United States Patent 10,407,724 (METHODS AND COMPOSITIONS FOR SCREENING AND TREATING DEVELOPMENTAL DISORDERS) - sequence listing, part 52

SEQ ID NO: 1212 - DNA, 144105 bp, Homo sapiens
atactgattaatgtttcatttattgttgctcaaagttagataacagtaggttcaaatagccactggattcttaaaaatctttagtaaaacaaaatacatgggaataatattagtgattaatccatacaataagcagattcattaagttagcattactttgctttcatagaatatttttcttcttgttaagaaaatataaaaatgaaattttacattggttcttgtcaaaatccaattaatagccaaataattatttctaagtgcaacttatttctaagtgcaatcagcccttaacttaagggcttattgaaacaaagccactgtaaaagagcttttcaagaagttacaatataatgggaaaataaatcggcccatacattttgttgcaaaaagtgaacaaagctaatcaaatacaggagaaaaaaatccgaacaattatgaactactttttaaaaataaaaagcatgctttgtgattaggtgtctttattctttctcttatcaatataaaaagtatttgtttgttttagaaaataccatcaaatattcccaataaagacttcatttcatcagcttcatcatcaggatgatacatactgggagaaagaagaaaaagtaaaaataactattttttaacacaatttattttaaaatacacaataaataatgtaatactaaacacaataaaataaacttgaagattgctatgaagttaatgtatcaaataaacttcagtatgcataactttgtaggaagtctgttggggaaaattagacttcataaaatgcaaatggtaggaactgtaaaggttatttctttaaatatattgaaaagttatgtcatttaataaaggtgtgaatggcctggtccaagggaagtgttgtttacaactaattgatcacaaccagttacagatttctgtttcttctgcatccccactgcttcacttgactagtcttaaacaaaagcaaaacagtgtgaacaggtctcaaatcttttgactcttcaaggagagagaaactgcaacacagtttccttttctaaaatggccagcagtgggggaacccatgagatttaatctgacattttcattgaacgtgttgattgtgaaataactggttaactaaaatacaacttcaacttttgaaaaattagctgatctcatctggatttctcaagtgactttaccctttacaaaattaacatactgtattcaaatcagtaaaagtaagtttatcaactcaatataatgtttgaataaacagcatcaaacatacgggttttcaaaaactgaggtatatgatgtttgaaacatcttaaagagcttagctcactgaggtttgaaaattttaatgtctttaataaatgaaatgttcaggctgtgatctttaaaatgaaaaggaaaacggaaggctgaatttctttgtgaaaagttttttattgatataatcttaaagtgtctttaaagagttcttacctgaaatcaacttcctttttacattcactgtttctaataaaaaaatccacttttttataatttgaagaatttgggtttttttcagagaaagtaaagcattgcttctcaatctctggtgacagattttgtggttttctttcttgaaaatggacctacatttgagataaaaaataacaatcattgaaagtttaagcactcgggcaaaatttaaaagaaaaacaaagaagtgcttcttcttacaataactgcatttccggcttgttgaggtaattttgtcatggaggatgcactgaacttgggcatagcagaatttgataaagaaatatccgacatctcatgtgatgaaacaaaactaaaaattaaaattaattatttgtaaaatacggcaaacaagaaaaaccattttaatttggatcataatgatttttggggaatatgatcaaagtttatcacatttatcacaaaaatgtaatgcattgtttctaatattcatggagagcttggtatatttcctttcctttagaccaaaccataatttacatatcccaaattaggaaaaagtactatttttaagggactatagaaataattattcaacaattttctttaaaattgagtcttatgcttaattgtctattacatagaaccctataaacattttctaaattccacttgcttaacttttaatctcctttctctattctggtctcattgtagttagacatctctagttatcttattagatataactgtatagaagaatttactctgaaccttctgtattaactcattcactaaaacacatttattattcactattatatgccagatattgtactagaagctgtgtatgaagtgataaagaaaacgtcagggagttaccatcaagcagacaatgaataaaaacaaatatataaataattataaatcctgaaattataaaaagaaaatgaactgggtaatagcataagaaataatagtgtggagccataagcccatttttaaaagatgatcatcaatgcatctctgatgaggtaaccatttaagttgacacctgaaggctaaaatgtaacagccatgtaaggagcaatgggcagtgtgggtggagacagggaagaatcacatatactgatagaattggatcgttttgtctctgactaataaatatatatacatggcaaggaattaaaatagtaaaaagtgtataaaagaaaaagcaggccaggcacagtggctcacacctataatcccagcattttgggaggttgaggtgggaggacagcttgagtccaggagtttgaggccagcttagtcaacatagcaagacccccatctctagaaaaaaaaaattttttttaattacccaggcatagtggtgtgtatgtacctgtagtcccagctacttgggaggccgaggtgggaggatctctttagcccaagagcttgaggctgcagtaagccctaattatgccactgtactctaccttaaataagtaaaaaagcaaatctcctttccaccccaaatcctcaggtcccacaggccttttccccagcagcaacttctacaccaggttctcagaggcttcttgttagaatccatttttaagcccacacatcttctgttggtcccttctaaactcttccaaaagtatttgttgttttttaaaggtgtggtgcacaaaactgttcatatgccttgttaccttcctccttatgatttacctactttttgcttctctacacctacagctttgtctcacttggatggttatatccgtttattctatgtcactcaagagttacaaccaaagaaacaaagtgataaaaagactcattttaagcaaatgttttaaaaagctattcagtgatttaagaaatcctaacatggaacaagggtgaatgagctcctggtcactggaactgtcttggtagaggtggcatgattacttgccagtgatgttgaatgatgattcaaagatccagtgagagggagactaaacaataccaaagtcgcccctagctctggaattctattaaaactatgagtctgtgatgctgatactaataatcagtaatggccaaataacagcaaaaattccaagggataccacaaatttagtatttttttttttttttttttttttttttttgagacggagtctcgctctgtggcccaggtggaagtgcagtggcgcaatctcggctcactgcaagctccgcctcccgggttcacgccattctcctgcctcagcctcccgagtagctgggactacaggcgcccgccatcacgcccggctaatttttttgtatttttagtagagacggggtttcaccgtgttagccaggatggtctcgatctcctgacctcgtgatccgcccgcctcggcctcccaaagtgctgggattacaagcgtgagccaccgcgagtatttttttaaagcagagaaataaataatccttaagtagaaaatcagaccctgaataaaaagttgttggtatttcttctgttttgaaaattttggctttggccatcatttctctcccttgacttctaatcaagtccagtatttcccaatgcattttgcattttttgtaaagatacttcaaattgaagatttataaaattatgttttccattctaaatctcttatgtttcctatatccttaaataacatctacctaggtgccatttattcttccctcttcctcaactatcatatcctatcaattgccacactgaatctgctctatttctgaaatgttttaaaaatccaaccctacctctctgttcccatcacttctgctgtagtttaggcctcattatagtctgtctttctcattggccaccatgcctctggcagtcccactccctacgattcactctgcatactgctgctaggatgattttttaaatcaaattgttttttctgtgcttaaatattttggatggtttctcactgcctaccatacaggtaaaaactagagggccctaggacacatctggcctacagatattattattatttggaggagggtgccacagagtatatcacatttttttgaattagttgtcaaaatttaaaaataataagatatcacataaaatttcagattcctagcttttcttgaaaagtcagaatattttataacactagactcacattgcctgcacagtaacaactgcttggagctgagtagtggctgctccctttagatgggacactctacagttggccttggcccaccaaatcttgaaggtatttgggtttgcgacccgactgggtacaggacaggtgtctaagcacagcactcaaagcccttacaataagacttcagcaacagactttgtgctgtggccacacataccacactttactgatctttgagcacgggataccttttcaagccttatccctttagagatgctttcttatacctggaatgcctatctgcctctgttctagttgtcaaactcctattcagttttcaagtcttgttaaaagtgaaggttcctgggctccagtcccagagacaaaaattcggtagatctaatgtggggcttaagaatgtgcatttttaatatgcacctcaaagtgattttgatgcaggtggtttcacaacagcactttgagaaatacacctctaagattaagagggtttaggttggctaataccttttagcatctgtgacatctaataacttgatccccatctccaactatgtgtcaaggggatataaagttgcaaatattacaaacctaagttctaaaacttgcctgtttgacatttctctttggaatttgctctttgactcttgaaggggtagcttacttcccctggtacttgaactcaaagtgtttccaaatcctatgtgaagagataacattttgaaacaaaatgccaagaaacagctgaatgaagcttttcacaagttctacaacgttctctccaacagatatgatctgattaaggaaggaatgaataattctcagtaacctaatttaatttgcatagaaaaattaggggcacaaggctaagggagtaaaactctaaaacatatagattagcttattagtaactatattaaaaggtcttcaagccacctgtgttgtggtaaaatacgtatttggtctttgactcctgtttctaactctactgggttggaagacacccagctggtattcactgtggaactgattgcttgcttggcgtgtgggaaaaaacccacacccatttggtcatagatgtcttctgggctgatcatggtgtgagagtgaggaaaaacagtttgtgtttttgcactcactctcgttatttatgtacttacattttcattcacataaatgatcaagttgaagttcactcaatattttcagtggtctgctcataatcatttaaagtgctctatacatgggggaaaatggcacttattgagactgattttcccagtgacaaagctgtgccgtcttaggactaggctacctcaaaggatcagtacacattgcctattaacttgcagtacccaatgacacttaagtttgaggtagggaacagtagttgtctggtgataaacaaaattgtgcctaatgaccccacatcatggagattctcctggcctattctgtgaaggtggtcaaatcctgttcttttcagaagcagtattagttctctaggtaattctaagggcccccaaaacaataacatttcaacttctaactgcttccctttgaaatactcttttaaaaacatgaggtggggtatggtaagtggtatctataattgtggaaataccagtctgcactgagaaggctgagggactgatttatttctgtcagccctaatgggagacagtatctccattgctatcttgtcacatactggccaaggttttcaattctctgttttagtgaaatagagtaaatttgcctttcactcaaagagctaataagcctcattattttggggttgtatatgatttaaatagaatttctagtacaggagaaactaatctttctttcttatttacttatttatgtattaacttatttatttacttcaagctgaaagtccatatttcaactagaaataaaagttattttctttgcaagcagatgaatagttttaaaaatgtatttttttgttcttcacaaatattagcagaccatttgtgatcttagaatggagaacaaaatagtctgtttcatgagagaaaattgaataaacaatttgaatttgacttttacaagagataggagcaatagaatagaaagtgctcatttgctacattatcatcatggaataaccttgatctctgttcttaggggggaaatgttctttgtagaagagtcacattttcagttttgctaaaaattataatcttaacaaaccaaatctaactaaacaagcacacacaacaaaggcaaagaaacttagttccaggagctgaaatgaaaaatattcaaagaattcctaatgaaatgattgcatgctaagtatgattttacctgatatttttgtcttctcagtatcagttgaaaagctagtaacttctaagttttcatcatcaaaatcatcccaaacttcatttcccaattcaaagttcacattcaaaacttctgaaaatagagaattgcttttatctgcatctgtcaaatgttggtttccagatatattaagatttctgttgaagaacactgtttgagagactttctcatttgaagttgtagaacagttacatctagaaaaatctgttatgtgtatgtataaaagactataggtactttttaaaccacaagcatcgtagtctattgatatatcaaacacatctttcaactactaaacagagttcttgagtaatagttttcaaaggcattgtgtcaagcattgttgaatactgtattcagccaattctattaactgtataaagttgcactaaatttaattttcaatacattttttaggcaattaatttttcctcttaattcccatattagaataactctactccaagattggattataatagtttctaaaatggtcttcctcctccagatcttctccctaaagttaattttcagtattgttataaaaggtatttgtccaaaataaataatatttatttttctcctgctaaaaaatcctcagtgttattcattgtttacagcctggatttagagccaaattacataagtgaaaattccacttctctcatttattagttgtatggtcttagacagtaattcaaacttcctgattctgcaaaataaggcaacaacagtacctacctcaaaagattgttatgaggcgctaaatgcctttagttgtacagttttacacagtattgtgctaataaatgtttaatagctacctctacaaaaagcgtatgcttatgtatacacatataagtttattataatctttgctgatgtaaaggctatacagcacacgttttacaaataacaacatatatggtatacttaaatgtaaattccatatatctaattgattctcattgaatgttttcattaagttttgccactgttttatctgtagtcaacctatggctgcaagtgacgaatgtagctctcatgtgaatgttgtttgatatttttgttgactctaacaagtaagatgaaaatattaataaaacaacaaagacatctgttgggatttcactcattcaccattgacttaagcaacttctttcctgaattagatagtaattttcaaatactagaagaatattctctcaattttttgtgttattcacaatgtaatggctacaataacaacacacatttgtttaatctacaatattaaaattttatccttcactttcttaagtctaaaaaataagcaaaacaataaatcaaacccagattggtagtatttgctgattcctatggtataaatgttcccaccataactgatttcaagctattaatgtgacataattgaataagaagttgggaaaaaatgcacgacagaaccctataatatagtatttctaccatatggataaataatctcgagaacacagataagagtaaaatgcagtagaacaattaggaagtgatgagttttgagtatttttgcctttgtttttaacataatttaattgaaagtttatgtaattaaattttcaataatggctgaaagattcttgaaaatttaataatcatctctcataagttagtataaacttgctccagcatatcactgagtttcctccactttaaatatcttctatgaatttcttcacctgtccaaacccttccttattcttcaactgtacctataactacagttcacattactctacttttgtatgttgatgtgcacacactgagacacacaatgtatatatgtactaaaaatggaagtttgtacagagtgcaatgggaatgcagaggaaggaggatctaaacctgcaatggaagtaagacatactcttctaaggtgataccacatgacagacagactcctgaggtgataacatatgaaggaagagtagtcggaatttcagcttgatagagctgtagttgtgaagcagggcaagagcaaagggaacctatgctatgaagggagaacaccatgtaaaagacacagcaatatgagagaacagagaatttggggagaactgtaagttttcaggatttctggagcacaaagttggagaaggcagggtccattgtgtctgcacaggtagttaagtgctagatcacgttgaagcttatttgccatattaaggagatttttttgttttttgtttttcttataggtaaaggataactattgaagatgtttcagcagaaggtttacacaaccagatatgtctgtcagatcactttgaatattatggattgaaggataatgagactgaaagcagagagaaaagtaagttattgcagtaaacaagagagaatgaatgcttaagctagagtatcagcagaaaggatagagtggaaataacaaatatgagagatgtgcaggaggcaaaataattaagatttggtgattatttacatgtggggtgagctatttagaaggacactttagcagcttaacaaagtaaagagttcattcattgagctaaggcaaaaagaaaaggtgtagagtgaggtaagaagaagacagagttcagatgctgacatgtctgatatgttaactgttaggtggatatgtccaggaaggtgattatacagatggatttggagttagaaagaaaggtctagatgggagatacagctttagaaattatcaaaacatagtcagtgattaaagacacgggcttgggtgatactgtataggaaaagtttttgaagtgagaagaataaaaaaaaaaaaaagaaaaaagaatccttttgcaacatcaacaggaagaaaagcccatgcagtctaagaagtaacaggagaccaacataatggttttactgaaatcaaaggagagatttccaaaagaaaggaaagaccagtagtatcaaatactatagaggtcaaagagattaacagttgaaaacagttcactgaattcagaacttagaaagtcactaaatggcctgaacaaaaacagcttcaaaggactgatacacagaaaacctaaattttaatgaataaagagtaactagggtataaggaagcgatgagcatactgagtgtcaattgctctttcaattaatttttgttttgatgagaaagcaagagatagagggtatggggactctagaattctgttttttgtctgcctggtatgctttcccttcttttagtgggagtaccctccctttcctttgaggaaactgcttctacaattctactggatcctagtaaggccgttattcatggtgccctgccttctctggggccacaggtatacaacgacccaatcgtcaggttactgggattgatcaagggataaacacatgactcaaatgaggccagttagaatgagctctggtctgccaaaactaacagggaagtctacctttttccactgaggcgctaaactggtaagatgtaagttaggggctacctgctgtgtgagaaaccctattaaaaagtaaagccaagtagcaacaggcatagctaaaagattgagagaaagccagaggcatgagtgccttgatttagccagaattaagccagatacttttcagtttacttgagacaattggttccttttcttgtgcttaagtcattttgagtagaatttttatcatttataataaaaaagtcatgaccagaagctgaagaaggaagagacttcagcatatttatatgctaaagggaaagacacagtggagaggaaacaatgaaaatatgggaaagaggagatggataatgatcttctaaagtcccagggaaagcaggattggatagaattaagattacaggaggagagatatgcctcgagtggaagaaaagataagttttcttttaagacaaatagatggttacagatggatgcagagacagggaaatatatagttgaggggtggggcaaaaagctgaaagagttcatatactactggttcaattttcagttctccactgatcactaaaagtcaatttcattttatagaaatggcattgggctgggaatcaaaagatatggaatctttttctggccttgccattaattagatatgaaatttttgggcaagtcatttaatctcttggagtcttggcttctttcactataaaatgagaaattgcataaaggtcccttccaatttaaatcttatgattcaacatgctttctcatataatttgtgacattttttcttcttccctttttgaaattggaatacagaagataaaaactgccatgctttttaaaaaacattctcaaaagcagtatttgaatacatttaaagtatgttttgccaccaaagactaatatgtgaaaaatataataaacataattagttattactaacagtaccagaaaccctaacagctttacatgcattatctcatttaatcctaaaacccctaaaatataaccagatgagcaacttagacaaagtggttaagtagattatgaaaggttatactaaatatcagagctaggacttggacagatggttttcagatcctgcgaacttaactactataccatgcagcaacttcttaaaaaaaaaatggcccactcagtaaaacagggatagagttattattgggggttaaagtatctagatgagactttaatatcataatataaattggatttggaatagtgagtgggaaagaaaagtaggaaaaccatgtaaatataacacaaaagtaagcagagggaaggatagacaagctcttgtatgcagaaggacaggtaataatgtagtaatataaggaaggagtaagttagagggctacatgttgaacaaagataaatataagaaggttgacaattttatacttcctatccgctttgtaatgacatccaggctttgaataagttggataaatgctctggttctccaggtgagattagggaacttttcttgatctcattattgggcctaatagctgccatggtatcacaagaggtagtgaatactccagcccttgactctgtaaaatcttaaattatgactagaggaaaaaaaagttacaacatgaagaaaaaaaaatgacagcatgaagaaaagaatgtcaacagaagccaatgccaaacacatgaaatgattttcagaaaaccccaagcttaccatttctacatacagccacttgaagaaataactcaatggataggattgtctcatgttttaacagactggctattaatagcattattcagggaaattatgctctattaattgcaggaaccagagtaatgatgaaccaggcagtgttgaatttatatgcattatctcattaatttaatgacggacacagataaaaaagcaaatctagattacaaactagctatatcccacaacctaagttattttctcatactaacatagaattgtaagaatcataggtttaagaattggagagatattaaaggtcacccagttcaataccttcatcttaaagataagactaaagcccaaagagattaaataacttgcccaaggtcacattgatattttgtaaaactggactagttttataaacataaaattattttaaataattctaatgatatatgaatgtaatcattcagtatgttaatactctatatacccaaggatcccttatttgctcaggttttcctcatagtatctttaaattaaaatagcattatgtaggaaagagatttttttttaaaaagtacaacaaacagagtaagaccatctcaataacagacccaagaatttgaaaatgattcagtaatctaagagaaaaatgttgccaagttaataatcataacaatttcagatgccggtgtttcaataacactactcgtcaattcaaagtaataataagccatttactctctcaagtaagtatcaatggtaatttacctttgtcttgatattcagatggttcttgtctaacttttccatagatttcaggctgatcccactgctccattataggcaattcagatatgtttaaatattctgacctttataaagataaaaccatgaaaatgttaaagaaaatatggaaattaatctaagcctgaaaactatttattcatataaacaaaaataatgatttatccatttaacacttctatgatacactggacccaggctgggtagcaaataaataggtgtttcatggaagtgaccaatactttcctttacatgcccttagttagataacaaaagccaggatctctagaagtactgctggcatctattctgatgagtcagttcctgttctgtactagttgttaaatacattgaatgtcattcctgcatatagaatgcccttatctagcagggaaattacatatatgattgtcctgtaggcatcaggatacaggaaaagaacaatgagttaccacctaaggccttctgcttgctaactaggaatatgaacttcagtttttccatctatacaatgggacgaaaaaatacctcattttatgggccatgttgttgtttaagtcagaaaatataatgcacaaatgtgtaattttcgtattataaatctgagatattattaatatggactgagcttctaaatggaaaggttagactgtacaccaacatgatttccattttaaagtatactcttgtcacttagtttatattccctataaagagagaacctaagggaatgacagaggataggtagtttcctagggaagagatgatctaatgaatgttatttcataactgcagagttctaaataaatttagggtatcaaagataatgaaaccattatgatgttattgcttcactatggaactaaacgataactgtgacttgatggtagccagtgactatctttccctgaataagtggttacctgcaggaacagagtttacgataaatattttaccttagatattaacattatatttgtaccttgatatactaggaagggaaggttttggagtaaaaccaaactctttaaggtccacactttgagatttattcatctgtatctattaatgaaacaaaaataagttcaactatcagtttcacatcaataacttgtaacacatgagccaaacaacaaaattcctgctggtacataaagtccccaaatcaatgaattaggagaaactcaggttagttcttgactcgaatatttcactcaggcccttcttaaatgttggcatttttttttttttttttgagatggagttttgttctttcacccaggctggagtgcagtggtataatctcagctcactgcaacctctgcctcccaggtttaagcaattctctgcctcagcctcctgactagctgggattacaggtgcccaccaccatgcctggctaatttttgtatttttagtagagacaggggtttcactatgttggccaggctggtctcgaactcctgaccttgtgatccacccgcctcggcctcccaaagtgctgggattacaggcgtgagccaccacatctggcctaaatgttggcattcttcatggttctttactaggtctcttcttacactacaccttctcaatcaaagatctcatttattcctgtggcttcaattgtcatctacatgtgaatgactctcaaatttctacttctcgctcagctctgtctcctgattttcaaacagttatatccagctgtctgtaggacatccttagctagacatcttgcaggccctctaaattcagtgtttcccaagttgaacttatcctgttctctatttcagcaaacttgcttttccttcagaatatctacctgaatgagaccccacttttctcccagttgctaatgccagaaacctgggcatcatttttgactgttccttctattttgtctcttataaccaatgaagtagcaaggtagcgattctacctctgaaaaatattttaacccagtcacttccctccattgctattgccactaccctaaactaggccattattttgcttagattattgtaaaaaccacctaatgagtccctttgttcctattctatcatcctctaatcccttttctacattgcagtcagagtgacttttacaaaatacaattttgatcatgtcactggttaaaatctttcattggcttctcagtactttcatgataaagtctaatcccttaaaatagcaaaaaggtctgcatgatctagctcctacttgcctcttcagcctcatctctctctactcctttacttgtaatcaaactctagacgtactgtattactgagaaagagtttctttaaagatccctctctctctctctttctttatacctctggacctttgtataatctctatgcttggaatatttagctatcccttcctacgatcattctggtgcctgcccctccatccttggcttatccttcaggtcccaatcacatctattaggaatcctttcttggtccatcaaatgtggattgagtaccttttctgtctaaacttaactgtgttgtacttctgtcacagaatcactcatcacactatattaaaaaagcatgtttacttacttgtatctctcactctactacaaattctatgattgggaataagactgtcttaatcgtcactgtatcttagcactttggcatattcttggtgctcaaagaagatggaaggaaagaagaaagatttagaagaaaaaaggaaagaagaaagaagggaagatggattatgaataatggtaatattcttagtcaagcccacaagtaattctatagtacactgtggatacctaattgacagacagaacaaagaatatttatatacgtttaactacagaacaatgggaaaaatgttattaaaactaaccttcagacgtttaactggaggaacagatgaaacagcattcctgtttcttaaatcagataaatatgaagaaattgttgactctttaatttctgacttctgtgcaactccaattttacctatgaaaagaaacttcagattctttaggttaaacttcagatcttattcttataaagtcaaatttctttaaaatttcaaatctagtatttacttttttcatgttgcccacagagagaaaattatttgcattattaagttgcataatataaatatcatacataattaggatgtcattactatccaccaaagacctttcaattttgaacactttaaataaacttgttttaaggaactcacagcagtcatgtccacatgtatgtttacttttacaaagatgattgcattctcggttcccaggttttttgctggcagtcgttcctaaattaatataagaaaaacaaatccatttgtcactacatttattattgttaatttaatataattaatttttatccagtttccttcctttcagacaatacaaaaatattgatttttatactttctcaagtgttttgtaatccacgtaattttttttttaataaagagatagggtcttgctatcttgcctaggctggagtgctatggctattcacaggcatgataattagtattacagcctcaatctcctgggctcaagagatcctcctgtttcagccttccaagtagctgggactacaggcacttaccaccatgcctggtaatttttaaaacatatttttgataagttactccctgccccactattactcccaacaagaaacatctagccacctacaagcttctctcaacctccctggtgtgtgtgtataatctccctggtgggtgtgtgtgtgtgtgtgtgtgtatactttatatatatataatatatatactttaaatatgtataatatatatactttatatataatatatatactttatatatatactatatactaatatatataatatatactatatataatatatactaatatatataatatatacactatatataatatatactaatatatattatatatactttatataatatatactaatatatataatatatatactttatatataatatatactaatatatataatgtatatactttatatataatatatactaatatataatatatatactttatatataatatatactaatatatattatatatactttatatatataatatatacttatatattatatatgcttatatataatatatacactaatatataatatatatactttatatattatattttatatatactttatatacattatattatatatatataaaatagggccaaatatggccacatatcagtaacttttttactaaatgaggtaagaatgagggtggagtttaaaaacacttctgttgctttgtactcaagcctgaaaaacctgtaaagaagtaaacattatggcattttgatggtactgctgacagaagttagtaaacaagatgtaatacatatttaatacatattagaaataaatgctttagggatctaagaaattagctatatgaatttacaggaaagagagattgtttccatcctgactcctctaagttagaattaatatatctaaatatatgatttactcttaatttattatattttaaatcagctttttcttgatcttagctctcactagtagcacggggaaggagagagatgtttgaactggtccttgaaggacagatggaaatacgaacatgagaatgagacaaagggaagatattccaggtggagggcaaatacccaaaagcagcaaatcaccgattgtaagagctgaaatcagcttatttttgctgcagcatagattttaagtgaaccagaaatgttggagatagtggagagcttgaaaactttacaacatttcttggtactttactcttcattttcggtaccattgttcagtcaagctttccaagtcatggcacgtctagacagtgataatatacatattgcagcctagggtaaatggatgaggctgctcaacatatgaggcaacggctggtccttagagctgaacagatcaatgtattgggtactgataaggtaaaaagaaaacacctgggcggctggaagctgacagctaaccacagtattcccaattgagcaaacaattttgagaatataaatacccagataaggccactctgtgaccatagtagaagaagacagagataagactaccatgtaaatgtttctgaaactagagaaaagaactctcaagaaacataaaaaataatgaaacatccccctcttctggctaacacagatgactactattttttaaatcctctcacttccaaaaaaaaaatgtaccaaaatatccaacatcttacttcctgagagcatccaatctagaactgatctctgctttccctaaaccttcctaagagtcacccagcacaagctgaaatcctataataagattctgaaatcctataataagattctgaaatcctataagaaaatcctcctggctccttgagatgacccacagttctgtggctatggtgctctcctttgctgcagtatgttaaataaacctaacgttcctcagacccaagtgtgttcctattaggcactgactgaaaggctttgactttaaactttgtaaagtgtgtcacgacttattgtttcaggtgttttgtcccaagtcatggtcctgttacctctcacttagatcagaactggtttctttgaatccagtcctccatgatacaatttattctacacattgttgcttatttaatacttttaaagtccaatgctgatcagaccaatttgcccacttagaaacatgagttacttcctactgccagcaaaatcaattccatcttcaaggtcctgcatgatccaattccagcttcccttcctgggacccatattagccctacatccatcaaaacacattcaattgccattcttcaaatagttccatgcctttttataactgtagctttgatactatctcttgtcttagaagaccctcatttccttgcccaacagatgcctaccaaccttcaagtctgactcaaatggcacctctgggttggaggtctatggtgatcacctgatctgatttccctctcctttgggcccctgtggcattttctctgtgcctcttgcttactgtatgctgccttatattgaatgtatttacagaaaaaacatagtggtgaagtacagggaacactaaaatagaaaaaaaatgagctctaatataggctcttatttgggaaaaaagatttaatatctgttctgtttacctcacagagacgtaaaaataaaatgtaatttaagtatgtaaaaacaattgacaattaagtgataaacaaatatattaatgtatatattatatccgctatctctactattacatcaatccaagattaaacaaataaattttaaactaaaattgttctgaatgctgtgaaggagtggtacatcatgctatgtggtaacaggtgaagctgttctggtcaggaacgttgggctgagcactgaagaaagaagggaagttaagaaggcaaagaaggaggagaaattagagttcaggcagaggggatagcatatgctaaagctctatgacaaggaaaagcatggcacattggggaaactgaaaggtcaatatgactgatgctagcaaatatgagaaagtatgtaagatgagactatagtggtagtaaaggcagcctatgtttgtaggggaacagttccaccatggcaccatggcaattgcatatctccatataggccatgtaggtaagactcaactgttggcagaatgccccatgatcatccttaaaaatggcaagataggtagtcttgtgaggagctatcaaaggccatttcacatttgctccataccttgcagaagaccctcgatcttgcagaagacttgccatgcggcagtttctcatctgcctccctgattccactaaggtatggaactttccattttgcccctttcagataaaactgcttagctgaagcctagagttcacttctcaaaaacaaagcaacccaccactcatgttgtctgtcatctgacccccctagtttggtatcatcctgtggaattggggatgtaagcagctaataccatgctgatcttgctttgccatctgtgtaagtaataaactgtttaaatccattagggtgtccttaccagccaaatctacagaagtgaggcaagaccacatagcagctaccactacattgctgcttagggactggttgaccatgtgaccatatagaaccttctaggggatgctaatgatttagattctaagagctatgggaagccactgaaatgttttaaccgaagagggggcacaatcagatctgcattgtgaaaaacgtcaccatatagagtgtaatatggagaacagatttgagataagacagaaaggatgcaagaaaaccagtacaagtctaagcagaaatcatggtaactccagagtggtggtggtagtagagttacagagaatagactgatttgagagatatacagaaggtaaaaatatttttaatgcagaatcaagtggagtggttttctttcttgagcagcatattgcttcccctgaagttttgcagccttcctttttgtctagcaatatccatcttgtttctttaagttcactcaatagttgaagggtaaaagcaaatacatgggaatacctcacccatttattcccccctcatcaatgcctccttccttgaaccctctatctgcctcctaatgcaatctagacctgtcctgtaactgtcacctttgaacttcctttcattaagttcctgggctgaatctactacaaatggattcttgggctttttctttcttgttttactggtgctcaattttgagcaactgcctaagaaaggatgtataagaataaaattttctgaatctttgaatgtattaaggcatctttatattactttcatacttagtagtttggctgggcatagaacataaggttgaaaatcatttttcccttggaattttattttttattattacagttttggagacagggtctcgctctgtcacccaggctggagtgcaggtgtgagaccacagctcaccgcagcctcgaactcttgggcgcacgcactcctgccttctcattcttccaagtagctgagattacaggcacaaaccactgtgcctggcttccccctggaattttaaatcaattgacttttagcatccaacattgctcactaaaagactattacatttttaaatttttgtgcctcgtaagcatttacaattttgtctttatccacaatgttctgaaatattgcaattagctttatttgtagacctttcattcatcctaactagcattaagtaagactttttaatgtgaagatttctgtctcacttcagttctgaaaacgtttctcaaattatttcttctgatttgtttgttctttcttgaacacttataagttagatactgggttcttaaattgccccccttttctcttatattttctgtctccttgactttttgctttcattgagaaggtattgactttatgttcgagacctccggttttccttccaaacataatttttgcttctctgtgcttgctctggttctttttattttaaaatggcatcctattcagttttgtggttgcaatttaatctttaatttctcggacgttactaaagttttatattaggttttattacattcctgaattatcctgttgctctttcatccattttctatttccttattttggactttcacacattctacattttcctaaaatgtctcatcacccttggttgtctgcctataaggttcctattatatctccatttcacctatgagaaaattaattcttacagaggttaagtaagatgctcaagactatgctgttagtaagtagcaaatttgagattctaattcaaggtagtctaattccagagactgatctatcaacaattctctctctagttgtaccagttgctttagctctcccagaggattcatttaagttatttagagaaggaacctttgttttgaggtgggaagacttggaagaaaagctttgcaagttgctgttttaaaatgaagaataaagagttgcctttgggtcttaaatactaaagaacttctaaaaaagatgcatgtctaaacgctgccacaaggtggtgcacaatgactaagcacatttgctcccagtggcagcaactaggatctgggactctaattagagagattccgagggctcccaaaaatttcaaggcaaagttggcaagtcttgtcaggaatgaggactgtatgcaagttttgtttgtttgtttatagaacactagcacatggatactacctgacgaaatctttttgctgtatttttgttacgaatggtactttgaaaataaaagtgctccctttaccctgccgccctccctacctcctgagaattgtctgaatttatcttattagcaaatataagcttacagatattggtaattagaaagataaggttctcagaaaaaaaataatctaagctgtactcttctgagaaaaagtctggctctatcacctaggcaggagtgcagtggcaccatcacggctcactgaaacttcagcctcccaggctcaagtgatcctcccaactcagccccctcagtagctgggactacaggcatgcaccaccacacccagctaatttttgtattttttgtagagacagggtttgtaaagaccagccatgttgcccaggctggtctcgaacctgtaagttcaagcaatccacccacttcggcctcccaaagtgctgagactacaggtgtgagtcactgtgcccagcctaagctgcactcttaagtatactctaaagatagcagattccatattccatcactgtcataatctgaggtgcaaatattttcatagttttgccacatattgtattaatttacatgttataaagtctctagttccaagcatttaaagtaaatttattaataatatcaaatagaaatgtattgaaagaaaatacttaaaattactttaacagagtcattaacaggtggcggggcaagggtcacttctttaaaaaaagaagtccagacaataaataaaaaatagcaagaatctctgtcacacttagcataactttctaattataaattcaaataatttggtctgtgcagaagctactggagtatttttttagtattactttcacttttgcagttctccatttatgctaatcatagatttatgcaattcatggttttactttttttaatgatgagagagtctccttttcatttttctgtcaaatattttactatcattttgttatttatttatgcagaaaaggaatacactgaactggagtccttgattttgcaacttaatgcacatacacaccaaagaatataaagaaaagtagactgccttttaactagtatttaaatgtacacacaatgtgcctgaggactggctttatccttgtattcattcaactacattaattattattattattatattattattattttttttttgagatagagttttgcctttgttgcccaggctggagtgcagtggtgcaatctcaactcactgcaacctccgcccaaggctcaagtgattcacctgcctcagcctcccgagtagctcgtattacatgggattacaggtgcctgccaccatgcccagctaatttttgtatttttagtagagatggggtttcaccacattggccaggctagtctggaattcctgacctcaggtgatctgcctgccttcggcctcccaaattgttgagattacaggtgtgagccactgtacctagctccaagacattcatattcagaataatactgcaaatgaagataaatgtattaatgtcaaatagattttcttcaaattaagcaaagcctgtaattcttatttagaatgcatttaaaggataagaagtttaaatgcctaatcttcatatactgagagcaggcctgaaaattttttaatttttgtttttacaacttaaaaatatgtctcacattgccatatattaaaaataacaaaaatgttcttcctcaaattatacaagaattttatctcttggaactataaccatatgtgagaaactgcagctaaaagaatgttttcaaaaagtttgatatggtttggctgtgtcctcacccaaatctcatcttgatttgcagctcccataatttccacatgttgtgggagagacctgggggagataattgaatcatgggggcagtttcccccatactgttcttgtggtagtgaataagtctcacaagatttgatgattttataaggggtctctcctttcggctggctctcattctctcttgtctgccaccatgtaagacgtgcctttcactttctgccatgattgtgaggcctccccagccacgtggaactgtgagcccatcgaacctcattttctttataaattacccagtctcagttatgtctttatcagcagcatgaaaacggactaatataagttgtagaaagcatgaaaagaatttttcattattttatattccctaaggtgcatgtttttgtttttatatatagtcctataatttgatgatatacaaaattgaaacatttgttcaacttgaaagcatatttggaaatagccatttagcaattatattctctgaactaaatatcagtttgtatcatttaataacaccatttgacaagggattagaacaactgaaatttggattgttttgaaaaggcccaaatttggtgtcacagccttagtagggtaatctattgccccttaattgtgtcagttactaagaaagagtgtatgtatgttaggtttagaggtataattgtgtatctttatccagggatatataaatttgcatataaaaattgaattgtacaatacggatgtgcataagttcctaagatttggatgattacatacagtagcccccttcatccatgattttgctttccacagtttcagttacccaaggtcaactctggtccgaaaatattacatgaaaattttcagaaataaatatttcataagttttaaattgtacatcattctgagtagcatgatagaatctcaggctgtcccacttcactctgtcctggatgtgaatcattcctttgcccagcatatccaggctgtatatgctacccaccccttagtcacttggtaggtgtctcaatgatcaaatcgacggtcatggtatcacagtacttgtgttcaagtaacccttgttttacttagtaatggccccaaagcacaagagtagcaatgctggcaatttggatgtgccaaagagaagctgtagtttcctttaagtgaaaaggtgaaagttcttgacttaataaggaaattatatatatagagttcagtactacccacaacagagaaatatcagcacccctagaaactatctttctgtcctattctagtcaactttgtcaagagtaatctttatcttgacttttaacagcacagattagtatattagttttctagggtggctataacaaagtaccacacactggatggcttaaaacaacagaaatttattctttcacagttctgaagattaaaagtctgaaataagttgctggcagagccatactccctctgaattctctaggagaggatccttcctcaactcttccagtttctgatagctctagacatttcttggcttgtgggagcataactataatctctgcctctgtctttgcatggctgtctttcctctgtattggtattcttatggagttttcttggtgtctgtgtctttttgccttttcatataaggacaccagtcatattggattaggatgcagtcatattggattagggtccaccttaacttgattatatctgtaaactctattccagataagatcacattcacgaccgaggagccaagatggccgaataggaacatctccagtctacagctcccagtgtgagcgacgcagaagacgggtgatttctgcatttccatctgaggtaccgggttcatctcactagggagtgccagacagtgggcacaggtcagtgggtgcagtgcaccgtgcgccagccgaagcaaggcgaggcgttgcctcactcgggaagcgcaaggggtcagggagttccctttcctagtcaaagaaaggggtgacagacggcacctggaaaattgggtcactcccacccgaatactgcgcttttccgacgggcttaaaaaacggcgcaccacgagattatatcccgcacctggctcagagggtcctacgcccacggagtctcgctgattgctagcacagcagtctgagatcaaactgcaaggcggcagcgaggctgggggaggggtgcccgccactgcccaggattgcttaggtaaacaaagcagccgggaagctcgaactgggtggagcccaccacagctcatggaggcctgcctgcctctgtaggctccacctctgggggcagcgcacaggcaaacaaaaagacagcagtaacctctgcagacttaaatgtccctgtctgacagctttgaagagagcagtggttctcccagcatgcagctggagatctgagaaggggcagactgcctcctcaagtgagtccctgacccctgacccccaagcagcctaactgggaggcaccccctagcaggggcagactgacacctcacacgtccgggtactccaacagacctgcagctgagggtcctgtctgttagaaggaaaactaactaacaaacagaaaggacatccacaccaaaaacccatctgtacatcaccatcagcaaagaccaaaagtagataaaaccacaaagatagggaaaaaacagagcagaaaaactggaaactaaaaagcagagcacctctcctcctctaaaggaacgcagttcctcaccagcaacagaacaaagctggacggagaatgactttgacgagctgagagaagaagtcttcagacgatcaaattactccgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatgaattggaagaaagggtatcagcgatggaagatgaaatgaatgaaatgaagcgagaagggaagtttagagaaaaaagaataaaaagaaacgagcaaagcctccaagaaatatgggactatgtgaaaagaccaaatctacgtctgattggtgtaccttaaagtgacggggagaatggaaccaagttggaaaacactctgcaggatattatccaggagaagttccccaatctagcaaggcaggccaacattcagattcaggaaatacagagaacgccacagagatactcctcaagaagagcaacaccaagacacataattgtcagattcaccaaagttgaaatgaaggaaaaaatgttaagggcagccagagagaaaggtcgggttaccctcaaagggaagcccatcagactaacagcagatctcccggcagaaactctacaagccagaagagagtgggggccaatattcaacattctttttttttttttttttttttttttagtatttattgatcattcttgggtgtttctcggggagggggatttggcagggtcataggacaatagtggagggaaggtcagcagataaacatgtgaacaaaggtctctggttttcctaggcagagggccctgctgccttccctagtgtttgtgtccctgggtacttgagattagggagtggtgatgactcttaaggagtatgctgccttcaagcatctgtttaacaaagcacatcttgcaccgcccttaatccatttaaccctcagtggacacagcacacgtttgagagcacagggttgggggtaaggttatagattaacagcatcccaaggcagatgaatttttcttagtacagaataaaatggagtctcctatgtctacttctttctacacagacacagtaacaatctgatctctctttcttttccccacatttcccccttttctattcaacaaaaccgccatcgtcatcatggccctttctcaatgagctgttgggtacacctcccagacggggtggcggccgggcagaggggctcctcacttcccagacgggccggccgggcagaggcgccccccacctcccggacggggcggctggtcaggtgggggctaccccccacctcccggatggggcagctggccgggcgggggctgccccccacctcccggatggggcggctgccgggcggagacactcctcacttcccagatggggcggctgccaggcggaggggctcctcatttctcagatggggcagccagtcagagacgctcctcacctcccagacggggtggtggcggggcagagacactcctcagttccaagacggggtcgcggccggacagaggcgctcttcacatctcagacggggcggcggggcagaggcgctccccacatcccagacgatgggcggccgggcagagatgctcctcacttcctagacgggatgacggccaggaagagacgctcctcacttcccagactgggcggccgggcagaagggctcctcacatcccagacgatgggcggccaggcagagatgctcctcacttcctagacagagtggcacctgggcagaggctgcaatctcggcactttgggaagccaaggcaggcggctgggaggtggaggttgtagcgagccaagaacacgccactgcactccagcctgggcaacattgagcactgagtgagcgagactccgtctgcaatcctggcaccttgggaggctgaggctggcagaacactcgcagtcaggagctagagaccagcccggccaacacagcgaaaccccgtctctaccaaaaaatacaaaaaccagtcaggcgtggcggcgcgcgcctgcatcccaggcactcggcaggctgaggcaggagaatcaggcagggaggttgcagtgagccgagatggcggcagcacagtccagcctcagctcagcatcagagggagaccgtgcaaagagggagagggagacgagagggagagggagagggagagggtcaacattcttaaagaaaataattttcagcccagaatttcatatccagccaaactaagcttcataagtgaaggagaaataaaatcctttacagacaagcaaatgctgagagattttgtcaccaccaggcctgccctaaaagagctcctgaaggaagtgctaaacatggaaaggaacaatcggtaccagccgctgcaaaatcatgccaaaatgtaaagaccatcgagactaggaagaaaactgcatcaactaacaagcaaaataaccagctaacatcataatgacaggatcaaattcaaacacaacaatattaactttaaatgtacatggactaaatgctccaattaaaagacacagactggcaaattggataaagagtcaagacccatcagtgtgctgtattcaggaaacccatctcacaggcagagacacacataggcttaaaataaaaggatggaggaagatctaccaagcaaatggaaaacaaaaaaaggcaggggttgcaatcctagtctctgataaaacagactttaaaccaacaaagatcaaaagagacaaagaaggccattaatcaatggtaaagggaccaattcaacaagaagagctaactatcctaaatatatatgcacccaacacaggagcacccagattcataaagcaagtcctgagtgacctacaaagagacttagactcccacacattaataataggagactttaacaccccactgtcaacattacacagatcaacgagacagaaagtcaacaaggatacccaggaattgaactcagctctgcaccaaccggacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcattcagaaccgctcaactacatggaaattgaacaacctgctcctaaatgactactgggtacataacgaaatgaaggcagaaataaagatgttctttgaaaccaacgagaacgaagacacaacataccagaatctctgggacacattcaaagcagtgtgtagagggaaatttatagcactaaatgcccacaatagaaagcagaaaagatccaaaattgacaccctaacatcacaattaaaagaactagaaaagcaagagcaaacacattcaaaagctagcagaagtcaagaaataactaaaatcagagcagaactgaaggaaatagagacacaaaacacccttcaaaaaattaatgaattcaggagctggttttttgaaaggatcaacaaaattgatagaccgctagcaagactaataaagaagaaaagagagaagaatcaaatagacacaataaaaaatgataaaggggatatcaccaccgatcccacagaaatacaaactaccatcagataatactacaaacacctctacgcaaataaactagaaaatctggaagaaatggatacattcctcgacacatacactctcccaagactaaaccaggaagaagttgaatctctgaatagaccaataacaggagctgaaattgtggcaataatcaatagcttaccaacgaaaaagagtccaggaccagatggattcatagccgaattctaccagaggtacaagtaggaactggtaccattccttctgaaactattccaatcaatagaaaaagagggaatcctccctaactcattttatgaggccagcatcatcctgataccaaagacgggcagagacacaaccaaaaaagagaattttagaccaatatccttgatgaacattgatgcaaaaatcctcaataaaatactggcaaaccgaatccagcagcacatcaaaaagcttacccaccatgatcaagtgggcttcatccctgggatgcaaggctggttcaatatacgcaaatcaataaatgtaatccagcatataaacagaaccaagacaaaaaccacatgattatctcaatagatgcagaaaaggtctttgacaaaattcaacaacacttcatgctaaaaactctcaataaattaggtattgatgggacgtatctcaaaataataacagctatctatgacaaacccacagccaaaatcatactgaatggacaaaaactggaagcattccctttgaaaactggcacaagacagggatgccctctctcaccactcctattcaacatagtgttggaagttctggccagggcaattaggcaggagaaggaaataaagagtattcgattaggaaaagaggaagtcaaattgtccctgtttgcagatgacatgattgtatatctagaaaaccccattgtctcagcccaaaatctccttaagttgttaagcaacttcagcaacgtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaagaaaataaaagagcatacaaacaaatggaagaacattccatgctcacgggtaggaagaatcaatatcatgaaaatggccatactgcccaaggtaatttacagattcaatgccatccccatcaagctaccaatgactttcttcacagaaatggaaaaaactactttaaagttcatatggaacaaaaaaagagctcgtatcaccaagtcaatcctaagccaaaagaagaaagctggaggcatcacactacctgacttcaaactatactacaaggctacagtaaccaaaacagcatggtactggtaccaaaacagagatatagatcaatggaacagaatagagccctcagaaataacgccacatatctacaactatctgatctttgacaaacccgacaaaaacaggaaatggggaaaggattccctatttaataaatggtgctgggaaaactggctagccatatgtagaaagctgaaactggatcccttccttacaccttatacaaaaattaattcaagatggattaaagacttgaacgttagacctaaaaccataaaaaccctagaagaaaacctaggcattaccattcaggacgtaggcatgggcaagggcttcatgtctaaaacaccaaaagcaatggcaacaaaagccaaaattgacaaatgggatctaattaaactaaagagcttctgcacagcaagaaaactaccatcagagtgaacaggcaacctacagaatgggagaaaattttcgcaacctactcatctgacaaagggctaatatccagaatctacaaagaactcaaacaaatttataagaaaaaaacaaccccatcaaaaagtgggcaaaggacatgaacagacacttctcaaaagaagacatttatgcagccaaaaaacacatgaaaaaaggctcaccatcactggccatcagagaaatgcaaatcaaaaccacaatgagataccatctcacaccagttagaatggcaatcattaaaaagtcaggaaacaacaggtgctggagaggatgtggagaaataggaacacttttacgctgttggtgggactgtaaactagttcaaccattgtggaagtcagtgtggcgattcctcagggatctagaactagaaataccatttgacccagccatccccttactaggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaatcatcattctcagcaaactatcgcaagaacaaaaaaccaaacaccgcatattctcactcataggtgggaaatgaacaatgagaacacatggacacaggaaggggaacatcacactctggggactgtggtggggtggggggagggggaagggatagcattgggagatatacctaatgctagatgacgagttagtgggtgcagtgcaccagcatggcacatgtatacatatgtaactaacctgcacattttgcacatgtaccctaaaacttaaagtataataataataaataaaataaaaaataatcaaaataaaataatgccaaagaaggaaaaaaaaaagatcacattcacaggtaccagggattagaccatcaatgtatgtttttgtgaaacacaattcaaaccatgagagttagtagtgcttatttttgcaatttatatacatggactcatacagtattacctttttgtgtctggcttcttttgcttaactttatgttagtgatattcattcatattgttgtgtgtagtcataggtaattcaatctccttgctctatagcaggggttggaaactatagttcatgggccaaccatctatttttgtaaataaagttttattggaatacacccatgtctattcatttacatattgtctatggctgcttttgggttgcaaacacctacaaagacagagttgcatagatataaagaagatctatagtctgcaaaccaaaaacatttactatctggccttttaggaaagttttctgacccctgtagaattgtattgggtcaatataccacaatttatttgtccatctaactgctgatgagcttttggctggtttccattttagggctaatatgatagtactgctatgaacattccaaaatacatcttttggtgaacatatatgcacacttttatctggtatatacctagaagcagaattgctctatcacataatatgcaaggggaattactctatcatagaatgcatatgctaaactttaataaatactgctagttttcggaagtagttgtatcaatctataatcacattagtgattaagagtagtagttgttatatatccttatcaatacttggtattttctttttcacttaagtccttttgatggttgcacaatgatacagcaatatctcattgtagattttcattctcactttgtctaatgaacttaaatactctttcataggttcctgactttttggatatcctctattttgaagtgtctgtttaattgagtacccatttttaaaatgtttacttatacatataggagttctttatatattatgtaaaatcgttctttccagtgtattaatttgttaaggctgccataacaaagtggcagattgagtggcttaaacaactgaaatttattgtttcacaattctagaggctacaagtccaagatcaaggtgttggtagggttggtatctcctgaggttcctctccttggcttgtgaatggctctctctcattgtgtcttcacatgatcttccctccatgtgtgcctgtatcctaatttcctcttcttataagaacaccaggcatattggattggggttcacactaaggaaccctattttaattcaattatcttttacagaccctatctccaaatatagtcgcattctgaggaattcagcatatttatttgggggtaaacacaattcagcccataacagccaggtatatgtattccatttttttcctcacattctgtgagttgcacccttcactcttaatggtatctttttgatgaacagagttcttaattttaacatagtcaaattcattatgtttttatggttagaaagttttgtgccctgtttttttaaaaaagtcaacctatcccaaggtctcgaagacctattttttctcctctaaaagttttattgtttttctttcacatttaaatcagtcatctatttgcaaataagttttgtgtacagtgtgaggtcagagttgacatacaattttttctttctttttttttgagacggagtctcactctgtcacccaggctggagtgcagtggcaatctcggctcactgcaagctctgcctcccaggttcatgccattcacctcccgagtagctgggactacaggcacctgctaccatgcccggctaattttttgtattttttagtagagatggggtttcaccatgttagccaggatggactcaatctcctgacctcatgatccgcccaccttggcctcccaaaatgctgggattgcaggcgtgagccaccgcgcccagactgacatacaattttttccatatggacatccagttgatctagcagcatttattgaaagactgtccgttttccaactgcatggcacttcacctttgtcagaaatcaatgactgtattatttgtaggtgtatttctggactctagtccattccactggttaatgtgtctatccttatgcctacatcacattcttattatctactgtttaataacaggtcttgatatctagtaaagtaggttgcccaatatgtttttcttcaagtttgccctgactaccctgtccttttgaattttcatatgaattttataattagctggttatttcagaaaaaaaaatgacaacaacaacaaaaccctgctgaaattgggatgacactgaatataaagattaatttggggagaactgacatctttataatattaaacttttcagttcttgaaacggtatcttaattaagtatgttttccctaatttcccttaaacaatgatttttagttttcatgtagtggtcttgagcatcttttgttattctattacaaggttgatattttatactactgtaaatgctgttttagaattataattttgaggggaggagccaagatggccaaataggaacagccccagtctacagctcccagcgtgagcgatgcagaagacaggtgatttctgcatttctaactgaggtaccgggttcatctcactggggaatgtcagacagtgggtgcaggacagtgggtgcagtgcaccaagtgtgagccaaagcagggcgaggcatcgcctcacccgggaagcacaaggggtcagggaattccctttcctagtcaaagaaaggggtgacagacggcacctggaaaatcgggtcactcccaccctaatactgcacttttctaatggtcttagcaaacggcacaccaggagattatatcacgcgcctggctcggagggtcctacagccacagagcctcgctcattgctagcacagcagtctgagatcaaactgcaaggtggcagcgagtccgggggaggggcacccgccattgccgacgcttgagtaggtaaacaaagcagccgggaagcttgaactgggtggagcccaccacagctcaaggaggcctgcctgcctctgcagactccacctctacgggcagggcatagccaaacaaaaggcagcagaaacatctgcagacttaaatgtccctgtctgacagctttgaagagagtagtggttctcccagcatgcagctggagatctgagaacaggcagactgcctcctcaagtgggtcccttacccccaagtaggctaactgggaggcgtcccccagtaggggcagactgacaactcacacagccgggtacccctctgagacaaaacttccagaggaacgatcaggcagcaacatttgctgttcaccaatatctgctgttctgcagcctccgctgctgatacccaggaaaacagggtctggagtggacctccagcaaactccaacagacctgcagctgagggtcctgactgttagaaggaaaactaacaaacagaaaggacatccacaccaaaaccccatctgttcgtcaccatcatcaaagaccaaaggtagataagaccacaaagatggggaaaaaacagagcagaaaaactggaaactctaaaattcagagcgcctctcctcctccaaaggaacgcagctcctcaccagcaacggaacaaagctggacggagaatgactttgatgagttgagagaaggcttcagatgatccaactactccaagctaaaggaggaagtttgaacccatggcaaagaagttaaaaaccttgaaaaaaaattagatgaacagctaactagaataaccaatgcagagaagtccttaaaggacctgatggagctgaaaaccacagcacaagaagtacctgacgaatgcacaagcctcagtagctgatccgatgaactggaagaaagggtatcagggatggaagatcaaattcatgaaatgaagcgagaagagaagtttagagaaaaaagaataaaaagaaacaaacaaagcctccaagaaatatgggactatgtgaaaagaccaagtctacatctgattggtgtacctgaaagtcacagggagaatggaaccaagttggaaaacgctctgcaggatattatccaggagaacttccccaatctagcaaggcaggccacattcaaattcaggaaatacaaagaatgccacaaagatactcctcaagaagagcaactccaagacacaaagttgtcaaattcaccaaagttgaaatgaaggaaaaaatgttaagagcagccagagagaaaggttgggttacccacaaagggaaatccatcagactaacagctgatctcttggcagaaactctacaaaccagaagagagtgggggcaaatattcaacattcttaaagaaaagaattttcaacccagaatttcatatccagccaaactaagcttcataagtgaaggagaagtaaaatcctttacagacaagcaaatgctgagagatttttgtcaccaccaggcctgccctaaaagagctcctgaaggaagcaataaacatggaaaggaacaactggtaccagccactgcaaaaacatgccaaattgtaaagaccatcgaggctaggaagaaactgcatccactaatgagcaaaataaccagctaacatcataatgacaggatcaaattcacacataacaatattaaccttaactgtaaatgggctaaatgctccaattaaaagacacagactggcaaactggagaaagagttaagacccatcagtgtgctgtattcaggaaacccatctcacgtgcagagacacatataggctcaaaataaagggatggaggaagatctaccaagcaaatggaaaacaaaaaaaggcaggggttgcaatcctagtctctgataaaacagactttaaaccaacaaagatcaaaagacacaaaggccattataatggtaaagggatcaattcaacaagaagagctaactatcctaaatatatatgcacccaatacaggagcacccagattcataaagcaagtccttagagacctacaaagagacttagactcccacacaataataatgggagactttcacaccccactgtcaacattagacagatcaacaagacagaacgttaaaaaggatatccaggaactgaactcagctctgcaccaaccggacctaatagacatctacagaactctccaccccaaatcaacagaatatacattcttgtcagcaccacaccacacctattccaaaattgaccacatagttggaagtaaagctctcctcagcaaatgtaaaagaacagaaattataacaaactgtctctcagaccacagtgcaatcaaactagaactcaggattaagaaattcactcaaaaccgctcaactacatggaaactgaacatcctgctcctgaatgactactgggtacataacgaaatgaaggcagaaataaagatgttctttgaaaccaatgagaacaaagacacaacataccagaatctctgggacacattcaaagcagtgtgtagagggaaatttatagcactaaatgcccacaagaaaaagcaggaaagatctaaaattgacaccctaacatcagaattaaaagaactagagaagtaagagcaaacacattcaaaagctagcagaagtcaagaaataactaagatcagagcagaactgaaggaaatagagacacaaaaaacccttcaaaaaaatcaatgaatccaggagctggttttttgaaagataacaaaattgatagaccgctagcaagactaataaagaagaaaagagagaagaatcaaatagacacaataaaaaatgataaaggggatatcaccaccgatcccacagaaatacaaactaccatcagagaatactataaacacctctatgcaaataaactagaaaatctagaagaaatggataaatttctggacacatacaccctcccaagactaaaccaggaagaagctgaatctctgaatagaccaataacaggctcagaaattgaggcaataattaatagcttaccaaccaaaaaaagtccaggaccagatggattcacaactgaattctagcagaggtacaaggaggagctggtaccattccttctgaaactattccaatcaatagaaaaagagggaatcctccctaactcattttatgaggccagcatcatcctgataccaaagcctggcagagacacaacaaaaaaagagaattttagaccaatatccctgatgaacaccaatgcaaaaatcctcaataaaatattggcaaactaaatctagcagcacatcaaaaagcttatccaccatgatcaagtgggcttcatccctgggatgcaaggctagttcaacatatgcaaatcaataaacttaatccagcatataaacagaatcaacaacaaaaaccacacgattatctcaatagatgcagaaaaggcctttgacaaaattcaacaacccttcatgctaaaaactctcaataaattagttattgatgggacgtatctcaaagtaataagagctatctatgacaaacccacagccaatatcatactgaatggacaaaaactggaagcattccctttgaaaactggcacaagacaaggatgccctctctcaccactcctattcaacacagtgttggaagttctggccagggcaatcaggcaggagaaggaaataaagagtattcgattaggaaaagaggaagtcaaattgtccctgtttgcagatgacatgattgtatatctagaaaaccccatcatctcagcccaaaatctctttaagctgataggcaacctcagcaaagtctcaggatacaaaatcaatgtgcaaaaatcacaagcattcttatacaccaataacagacaaacagagccaaatcatgagtgaactcccattcacaattgcttcaaagagaataaaatacctaggaatccaacttacaagggatgtgaaggacctcttcaaggagaactacaaaccactgctcaatgaaataaaagaagatacaaacaaatggaagaacattccatgctcatgggtaggaagaatcaatatcatgaaaatggccatactgcccaaggtaatttatagatacaatgccatccccatcaagctacaaatgactttcttcacagaattggaaaaaactactttaaagttcacatggaaccgaaaaagagcccgcattgccaagtcaattctatgccaaaagaacaaagctggaggcatcacactacctgacttcaaactatactacaaggctacagtaaccaaaacagcatgatactggtaccaaaacagagatatagaccaatggaacagaacagagccctcagaaataatgccacatatctacaaccatctgatctttgacaaacctgagaaaaacaagaaatggggaaaggattccctatttaataaatggtgctgggaaaactggctagccatatatagaaagctgaaactggatcccttccttacaccttatacaaaaattaattcaagatgcattaaagacttaaatgttagacctaaaaccataaaaaccctagaagaaaacctaggcaataccattcaggacataggcatgggcaaggacttcatgtctaaaacattaaaagcaatggcaacaaaagccaaacttgacaaatgggatctaattaaagagcttctgtacagcaaaagaaactaccatcagagtgaataggcagcctacagaatgggagaaaatttttgcaatctactcatctgacaaagggctaatatccagaatctacaatgaactcaaacaaatttacaagaaaatatcaaacaaccccatcaaaaagtggttcgtgaaggatatgaacagacacttctcaaaagaagacatttatgcagccaaaagacacatgagaaaatgctcatcatgattggccatcagagaaatgcaaatcaaaaccacaatgagataccatctcacaccagttagaatggtgatcattaaaaagtcaggaaacaacaggtgctggagaggatgtggagaaataggaacacttttacgctgttggtgggactgtaaactagttcaaccattgtggaagtcagtgtggcgattcctcagggatctagaactagaaataccatttgacccaacaatcccattattgggtatatatccaaaggattataaaacatgctgctataaagacacatgcacacgtatgtttattgtggccctattcacaatagcaaagacttggaaccaacccaaatgtccaacaatgatagactggattaagacaatgtggcacatatacaccagggaatactatgcagctataaaaaatgatgagttcatgtcctttgtagggacatggatgacgctggaaaccatcattctcagcaaactatcgcaaggacaaaaaaccaaacactgcatgttcttactcataggtggaattgaacaatgagaacacatagacacaggaagtggaacatcacactctggggcctgttgtggggtgggggggagggggaagggatagcattaggagatatacctaatgttaaatgatgagttaatgggtgcagcacaccaacatggcacatgtatacatatgtaacaaacccgcacgttgtgcacatgtaccctaaaagtataatttaaaattaaaataaaataaaataaaattataatttatcctttttgctggtatacaggaatacaatggacttttaaatttcttaattaaattataattcataccataccattcacatttttaaactgtacaattcagtgggtttttagtatattcccaaggttgtgcaacagtcatcatataattccagaacactgtcatcaccatacatacaaaaaacccaccatataactattattagtcattcctcatttattcctgccctcaacccctgacaaccactaatctactttatgtctctatagatttacctgttctagacacttcatataaattgaaccatacaatatctggtcttctgtgactagcttctatctagcatgttttcaaggctcatccgtgctgtagcatgcatcagtagtttttctttttggctgaataatattccattgtatggatataccacattttgcttatctattcatcagttgatagatatttgggttgtttccagtttgggctattataaataatgcagctatatacattcatgtctaagtttttgtatgaatatgttttcaattcttttggatatacacctaggagtacaattgctgtatcatatgttaattctatgttaaatttcttgaggaaataccaactgtttttcaaagcagtgcacaattttacattcccactagcagtgtatgagggttccagtttctccatatccttatcaacacatgttattgtccatcattttgactaaagccaccctactgagtgggaagtggtatcttactgtggttttggtttgcatttctgcattgactaacaatgtagagcatcttttcatatgtgtgttgaccatttgtatcacttctttggaaaatgtctatgcagatcccttgactagttttatttttattttatttttgagacaaagtctcactctgtcacccaggttggagtgcagtggcatgatcttggctcactgcaacctctacctcctgagttcaagcaattcttccacctcaccttccactcaatcctgagtaggtgggattacaggcgtgcaccaacacgcctggctaatttttgtatttttagtagagatggggtttcaccatattggccagggtggtcttgaactcctgacctcaagtgatctacccgcctcggcctcccaaagtgttgggattacagatgtgagccactgtgcccggccccttgactagttttaattgggctatttgtctttttactgttgaagtgtaagatttctttatatatactcaatacaagttagttatcagatatatatgatttgcaagtattttctcccattccgtgggttgtcttttcactttctgaatagtgtcctctgaagcacaaaagttttcatcttaagtccaattcatctattttttctttggttacttgagctttatatgtcatacctaagaaactgttgccttgtacaaggtaatgaatgaagatatacacctatgttttcttttaagagttttataggtttttgtttgtttgtttgtttttgagacagagtttcgctcttgttgcccaggctggagtgcaatggagcgatcttggctcactgcaacctccgcctcctgggttcaagcgattctcttgcctcaccctcctgagtagctgggattacaggggcccatcaccacagccggctaatttttttttttttttttgtatttttagtagagacagagtttcactatgttggccaagctggtcttgaactcttgacctcaggtgatccacccacctcagcctcccaaagtgctgggattactggtgttagccactgcacctggcgagttttatagttttaagttttacctttaggtctttgattcattttgagttaatttttgtatatggtatgaggtaggagtccaaattcatccttttgcatgtgtctatgcagttgcccagccctattacttgaaaaattattttcaaattcttttaccatcaaattgttttggcatccttgtcaaaaataaactggcagagaggtaaaggtttatttctacactctcagttgtattccattgatctttatgtctattattatgacagcaccaccttgtcttaatcactgcagctttgtaacaagttttgaaaccaagaattgtgagtcctctaccttccttctttttcttttcaaggttggcttagctattctgggtcccttgtatttccacgtgaattttaggatcagcctgtgaatttctgcaaaaactacagctaggattttgatacagactttgttgaatttatgaattaatatgagaagtgctgccatcttaacaatattgactttcaatccacgaacataaaatatttttcaatttatttagaacttctttaatttatttcaatggtgttttgtagttttcagtgttcacttcttacacttttttgttcaatttattcctaagtattttattctttttgatgctattgtacaattgttttttatattgactgcattcagtgatatttctaaacatattaattccaacagcatgtctatagagtcttttggattttctctataaataatcatgttgcttagaaataatgacaatttatttatttctttttttttcttttttttgagacaaggtctcactctgttgcccaggctggagtggagtggtgtaatcatagctcactgtaacttcgaacacctggactcaagtgatcttcccatttcagcctccagaggagctgggtctacaggcaagcaccaccacacctggctacttttttctatttttgtaaagatggagtttcacactgttgcccaggcttgtcttgaactcctggactcaagtgatcctcctacctcggcctcccaaagttctgggattataggtatgagccactgcacccagccccctttttgcttttttaaagtattattatattactaagacttccagcacaatgtcgaatagaaataataacacagagcattcttgtaacattctccaactcaataggaaagtgtttaatattttactatcgagtatgacatttgctatagtttttgtagatattctttatatttaagaagttccaggccaggcgtggtggctcaccctgtaatcccagcactttgggaggccaaggcaggcagattacctgaggttgggagttcaagaccagcctgaccaacacggagaaatcccatctctactaaaaatacaaaattagctgggcgtggtggtgcatgcctgtaatcccagcactcgggaggctgagacaggagaatagcttgaacctgggaggtggagattatggtgagccgagattgcaccattgcactctagcctgggcaacaagggtgaaactctgtctcaaaaacaaaaacaaaacaaaacaaaagaagttcccttctatttctagtttgctaagagtttttttaaatcataaatgagtactgaattttgtcaaacttttttgacacctatcaagaggatcaaatcattttctcctttttctctgttaacatagtgaattatattgatctacttttgaatggtaagcctctcctgcatacatgcaataaaccatacttaattgtgcttttaaaaaatatggccaaattcagcttgtgaatatttcattaaagacttttggatctatgttcatgagatatgttgctaaataatttccctttctttttaatgtccttgtcaggttttgacacactggcctcattaaaaaaacaaaacattagaaaatattctctttttttctattctctggaaaagtttaggtaagtttgatattatttcttcttaattaagaaaaattaacagtgaagtcatccatgcctcaagttttctttgtggaaaaatttttactaacaattgcttcaatttcattactagtatcagactactcagattttattttcttctgtcagttttggtaagctttgcttctcaataaatattctcattttaacccaaactatgtcaaatttatcattataaaattgttaatgtcttgtttttgtgcttttgaatatcttcagtaactttttgatatacaatgtaatatcctcttcttcattcttgatattgttacttgtgttttctttctttctcttgatcagtcttcattcatagagggttcttaattttatttatcttttctaagaaccaaatctcagctttgttgatttttctctgttgtatatttacatcctatgtatcgctgatttctgtttttctcttgttacattattatgtttgatatggtatactcttgagatgcaagcttgtatttttttgctttgcattttatttccacatatattttaaactctgtaagtcatttcaattactgttttacatagtctacttatatttagtcatatagttatcctttctactcttcttcattccccccagcatgtccatgttttcatctgtgatcattttcctctaaggaaatccctttagtatttattttattttattttttattttgagacagggtctcgctctgttacccaggctggagtgcagtagtgtgatctcagctcactgcagcctcaacttcccagggtcaaatgatcctcccacctcagcctcccaagtagctgggaccactggtgcacatcaccacactcactaattttttttaactttttgtagagacagggtttcaccacattgcctaggctggtcttgaactcctgggctcaagcgatctgcccatcttggcctcccaaagtgctgggattataggcatgagccactaagcctggccttagtattcattttaattcaggctgataaatatactagtagtgataaagtcatttagttattttctttctctttcttcctctttctttctcttctttctcttctttcttttttcactttcatcatgaaggatattttccactgggcagaaacctaggttggtagcattttgaatatgacattccattgtcttctgttttccatcattattgttgagaagttagctgtcagtttcactgttgttattttgaaggtaatgcataaatgatgtgtctaattttaacattttcagcagttttgctacaatatgtccaggtgtggttttccctgtatttgcctctgtttggggtttaccaaaattctaaatctgttggttggtgtcttttattattttgaaatggactctgccattgtctctttgaatgttaattttgtcccattctctctctactctgcttctgggactttaattatgcatatgttagacctttttttgagtattatattcctttgtgttctttccattctcttatctctgggcttcaatttagatattttctactgatatgtctcaaagcccacaaatcctatatttggttatattgaatctaatgttaagcctacccaactagctcttcatttcagatatcgcatttttaattctagaaagtccatttaaatctctttatagattttaattatctggtaaaactttccatcttttcatgcatttacctattttttctatattttctttaaaatattcataattattttatactttttttaaagagatgtggtcttgctatgtggtccaggctggagtgcagtggtaaattcacagacatgatcatagtgcactacagcctcaaactcctgggctcaagaaatcctcctgccttagcctcctgaatatctaggactaccagtgtgtgtcaccatgtctggcttgtttcttgacacagttgattatcagtcatatggtcttatctctttgtgggcctcacaatttttttatcatatgacagacactgtgtctgtggtttccagattacatttcaccagaagaagtttccctttccctctgtcaggcaaacatggtgagtggctgatcatgtaaacccctttacagggcatggtctacctagcctttttattaagaatttagttcctttagtccttagtgcttccacaaatctctgatgccctaaaaattataattttataaggtatgaaggttttcatagttgtagctgtggaagcactggcctaccacaaaactatatcctacccagaaatggaagctcttttgtgttcttcaaaaggaagaagatgaaggctcatgagctcacagaatagttctaaatgcgttcttcctgtcactactcactgcagttactatttatcataattgccaatactattcagagagcatgtctaatcatgctgctgctctcaaattccccagtgtctgttaactgctccccttatggggtcaaaagggtgaaaacaggaccaactgaataagaaagagctgtaaggtagactgcctatgctgcaagtgtttatatatttagtgcttgttttgtagatttagttacagagccatgtaaatgttttacattattataaaacaaaattaatttttgaaagctagtcctaaaaatataaaataaaatgaaacaaatgaaagtatatgtatccagagtggcatggccacatacagaggatctattccaagtgatttttaaacacattaattttactattgagatacagtctaagatagtaagatacagcctaagaacaaaaatatctgcaaaataattctcaaattttatgatcatattaagagtgatagtctgatgctgctattctcagactgtttattgtgtgtgtaatgtatataaaggatagaaaattagtgatactctattatttttgagccattgagaaccaagtttctcagcatgatagaaggcatatatagataattgagtttaaggataaattctgcatctctgaatttgataagtatgaattcatgatgtcttttaagacaaaaaataatcacataatacttacctccatgcatgaaaaaaatctaagagaccataatcactcaatggcaacgagctcctctaggacacagattgtgatctctgaaaactactatcatttaaaaaaaaaggcttcttggacaaagggtttattatgtttgggactgaagctggagatatacgagataagcctagaacagcatattactctgcatagcaaagaagctgtcaaatctactagaaatactcaaaaggactcaggagttaatctggtatatctagatggtatgaagatgataatacatctacaatatttatgagacaatttgaaccctgacttaatattggataatattagtttttatgtgtaaaagtaatgtagtttaaaaaaatctttaccatttagatagagatatattgaaacatttacagaggaaataatacgatatctaaaattttcttcaaaatatggatggaaaaaaaaactagagaggtatagatgaaacagtagcagccatgaattgatcactgtttaaagtggataatgagtaaatgaaaattcatcttacacttctatctacttttgtatatgtttgaaaaattcccataataaaaaataataattcattttcactctgatttgccttaacaaatctgttgattcttgtacatcacttgatctcccctgacaatggctataacaatggcataagtatggaaaaggaaaaacgtatactgacatggtttggctgtgtccccaccaaaatctcaacttgaattgtatctcccagaattcccacgtgttgtggaagggactgagggggaggtaattgaatcatggaggctggtctttcccttgctattctcctgatagtgaataagtctcaagagatctgatgggtttatcaagggtttctgcttttgcttcttcctcatttttctcttgccgccgccatgtaagaagtgccttttaactcccaccatgtgattctgaggcctccccagccatgtgaaactgttaagtacaattaaacctcttttccttcccagtatcagctatgtctttatcagcagtgtgaaaacagattaatatagtaaattggtaccagtagagtggggacattgctgaaaagatacccaaatatgtggaagcgactttgaaactgggtaacaggcaaaggttggaacagtttggagagctcagaggaagacaggaaaatgtaggaaagtttggaacttcctagagaattgtggaatggctttgcccaaaatgctgatagcaatatggacaataaggtccaggttgaggtggtctcagatgaagatgaggaacttgttgggaactggagcaaaggtgactcttgttacgttttagcaaagagactggtggcattttgcccctgcccaagagatttgtggaacttttaacttgagagagatgatttagggcatctggtggaaaaaatttctaagcagcaaagcattcaagaggtgatatggtactcttaaaggcattcagttgtaaaaggggaacagggcataaaagttcagaaaatttatcccagcacttcgggaggccgaggcaggtggatcacctgagaccaggagtttgagaccagcctgaccaatatggtgaaaccctgtctctactaaaaatacaaaaattagccgggcatgctggtgggtgcctgtagtcccagctactcaggaggcagagacaggagaattgcttgaacccaggaggcagaggttgcagcaagccgagatcgtgccactgcactccagcctgggtgacagagtgagactccatctcaaaaaaaaaaaaaagttcagaaaatttgcagcctgactatgcaatagaaaagaaaaacccatttgctggggagaaattcatgctggctgcagaaatttgcataagtagcaagaagcctaatgttaaacctcaagaccatggggaaaatgtctccaggccatgtcacagatgtttacggcagccccttctatcacaggcctggaggcccaggaggaaaaagtgctttcatgggctgggcccaggtccctgtgctgtgtgcagcctagggatttggtgtcctatgtcccagctgctccagccatggctgaaaggggtcaacatacagctccagctgtggcttcaaggcttgtggaagccccaagccttggcagcttccacatggtattgagcctgtgggtacacagaagtcaagaatcgaggtttgggaacctccacctggatttcagaagatgtatggaaatgcctggatgcccaggcaaaagtttgctgcaggagcaaagccctcatggagaacctctggtaaggcaatgtagaagagaaatgtggggtcagagcccccacacagagtctctagtggggtgctgcctagtggagctgtgagaagagggccaccatcctccagacccccgaatggtagatccaccgacagcttgaactgtgcacttggaaaagctgcagacactcaacaccaacccatgaaagcagccagtagggaggctgtgccctgcaaagccacaggggtggatcttcccaagaccatgggaactcacctcttgcatccatgtgacctagatgtgagacctggagtcaaaggagatcattttggagctttaaagtttgactgctccactggatttcagacatgcatggggcctgtaagccctttgttttggccaatttctcccatttggaatgactgtatttacccaatatctgtacccccattatatctaggaagtaactagcttgcttttgattttacaggctcataggcagaagggacttgccttgtctcagatgagactttgaactgtggacttttgggttaatgctgaaatgagttaaggctttgggggactgttgggaaggtgtgattggttttgaaatgtgaggacatgagatttggaggggctaggggtggaatgatatggtttggctgtgtccccaccaaaatcccaacttgaattgtatctcccagaattcccatgtgttgtgggagggacccagggggaggtaaccaaatcatgggggctggtcttttttgcgctgttcttgtgatagtgagtaagtctcatgagatctgatgggcttatcggggtttctgcttttgcttcttcctcatttttctctcgccaccaccatgcaagatgtgcccttcacctcctgccatgattctgaggcctccccagccatgtgcaactgtaagtccaattaaacctctttttcttcccagtctcaggtatgtctttatcagcagcatgaaaatggactaatacatataccaaaagatgaataaaaaaatttgtcccccaaccattaccccaatttgacaaatactaacttgaagaatctctactatatactattaatgaaattactatgaagcttaaatatcttattccagagtatcctcaatctgagtgttgcagtactataacactgatactccttcctagccatatctttgctttaatataaaataggaattaatacagctatttacctttattaggtcctgctattgtagatatgtctgaatgtttagaatgggaaatctgtgtttcagattttctttgcatagtgatttgatttccaaacctcttgggttctaagtaaaagactgtaagtttctgctgaatatcaagcccaactggaaaatgaaaaaaaagtacacaaatgtttatttgtcatataaatccacatatgagaacacttatttctttttatctctcttacatttttataacttctagagctaagaagtccagaaagttaaaatatgttgaaaggttaaaaaatatgacaactaaaaaattatatatttatcattataaaaataaaaatcttccaacaataactgcaacttaactatctaggaaaataaaatatctataaatgaaaagataaacttttaattatgtcatctggtccatgttatgttttacatatctaaatacatgaaacttcctttgaagtttattcatattatctaaatatattatttttgcataataccatttatactgtttttctgtaccagcataaaggatgtaatttttaaatgcaattatattatttatattcatgtcttcattacttcaattaacttaccaaattcagaacttattagatttatgctaagatcttcagatttaagagctcttttcacagcaatctttttagcccaacttccagcttttagcaaaacagaatccctgaaaaatagtatagtttaaatagtgatccaaacactgaatgaaatacatattaatcttgaagggctgattgttcttaagaaagatactctctagtagtaaactgaaatcaattactgaaaactgctttccccaacttttaaggagggagaataaagtatcaatggaactctcttgaccatgatttttaaaaaattaattaattttctttgagacagaatcttactctgttgcctgggctggagtgcagtggtacaatcatacctcactgcagccacaaactcctaggctcaggcagtcttcctgcctcggtctcccgagtagctgggaccacaggcacattggcactatgctcagattatttatttatttatttttgtagaaatagggtctcactttgttgcccaggctggtctgaaactctgggctttaagtgatcctcctgcctcagcctctcaaagtgctgagattacaggtgtgagccactccatccaatccctaatttttttaattacagctgtttccaagttgcatttaccattttagtcccaataagaatatatactttgtatcaataacacatgagcttgcccctaaatcactaccattttaaactggctatacgttatgagaacaacttcaatagtatttttaaatttatataaaatggtttgtatctaataacatcacaagccagcaaccatttttatgactaaacttattttagtctcatgtagtcatagacttattagtcacagagaacaaagatttgtacaacagcatattctctataagtgggtcatggttagctgcaggagagcagttaccagtgaaagggatatcctggtcactgcagtcccttcagaaaccttgcatgcgactttttgggaaggtatcttccagtatactggcacaattaggagattcccatttcagaatcactgccattcctgaacttacaagtacagtaatatggttgggagtctaggctctggattgggttcaaatctagactttgctattaactagctatatgaccatgattaaggtttggttaatcataaatcaaactcattaaactctttttgtctcaatttcctcctctacagaatacggacagcacctgtctcatacaaatattaaataattcaatatttggaacctactaagtgctaaataatattagttatagctgcaactgatatccttagagattgcttatgacatcctgggagaaaataatagtacctggaaaaatgctgaagtaaaaattatagaatggcatgctacagaactagatataagggagggtacctcctctatacatttgctttgtttgcttggatcctacaatggagctatagtaatttgttagattttaatttggaagtagaaggtatattttgaggtcagtaggagaaagactgcatccaaacagtagtagggtcatggatgactggagaaaagcagtgaaataagaaagacctcctagaggtaatctactcacttgtttcagatcatggtgatagattttatactttgttcatctgagtactaaatataacaatttaaaacaacagacccaatgttaatatcttctttaatagaaaaatagagaaaccatcccattattgtgtcaggaaaatgtaatttagttgatcccacaatgatcttgttatttttttttcagtagaatttttcttttacagtatatgcttagaaataagatcaaacatcagaaatttcacacttacgtaatcttgtgcagataaactacttgattatctgcgtcacctatgattaaggtaacatagtgagaatccgatgctgttcttttagtttgtagctgttcaaaatttcttaatataacagtcactaatatttctgccgtcgtatcactatatcttgtaatctttaaaaaaggacaagtataaaaagtgttaaaaataaccttacttctcatactcagctgaagcctatttataggtagctttatttctgaaaagacaataaaatatctaagaaacagaaaatatttacctgttccactttaagttcatattttggtagatacatcacagtttcttttatctgggttccaaaggggggatgtctgtttaaaatctaaaaatatttacatcattatattcttaccacaacacttgaaattcttttagtaaaatattttttagaataaatagctttaataatgcttatcacccaaaagtaagttgaaatacttataactatgagaaggaaaataacttttaatagaaataaaggtaggcctcagaatttagatggaattaggaataagtgaatataactaccaattcaagttcccttgcatctgtctcttctatttttttaaaggaagtcaaaccagcatttacgattgcatttgacaatgttatacctgtggaaaattaatcaaacaacaacttaaaaataatgcactttaaataaaacatatatttaaatatttaacaactaaattagtaaaaaaaaaaaattttaagatccagtcaaataactaacttaaagtttttgtaaaaagttttcagttggattattgggtttgtgacattattcaattattcatatttattcagacaaataaaatatgcatttgctttataaaagaaagagaaactctggtccacatgatggatgtttagttctactatacgtcatccatagtccaatcaccaagagatatgtatttttgtactcatgcttgaaagaaaggcaacatgattcaaggatcatgcttgaatgaagcgagggaatactgctttatgaagctatggctctctgaccatttctgtcttagaaatacagttctatgtttctgtaactaaaccagactattttaatctactgcctaaaacttccaatgcttttccattgtatttagaatgaagtggcaatttccttactggagccaaatttccttacctatataatctgactacagcctttgtctcaaatctaatttcctctaactctcctcttgctgactactctccagtcacacttgctttcattctattccttaaatacatcaaattcggttgggcccagtggctcacacctgtaatcccagcactttaggaggccaaggcgggcggatcacctgaggtcgggagttcgagaccaacctgaccaacatggagaaaccccgtctctactaaaaatacaaaattagccgggcatggtggcacatgcctgtaatcccagctactcaggaggctgaggcaggagaatcgcttgaacccgagaggcggaggttgcggtgagccaagatcgtgccattgtactctagcctgggcaacaaagcaaaactccatctcaaaaacaaacaaacaaacaacaaaaaaaatcaagttcattttcttctttggatctttcctatttccttatactttcagaaggcagaatttacaattcttatatgcttatgaatgaatttatccaaatccccaaatagaagacacggaacagtataaaattccaaaatattactactttgtctaaggcacatatattacatgtattactggtgaaggtatgaccctatttccttactcatatatttacttgttcttgggaatttctcttagttcttcttaagactcagcttctagtattcataattccttaatgttcatttccatttcccctcaaaatgtttattgacttttaactttttcatttatagccaacattaaaattaatttgtatgcattatttttttcaagatgcccaataacaacttggatttgactttttgtttagattctctcacttttatatgattttttttttctgggcaatatttgcttttttctgttcagctgtaatgagtgtgtgtgaaaacaggttagtttcaacaatctggaagggacagaatgcaatggatgcccatattgacaatactctagaaagccagaaagattggctttttcaagtataatgaaatttactagtaatcacttagccgaatttcaaaattttctaaatgttgtatggaaccacctttccaattgagaactcttgcctttgtgggatggatgtggtatttggttgccaggacttctgtaagaaggtgagcctttccatcaggaatctctccccttactttcaccagccaatccccacttcaccccagctcccatgacttcctagtcagccctctgccaccccactgatttcaaatttccagatacaaaaggtaggtcttcttcataaacagttggtaatctttgttcaaataaataacaaaacatccctaaaaatccattatttaatttgttgatacccccaagatgcatacaaaattgtaaaattaacaaggctgtcagtgatgagatagtaactctctttttagaattctagctatctaagaaagaatagggtcacaaggtcacaggtaccaaacaggaaaatcctttgtaaatggtactccctacagtctcatagcacacactacacaaggtccctatagacaaaataatcaggcacaatcttttgtctacagaatctctatgaaaatcagtattaataccctactgttattgaaaacaaaaaaaaaattaagacataaagaggtgacataattttctgtaatgaattaggaatggctgggactgctaactccaccttgtaattgagatcaaaacaaaatattcatcaaaaaagtggaagagagggcatcacatagttgcctaattactgtaaccaaatttccctcttggtatgagaaaaaattttcaaatgacagcattaatttttattaggtttctcatgtactcatgtatcattcagttgatttcaaatggaatcctttaagcaggagcaaaggaaaatcagattttcgaaagtacagcacttatttaagcctacaaacacataccttccttgaaggtctgtaatcatcacagaataattttactaacagtgaatacaaaataaattgcagacatggccaaactgcctgcctgtattcagtacctaccaattttttccagttgtttggatacatgcagagagttttcccaaagtttacacctaaaacatttagctaaaatcaaactattcaatagtacagcaaacttcttttcttgagcagctacaaaatctgacaaccctaaaaaaaaagtttccagtattaaatctaatataccagtttattggaaaaaatatttaaaatccactaatcctgtaacatacatcttgtaattcgggagccatgtctgaaaatctttgcggtatcttgtgtcaaagcaaaatcttgtatgggaatgcatcctagttgagcctgaataagactgggggaaagaaaaaaaattgttactcccttttaagggttatctatctcccagtatttgatatcactcactgaagtattccttcttaaaacttttctctgccttaatttctgcaatactacatgattatcttgcataattattattgcaggtcaataataaaagttcattcctttttccccaaatcctcaaagttgtctttatttatttatttatttattgctcttctttattcactcaatctctctctaaaagatctcatttcttctcagactttcattataatctctagattgatacaaattacaggagactttcacttagactgttactttaacctcaactatctcaaattattttcatattctcctccaatacagatctatcttttggctctactatttcttttcaaagaattagagaaaaataatacaatttgtttaatcaacacatttttattaaatgcttattaagtgccaggcatagtattaggtgctgataattctattcagtgtatgaaggtcagtagcatattagctggttattcaaaaccagcagctgctgggctactaaatttgaggtgttagttgttcaaggggaaaaaagacactagtgcctatgtgcctagtatatcccgggttctttgctacctgttttgcccataaacttacctaatcaggcattgatatgcaaatcactgatggttctaactaaaattactgtacttattattactctcttaaggggatctcttttaaaaaacaaatttcttcctaaactcctcagtagaaggaggtctctcaataagaccgaaacagtcagctatacaaagaaaaacggcagaatagttatatttcatgatttcgtttagcacaagatacatgaaaattgaaagaagtaatcaactcacttcctggaatggatgtatacagctgaaatttaaactattcactttttttggctatggtatatgcttctgaaaattattttatatcatctattaagaaatagttacaaagatacacagtatactatcaaagaaggaactgatggaaaaatgtaaatggggtgcttttaaatgctgggtaaataaaactccttgttaagctacctagagatgcacaaatgtggagtaagaaattgctggagtaaaaataagacttttgaagtaatatttatttatattaaaaagcaatacttctaataataaataggacacttttcaacatcatacttccctgtcagaaatcttatttcaagaagcagtaataaaacagggataggaggaaggacagggatttaagctagtaggtacagaaccatggcagggctctctgtttctctgcaccagataaggcaagcagtgatgtcctatgatcttacccctgagcttgtcctcagtaaaaacagaagtgccacagcctcaggtgaggtggcagctctaccacctcaactaacaggggcagagttacatggtagttatgactaacccagggttagtaaaagaattaaatgagataaagtattgattcggttagaattacgttcatgaccagaccatatcagtttacacacaaacagtttattcttgtgtgtaaaaggggaatccagagttgggaagtccagggcttcgtatggtggctccacatcataccctgtcagttcactgaaaaataccagttaaagaaaacagagctagtgctgaagagggaagacctaggaattaaagctaggaagaatttaaaaatagccttaaattaaaagggcagagccaggcacgctggctcacgcctgtaatcccagcactttgggaggccgaggcaggtggatcacctttgaggtcaggagtttgggacaagactggccaacatggtgaaaccccatctctactaaaaatacaaaaattagccaggtgtgatagtgtgctcctgtaatcacagctactccagaggctgaggcaggagaatcgcttgagcccgggaggcagaggttgcagtgagcggagatcatgcccttgcacttgagcctgggccacagtgtgacactctgtctcaaaataaataaataaataaataaaaataataaaaagggaagaaaccagaaacttgaaggataaaatcctaaaactaagaggattaacatctacttggagaagaacagatttgaagttcagcaaagtaacagggatatgacaaagccatgaaaaaggtaactattagccatcatcacctaccaaaagactataaattttggattaagacccctccatcccacacgtacacacattctctcttcttggttatgcttaaataagatgcacaaaggcgggaaatgataatgggaatctaaattatgatatgtataaaaacaattataaagtataataattaactttaaaatttgacagcttcaatcaaaagaatatactacccaatttaaggcaaagttaatggaagcactgaaagtgcaaataaagtgttcccaagaaaatgaatgtggaaaaatacttgatttaatttgactcaataatttatgcaacacagtatactgggggaaaaaatgagaaaatcaagagttctagatagcaacataaccttggcgaagtcataacttatctgggcatcacttacatcgtttgtaaaatgagaggattgggctatatgatctcttaagtttactatgatctctaaggatatatgaatttatagaaataaatatttgaatatagaagtacagctaagaaaataaacattaacttctgtggtacaagctacaaatctgcctgatgagttgtaaacaacaatgagaagactgtcttatagacgtaaaggtatttggaagataaaatttaatgagatgtcaggaagaatcccaaagaaagaatggcctcctctagctatggaggaaaaagaaattctttggctaattggttttattgagccacattgaaaaagatcatttcaccttaaattacataacactaagacctacatactcagaaagccaagcactcagtatagcagaaaacagtatcattgcatttgtgactgcaaactgctaaaagtcacaagttacagtgtaaccttaatttactctttcaattactagtctctgtacaaactccccatttttggcagaacagtcatccactgtcacatatacacgcctttactcatgattttgcttttactctttgtctctcccagaatgccactaccattcagtagacatttattacacaggttttcatactgtccattatttttaaatgtactactctcactcaagctaacttgaaagctcctgacaatgagaagcataagaagcatgtcttcattcaaccgtccaccttgcctcaacagaatacactctgaacaaatgtttgctaagaaaaagcattcacaaatcatcaattttaaagtctgagagttgtaagaaattaatttcacatccacattctgactcatttttatgtaatcttttctgtattaagaaaaacaaattaaaaatgttttaaaaccaaaaaaagaaaactttcataagtatgaatcatctttaccaatttactttcatttctcttgttttaattcttccttccattggaaatctgtaaataaaaccacatggcaaaacatttattattatttattttaattaaataaaacctcttaaaattatttaaaacatatgtaatttctgtacctgatagttatccgatttggatctttgttcaaagtattcagtgttttcttttcatttatccttaactgtatatctagaaattccttgcagccagctatcaatgtaacctataacatttcagtagttgtccatttaatgaagtctattttttatttcctctcatcctttctccaaatttatttatttttcatactgccttaaaccatcacagttttatcaatgaacataacagagttaaaaacctgctttatacattttgcttctttaaggattcattcattcactaacaaatgcttacaaactcctattatataccagacactgcattagacaccaggactataccaataaaactttaaagattaacaagatagaatttaaaatatctagcccagtgcctatcacatagtaataaataagtcctcaataaacactgtttttgttactcctactcctaatactactactactgctattctactgttctatagtttgcaaatcattatctcaattgaggataatttagtcatagaatgttttagatattaggaaatttggattctagagcctacttccaccagatgacaaacaaagcagtctctgtgctttggtttcccacatatctaaaatggaactaacacttgttttaattttcttacacacttgctaaactcaagatcagatgagttaatgttaatagtgggtgttttcgactcttgatttctccttagttaagaataatgtttacacaaaaatacaaaccttctatttttcatcaattgttgtttatgtgactcctcaatcataactggaattctactgtgcaatttttactacaataatcttaccacagtaatcaaattagatattttaaataaaaatgaacggcttaaatttgagagtaaatattttcttttatgaatattgtttcatattcatgtcctgagtaaagggagaaaggaccaatgcagtcgccatataccaatgacatgcctatggttctattcactgctgcagctgcaaagttgccccattgttgatattttagcataacctgttattattcccattttttctacaatcagttcttttatctaggtcatcaccaatactattctatttccattgttctcactgttctcacccaaaatatttagggaagggttgcaagtacgtggcacacatgctgcatgcaactcactgtccttcactcatggtagactttcctaatatatcacaccacatcatcttggaatctttcttacatattattacattgtgtagccactaccaaggtaattagcattatcacctaagttgtaaagtagttgccatacctattttagttttgtatataagttttcttagctctgataagagttaaaacagaaaatataatatattctaagaaagactattccatatctcatgatcagaattataccagaggatatatcttagaaatgctttcttttctgctcattcattcttaaattatatgagatacacaaattagttgtttctcaaatattattttatactataccactatgtattttttttctagtgaaaattaatttaccagatctgataaggtttcttttccactgattgtataaaatttcttcactgtctcaaatgtaatataataccaagccatcaatcttcctgcttctgtaagaaaagacagaaaaatgaacggtcccctcatcagctgaaccaactgtttttttatgtttaacaaacatttcctgaggggaggagaagcaagatggtagaacagaagcctagaccattggtcctcactgcaggaacaccaaattttaacaacaatctgcacacacaaaagcactctaattgcttttctgcacacagaaaagtactgtcacaagaatcaaaaatcaggtaccagcttggccatggctgggtagagcaacaaggaggctcttggggtctctgagtccaggcctaggctcttaagacagcatttctggacctgccctgggccagagggggagcctactgccctgaaggatgcatagtcccaggcctggcagcattcactataagctgacagaagagcccttgggctttaagtgaacatcagtgatgacttggcacaaccccctgaggaccagtgaaggtcgtggccacaggcagagactcttccaatccctggctctcagacagtctctcagacagtatctctggacacacccaggacctgggggaactcaccatcccgaagtgaaaggccttgggaaggcccagtgctgtgctggcttcaggtctgacccagcacagtcccagcccacaggagtgcttacatcagcatagccccaattccaagtggctcagcacagagagagagaatctgtatttttgagagaaagtaagggaaaagaacaagagtctttgcctgatagtccagagaattcttctccatcttatccatgaacaccaaggtggtaggtctacgaatctgcaaaaaccacagcataatcgggcttatggccaaagtccctttgaatacctagaaagccttctcaagaaggacaggcaaaaacaagcccagactgtgaagactagaataaatacctagctgctgaatgctcagacaccaaagaacacctccaggaaaacatgacctcaccaagtgaactaaacaaggcagcaggaatgaatcctagaaaaagagagatatgtgacctttcagacagagaattcaaaatagctgttttgaagaaactcaaagaaattcaagataacacagagaaaggattcagaattctatcagataaatttaacaaagagattgaaataattaaaaagaataaagcagaaatcctagagttggaaaaatgcaatgacatgccgaacaatgcatcagagtatcttaacagcaacactgatcaagcagaagaaacagtaagtgagcttgaagacaggatatttgaaaatacatagtcagaggagacaaaagaaaaaataattttaaaaaaatgaagtacacctataagatctggaaaatagcctcaaaagggcaaatctaagagttattgaccttaaagaagcagtacaaaaagagatggcagtaaagtttattcaaaagcatagtatcacagaacatcccaaacacagagaaagatatcaacattcaagtaaaagaaggttatagaataccaagcagatttaacccaaagaaggctacctcacggtatttaataatcaaactcccaaaggtcaaggataaagaaaggatcctaagagcagcaaaaaacaaacagcatagaatggagctccaatgtgtctggcagcagacttttcagtggaaaccttacaggccatgagagagtggcaggacatatttaaagtgctaaagaaaaaaaaaacccttttactctagaatagtatatctgctgaaaatatcctttaacaatgaaggagaaataaagagcttcctagacaaacaaaagctgagggatttcatcaacaccagacgtgtcctctaagaaatgttcaaggaagctcttcaatctgaaagaaaaggatgttaataagcaagaagaaaatcatttgaaagtacaaaactcactggttatagtaagcacacagaaaaacacagaatattataacactgtaattgtggtgtgtaaacttctcttgacttaaatagactaaatgaagcaatcaaaaataatagctacaacagcttttcaagacacagaataataagatgtaaagggaaacaagaaaaaggtaaaaagcatggggatgaagttaaagtgtagagtgtctattagttttctttttacatttttgtttgcttgtttaggcaatcagtgttaggttatcatcagtgtgaaataatgggttacgagacagtatttgcaaaccccatggtaacctcaaattgaaagacatacaacagatacacaaaaaataaaaagcaagaaattaaagcatgccaccagagaaaatcaccttcactgaacagaagacaggaagacagaaagaaggaagagaagactgtaaaacaaccagaaaacaaataacaaaatggcaggagtaagttcctacttatcaataataacattgaatgtaaatgggctaaagtctccaataaaaatacatagactgaggctgggcacaatgggtcatgcctataatcccagcaatttgcaaggccaaggcaggaggattgcctgagctcagcactttgagacaagcgtgagcaacacggcaaaaccccatctctaccaaaaatacaaaaaagttagccaggaatggtggcatgtgcctgtgatcccagctacttggggggctgaggtaggagggtcacttgagcctgggacgtggaggttatagtgaggagcacccagatatataaagcaaatattattagagataaagagagagataggccccaatatgatgatagctggagacttcaccccactttcagcactgaacagatcatccagacagaaaatcgacaaagaaacatcaaacttaatctgcactatagaccaaatggacctgatagatatttacaaaacatttcatccaacagctgcagaatacacatctttctcatcagcacatggatcattcaaggagagaccatatgttaggtcacaaaacaggtcttaaaacagttttaaaaattgaaataatatcaagcatcttctgaaataaaactagaaataaatagcaaaaggaattttggaaactatacaaatacatggaaattaaacaacaggctcctaaatgaccagcgcgtcaatgaataaattcagatgaaaagtgaaaaattttttgaaacaaatgataatggaaacacaacataccaaaaccaatgggatacagcaaaagtagtatgaagaggaaagtttatagctacaagtgcctacatcaaaaaagaagaaaaatgtcaaataaaaaacctaatgatgcatcttaaagaactagaaaagcaagtgctaaccaaacacaaaattagtagaagaaaagaaataataaatgtcagagcagaaataaaattgaaatgaagaaaacaatacaaaagaccaatgaaacaaaaatgttggtttctagaaaaggttaacaaaattgacaaacctttagccagactaagaagaaaaagaagggctgagtgtcaggcgacccgcagctaagctgaggggggaaagtgggcttaggaccgcctgcccagggcaaccctgaatcaagctttagccgccgaggcctcgtgtcccaaaggccagtcatccctcctctgtgttgccatgggtattcaaggcctggccaaactaattgctgatgtggcccccagtgccacccgggagaatgacatcaagagctactttggccgtaaggtggccattgatgcctctatgagcacttatcagttcctgattgctgttcgccagggtggggatgtgctgcagaacgaggagggtgagaccaccagccacctgataggcatgttctaccgcactattcgcgtgatggagaacggcatcaagcccatgtatgtctttgagggcacgccaccacagcacaagtcaggcgagctggccaaatgcagtgaactgcggggctgaggcagagaagcagctacagcaggctcaggctgctggggccgagcaggtggtggaaaaattcactaagtggctggtgaaggtcactaagcagcacaacgataagtgcaaacatctgctgagcctcatgggcatcccttaccttgatgcacccatcgaggcagaggccagctgtgctgccctggtgaaggctggcaaagtctatcctgtggctaccgaggacatggactgcttcaccttcggcagccctgtgctaatgcaacacctgactgccagtgaagccaaaaagctgccaatccaggaattccacctgagctggattctgcaggagctagaaccaggaacagtttgtggatctgtgcatcctgctaggcagtgactactgtaagagtatctggagtattgggcccaagcgggctgtggatctaatccagaagcacaagagcatcgaggagatcgtgcagcgacttgaccccaacaagtaccctttgccagaaaatcggctccacaaggaggcttaccagctcttcttggaacctgaggtgctgggcccagagtctgtggagctgaagtggagcgagccaaatgaagaagagctggtcaagttcgtgtgtggtgaaaagcagttctctgaggagcgaatccacagtggggtcaagaggctgagtaagagtcattaaggcagcacccagggccgcctggatgatttcttcaaggtgactggctcactctcttcagctaagtgcaaggagccagaatcaaagggatccactaagaagaaggcaaagactggggcagcaaggaagtttaaaaggggaaaataaatgtgtttccccattatacctccttgacaccagaatatttgccctcttgtacccttaagagctacagctagagaaaccttcacaggggtggagagagcattctaaggtttttctagcgtgacccttttcagtagtgctagtcccttttttacttgatcttaatggcaagaaggccacagaggtacttttccttttttagctcaggaaaatatgtcaggctcaaaccacttctcaggcagtttagtggatggacaataagtccattgttacatgaaagtgatagatagcaacaagttttggagaagagagagggagataaaagggggagacaaaagatgtacaaaaatgatttcctggctggccaactggtggccagtgggaggtgatggtggacctagactgcttttctgtcttgttcagccttgacccaccttgagagacagccatcaggaaggcgcatcttagcagatgggaggaactgctgagagaagataggcagagagctggagcccctggagttgactgtgtctatgtctgtgactgattgctggctgtgtcttgggtgggcagacactcgaacttgctatgtaatttgtgtctagttattcagaggagtaagacggtgatgttcatctggcaatcagctgagttgagactttgggataagacactggttttcatgtgctgtttttgttttaaagttataaagaaaaaagtcaataaaattataaaagtaaaaaaaaagaagaagaagaaaaagaaaatatccaaataaataaaatcagagatgaaaaaggaggcattacaactgataccatacaaattcaaaggatcattagtggctactagcagcaactacatgccaatatattggaaaatctagaagaaatgaacaaattcctagacacatacaacctactaagattgaaccatgaagaaacccaaaacctgaacagaaaaataataagtaatgagattgaaaccataataaagtctccctgtaaagagaagcctgggacccaatggcttcactgctgaattctaccaaacatttaaagaagaactaccacaaatcctgctcaaaaactgtttcaaaaaatagaggaggagggaatacttccaaacttactctactaggacgttattaccctgataccacaaccagacaaagacatatcaaaaaagggaaactacaggccaatatctttgatgaatattgatgcaaaaccctcaacaaaatactagcaaaccaaattcaacaacacactaaaaagattattcaacatgaccaagtggggtttatcccagggatgcaaggatagttcaacgtatacaaatcaaccaatgtgatacatcatatcaagacaatgaagaacaaaaatcacaattgatgcttaaaaagcattcgataaaattcaacatccattcatgataaataccctcaaaaagctgggtatagaaggaataataaagccatatatcatgacccacagctagtatcatactgaatggggataaacggaaaagctttcctctaagatatggaatatgacaaggatgcccactttcaccactgttattcaccatagtattggaagtcctagctagagcaatcagataggagaaattaataaaggacattcgcttggaaaggaagaagtcaaattatccttgtttgcagatgaaataatcttatatttggaaaaacataaagaatccacaagaaaactgtcagaaataataaattcagtaatgttgcaggatacaacatcaacatgcaaaaatcagtagcattcctatatgccaacagtgaaaactctgaaaaagaaataaaaagtaatccatttataatagccacaactaaaattaaatatctagaaagtaataaaagaagtaaaagatctttgtaattaaaactataaaacactgatgaaataaattgaagaggacaccaaaaaatgaaaaaatattccatgaaaaacctgaaaaagaaataaaaaagtaatcccatttataatagccacaattaaaattaaatatctaggaattaatgaaagaagtgaaagatctttgtaattaaaactataaaacactggttgggtgcagtggctcatgcctgtaatcccagcattttggaaggcaaaggcaggcagatcacttcaggtcaggagtttgagactagcctggccaacatggcgaaaccctgtctctagtaaaaatacaaaaattagctgggtgtgatggcaggcgcctgtaatcccagctactcaggaggctgaggcaggagaatcacttgaacccgagaggcagaggttgcagtgagccaagatcgcaccactgcactctagcctgggcgacagagggagactccatctcaaaaacaaacaaacaaagaaacacaaaaactataaaacactgatgaaagaaattgaagaggacaccaaaaaatgaaaaaatattccatgttcatggattggaaaaatcaatattattaaaatttccatattacccaaagtaatctagagattcagtgcaatccctatcaaaataccaatgacattcttcacagaaagggaaaaaaaaatcctaaaatttatatggaactacaaaagatccagaatagccaaagctagtctaagcaaaaagaacaaaactggaggaattacattacctgatttcaaactatactacagagctatagtaaccaaaacaatatggtactggcataaaaacagacacatcaatcaatggaacagaataaggaacccagaaagaaatccacacacatccagtgaactcatttttgacaaaggtgccaagaacatacattagggaagacagtctcttcaataaatggtgctgagaaaactggatatccacatgcagaaaaatgaaactagaccccctatctcttgatatatataaaaatcaaatcaaaatggattaaagacttaaatctaacaactcaaactacaaaactactacaagaaaatattagggaaactctccaggtcattggtctgggcaaaaatttcttgagtaataccctacaagcacaggcaacaaaaaatggacaaatgggaacatatcaagttaagaactttctacacagcaaaggaaacaatcaacaaagtgaaaagaaaacccacagaatgggagaaaatatttgcaaactacccatctgacaaaagattaataattagaatatataaggagctcaaacaactctacaggaaaaaatctaataatccagttgaaaaatgggcaaaagatttgaatcaacatttctcaaaagaagacatacaaacagcaaacaggcatatgaaaaggtgctcaacatcactgatcatcagagaaatgcaaatcaaaagtacaatgagatatcatctcaccgcagttacaatggcttttatccaaataacaggcaataataaatgctggtgaagatgtgaagaaaagggaacccctgtacactgtgggtgggaatgtaaattagtacaaccactatggagaatagtttggaggttcctcaaaaaactaaaaagagagctactatatgatccagcaatcccactgctgggtatatacccaaaagaaaggaaatcagtatatcaaagaggtatctacactctcagtgtttattgcagcagtgttcacaatagccaagatttggaagcaacttagtgtccatcaacagatgaatggataaagaaaatgtggtacatatgcacaatggagtattaatcagccacagaaagaatgagatcctatcatttgcaacaacatggatggaaccccaggtcattatgctgagtgaaataagacaggcacagaaagaccaacattgcatgttcttacttatttgtggaatctgaaaatcaaaataattgaactcatggacatagagagtagaaagatggttaccagaggctgggaagggtagtgggagggtggaggggagtttggtggggatggttaatgggtacaaaaataaaaaaaaaacagaaagaatgaataagacctagtatttgatagcataacagggtgacgatagtcaataataatttgactgtacattttaaaaataacttaaacagtataattggactgtctgtaacacaaaggataaatacttgaggggatggattttccatgatatcattatacacattgcatacctgcaccaaaatatctcatgaactctataaatatatatacttaccatttaccgacaaaaatttaaaaataatttaaaacattttcttaacatgtactttgtgcctgtaatgccaccaggcacaaaagacataccaaaaaatgtagaagacacaatctctagaatttataggttggctaggaagataactacatgctaagtacctagacgacaaaaaatcagctaatgttagtatttacatacaaacttgagtatggaggaaatcaaacctaagaggaatggtcagtgtagagtggcctactacaaataatggatcttgagaagggtttttaaagtgactaatatgctttagtagagaggaaataatgccattatgacgttggggaaaatcctgtttatccaaagagtaaagttaaaaagactatctttagaatactgtaatgatggctggaaaaacatatggcttgacagtgattatgagtcctgatcagactgagttgattagaatcgctgctcctcctcttattgggtatgcaagtgatcatgcacaagttacgtgaccagtttcttaatgtaatgtgggaataataaaactacccacacctcagaagtttgttgtggagaagattaagtgcaattaaaaatggatatatagtacttagcatggtgcctaatatttaatgtgttacctatttttattattaaaacatgacaaatgatagagaggccctgaaagagccctcaaatgatattaaaagaggttatattttggatttgatttataaaataacaggtgaccacttaaaattcttgagcaatattttaattaaactggagtctgaaaataagttattccggaaatagaacagcagattggttgtgggtaggagtatgggagaaatgggggtaactaactgatgaaatggaattcacttaagaggttactggattcggccgggcgcattggctcacacctgtaatcccagcactttgggaggccgaggcaggtggatcatgaggtcaggagttcgagaccagcctggtcaagatggtgaaaccctgtctctactaaaaatacaaaaattagctgggcgtggtggcgggcacctgtagtcccagctactcaggaggctgaggcaggagaatcgcttgaacccgggaggtggaggttgcagtgagccgagatcgtgccactgtactctagcctgggtgacagagcaagactctctgtctcaaaaaaaaaaaaaaagttactggattcgataagttgtctaaaaacattccaaagaatttcaagccttatgaacacatagaaaacagctgggaagaagaaagtagcatcctgcttctcaaggaaagggctaacatttacgtatgtgctaaatgttttgctgaagaagaaaagatttttggcattccaacagagttacaagcaccaaggacatggtacaatagataaaactaacaatcaggaatagagaagtagccaggctctcaattaggatcctggtgaatatgttcagccaacatgtgaataatggattagtttataaaaaggagcttctgagagaagggtgtgaaatatcaagattataattaccacgagaactagttaaccattgcagtatatttaaagatggtcctcttaccctaaatatttataagttaatataaggtctcttcctgatagagaaaatgaaaggttttaagaaaagacttaatacttgttggcttattaatagagatgaagctttcctaggtaagacagaaaaacataacctagaaaggaaagcataaggaaaatgagtcaaagcagagggaatgaaaagtaatttttaaagatttgcaagtaaagcaaggaaataaagaaacaacttgctattaatatagctactgaatgattaatattcttacaggaaattcaggatatttcaaagattaatattctaacaggaaattcaggatatttcaaagattaatattctaacaggaaattcaggatatttcataaaatacagtggtagggagcatggaggacatgagaatgtacctttcagacctcctactgcaagacgtgtcagtgactgatggccccagctgctgtgctctgaatcatcatcatgtttacaccgagatcatactttcatgagatggccccagtcaatgactgagcatggcagggatgctaaggtacatctataagagttcctatcaactttgccaaatgttcttaggattgcactgcaggctaagacccctctctccctccctctctccctctctccttccctccttgtaagctaagatcctccaagggctttctctctcccatcctccttggaggctaaaatccctcctgccctcccctcctccctcccttcttgcaagctaagatcctccaagggctttctctgtcccatcctccttggaggctaaaatccctcctaccctcccctcctccttcccttcttgcaagctaagatccctgcctccctccttgcaggctaagatctatctctatctctctctccctccctccctcccttccttcctcccttccttccagagttatgggattcaattataagttgtctaaaaacatcccttcctccatcccatccttccttcctctcatactttctccctctctgccccaccatgttccctccccctgcattccttcctaccctcctcccctttccctccttacctccatcccttcttttcctacttccctccatcctgtcctttcttctttccctctatccctatccttcaaagaggtaagatctgcatcccagtttagtgactcttccagactattgcagttaccacctatcttcagaaggttaatctttcttaaattcacagtagaaattaaacaacagaagccggcaagattgcagattaaaaggaatgcttctacactgttggtgggagtgtaaataagttcaaccactgcggaagacagtgtggcaattcctataagacctagaaccagaaataccatttgacccagcaatcccattactgggtatatacccaaaggaatacaaatcattcttttgtaaagatacatgcacacgtatgttcactgcagcactattcacaatatcaaagacatggaatcaacctaaatccccatcaatgaaagactggataaagaaaacgtggtacacatacaccatgggatactatgcagccatgaaaaggaatgagatatgtcctctgcaggaaaatggatggagctggaagccgttatcctcagcaaaccaacacaggaacggaaaaccaagcaccgcatgttctcatttataaatgggagctgaacaatgagaacacgtggacgcgttgtggggaacaacacacgttggggtctgttggggagggcgaggggaaggagagcatcaggaagaatagctaatggatgctgggcttgatacacaggtgatggtatgatctgtgcagcaaaccaccatgccacatgtttacctgtaacgaacctgcacatctgctcatataccagaacagttgaagcgggaaaaaattggccttttgagcccttctctcagtacacattatctggcaaacaggtaaaaacctcaatgcaaacatacagatgaaaatacctagatacttgagtattatgattacaacctaaaaagcaaaaactatatgaagcagaattataggaacatacaaactaaaaactgatatacaaaaaataaactcaaagagacaaaataaagtattagtaatatgaaggaataagaagtcataaaaatgaattaattagaaatactatgtaagaaaattacatctacattaataacaggctaagaaattacaaacccagcatggtgcagcatcttccacaatttgatggggaagctcagagtcccgtctccagtactgcatccccttttttccgggaggcctcaggtaacttggctgcagcctctgtcaccctgtgacctgcagatactgggagatccatagggagaactctggaacaccagaaaagccaagaaattacatgtacaaataagaaatcatgtgagcacacagcatgaagatgactgtgtgcaaaggaagagaaccctcaacagaatctgaccatgtcagcacacttaactcaggcttccatccttcaggaactgagaaaggaggaggagaaccaagagggccaactggacacagccaggaagagcatctcccaccaaaagaccagaccatcaggaagaccagcacactcgaagcagatcttcagaaggaagtcattgagggtggttggagggaagacacagaccctaggtagaagctgggaacactgcagtgggcttcaaagcaccaggactcattcccagcccctggtggctcctggggaagggtgagttaaacaggtgaggagtggcccactcttgtcacggacctctggaatcttagctgcagaagacctcatgacccccacagacatttaaattggcagagagaactgcctggagaaatggcagggacaggactccaccctgtgtggagcccaaagggtttggcacaggaatggctacagtggagtacagtcaggaatgccaatcccccaaggcctgccatgctcctctaagtggttttggcctttgttgactgttggacctagacagagcagggcagtcttgtccatgtgatggggccagtcttatctgagtgccccctgactgccagcctcttctggggtccctccatggccaagctcacttgcagtgtggcctcagttgcccaactggggcaccgcctagtggccaccaccatagctccttagccagcagatgccactgaaccattagatggaccctgccgatgtgcacccaccaacagcctcctcacactgctttgccaacacacacctgtctgcagcctcccccaaccactctgctggcatgcactcaaccatggcctccccacatcactttgctagcatgcacatggtgcacggaccttgtcaccacggccgtggccccaccagtgcaccaccggtacatgcggatcccactatgctgctgtcttgccactgctgatacactgcaaacatggaccctgctgtgccaccaccactggtgcacatacccagacctcaccatgctactatacagccactgttggcattacacatgagtgcgtaaccttctgccactgccccatttaagtgtgattgccagtgaaccaggaacacctctaaccctccagtgcagcaggtacttaacctcgaggggccagcaaacaaagccatgagcatgcagcccaggagcactgagctgagcccaagccctctgaaatcatccagaaacaaagccagtcaactaaacccaacttatgccacagtaaatctcaatgacatcaaggaatataaaagaaaaagccccatctgaaggacagcaacttcaaatattaaaggaacatcagcccagacagacgaaaaacaattagtctgtctgggctgatgttcttgccagaaagcaagaaccctggcaactcaaaataccagagtgttttcttacttccaaacaaccacacagctccccagcaatggttcttaaccaggctgaaatggctgaaatgtcagacctagaattcagaatctggatggcaatgaagatcatcaagattcatcagaaagttgaagtccaatccaagaaatctaaggaacccagtaaaatgattaacaggtgaaggacaaaatcgccattttaacaaagaaccaaactgatctgatagagctgaaaaactcactgcaagaatttcataatacaattggaagtattaacagcagaataaaccaagctgaggaaacaatctcagagctcaaaaaccaggttttcaagtctactcagtcagagaaaaatacagaaaaaagaataaaaaagaatgaacaaaacttccaagaaatatgggattatgtagagaccaaaatttaaaactcattggtagccctgaaagagagggagagagagagagagcaagaaacttggaaaatataattgagaatacagttcaaaacatttccctgaccttgctagaggggtcaacattcaaattcagaaaattcagagagccccagtgagatactatatagaacagccatcccccaagacacatagtcattacattctccaagatcaatgggaaagaaaaaatattcagggcaactagacagaaaggtatatgttacctacaaagggaaacatataaagctaacagcagatctttcagcagctctttcagcaaaaatcctacacgccagaagagtttgggggcctatattaagcattttttttgacagggtcttactctgtcacccaggatggatggcagtggtgcaatcttggctcactgcaacctcctcctcccaggctcaagtgatcctgccacctcagcatcctaagtagccgggactatagacacatgccatcatgctcagctaatttttagaaaaattttttgtagagacaaggtgtcactatattgctcagactggtctcaaactcctgggctcaaataatcttcctgcctcagcctcccaaagtgctgggattacaggcacaagccactgtgcccagccttggcattcttaaagaaaagaaactccaaccataagtttcatatccagccaaaataagcttcatcaatgaaggagaaacaaaatccttttcagataagctaagggaattgtttgcatcagacctgtcttatgagaggtccttaagacagtactaaacatagaaatgaaagaccattactggccaccacaaagacacactttagtatctagaccattgacactataaagcaactacataacataacataacaagtctacataacaacacaatgacaaatctacacataccaatatcaaccttgaatataaacagactataataccccacttaaaaggcgcagagtgacaagttggataaagaagcaaaacccaactgtatgttgtcttcaagagacccatctcatatgcaataacacccataggcttaaagggatggagaaaaatctaccaagcaaatggaaaacaaaaaaagcaggggttgctattctaatttcagacaagacagactttacaccttaactatcaaaaaggacaaagaaggacactgataatgatgaaaaagttcaacacaacaaaaagatttaactatcctaaatatatatgcatctaatactagagcacacagattcataaaacaagtttttatagacctacaaagagacttagatacctacacaatgttgggaggcttcaacaccccactgacagtattagacagatcatcagggcagaaaacaaataaaaatgttcaggacctaaacttgacacttgaccaaatggacctaacagacatctacagaacactctatccaacaacaacaaaatatacattcttgtcatctgcacatgtaacatactctaaaatcaaccacacattcagctataaagcaattctcaacaaattcaaaaaaaatcataccaggcacattcttagaccacaatgcagtaaaaacagaaatcaatactaagatctttcaaagccatacaattacatggaaattaaacaacatgcttctgaaagacttttctgaaaataatgaacttaaggcagaaatcaagatactctttgtaactgatgaaaacaaaggcagaacatagcagaatctctgatatacaggtaaaacaatgttcagagaaaagtttatggcactaaatgctcacatcaaaaagctagaagtatcacattagcaacctcactaatatcacacctagaggaactagaaaagcaagagcaaatcaaccccaaagctggcagaggaatagaaataaccaaaatcagagctgaagtgaacaaaattgagagacacagaaccacacaaatgatcaacaaaaccagatattggttctttgaaagaataaataagattgatagactgctagctagaataacaaacaaaaaaacagaaaccagacaaataaacacaatcagaaatgacaaagaagatacgaccaccaatctcacagaaatacaaaaaaaaaacccagaaactgttatgaacacctttatacacacaaactagaaaacctagaagaaatggggagatagactgctggaaacacaacctcccaaggttgatccaggaagaaactgaaaccctgaacagaccaataacaagtttcaaaattgaatcagaaataaaaagactatcaacaagaaaaagccctggaccagactgattcacagccaaattctaccaaatatataaagaagagctggcaccaatcctactgaaactattccaaaaatttgaggagggactcctccctaactcattctatgaggccagcatcattctgataccaaaacttggcagagacacaatgaaaaaaaaaaaaaaaaaattcaggcgaatattcctgatgaacatagatgcaaaaatcctcaacaaaatactagcaaaccaaatccagaagcacatcaaaaagctaatccaccgtgagagagagagaaagagagagagataggattcaggacacgctatcccaaaatggagcatcttggcttattgaatattttaagctgtaggaatttgagaaacaacatgtacaggaagaattcttctggcctttccctgaagcaagtaataacaccatcatgtgagaggtgccctccctatacctaaagaatggagcatctttatctccatagacacagagtggaatttgaatgaacaggctttgctaaatttcccccaatttattacacttagttcatatcccctttgtcctatcatatttctccatgacttttcaatcttcatcacacctggcataaaaacattcaggtttaaccatttctttgggtcttcatttccttataaaggcccccatgtcacataaaacatattaaataaagttgtatgcttttctcttgttaatacattttgttatatgagtcccagttaatgaacctaagatgagtagaaggaaaagatatttttactaaccttacagaagtctaaccaccagattatcaatggttgaatatttaagaatataaaaagcatattaaaagcataccaataaaagtatatctataatagttataacaggtttaaagcaacccaaagattcaagcatttcattcctctgccaaaagtcaccagaatcagtgaagacaaattctgtgcacctgtgcccaggcacggtggctcaagcctgtaatcccagcactttgggagcccgaggtgggcagatcacaaggtcaggagatcgagaccatcctagctaacatggtgaaaccccgtctctactaaaaatacaaaaaaaaaattggccgggcatggtggcaggcgcctgtagtcccagctactcgggaggctgaggcaggagaatggcatgaacccgggaggcggagcttgcattgagctgagatctcgccactgcactccagcctgggcaaaagagtgagactctgtctcaaaaaaaaaaaaaaaaaaaaaaactattacaaataggacttgtttaaatttatcatgcctatggctaataatgatgataccctgttgagaactgagatcacaatttagttttatcaccatctaaattttagtaaaacaaaattttaatttagtcttaagtaaacaattgctaaatttactgacaatgataagaaattaccagttggtttgaaattaacaccttcatccatctttattaagtccagggatgataaatcattcagattcttcaaacataattctgtttaattatagaaaacacattttaattttagtaaaatagggaagtagggaaaaataatttattattaaatatgctaaagttgtgctattactgtgtaactgttctagaagaaccatagtccctacttaagcagtaagagaaagctcatttaaataaaaaagctaactaatatgctaaaaacattttctaaaagtaacaagaatacaagtaataaaaataacattcagtaagtagaaataacacttaaaacttggagtatttaaatgatacacatgtattacctcatttaatcttcaaaacatcacaataaggtagacaccgatattttcatatataggttaggaaactaaagaatagaggctaagtaacttgctccaggtctaagtaaccactttgctatctgccctccattaaggcaatagttttctttttcttttttctttaaacttctatcaaagatatattaatgtatgcacaaattataagaagtcaaatagttctgcaaagattattccaaaaaccaccagttcttcccctcctccctgtttgccactttcttgaagcaaaaacttaaaactgttttaactgatgcttttaggtgtttacttttgtttctctgacaggaagcaatgctagttcatgctcactattgatggggatcagagcaattgtagtaatctgctgctgacagttccttctctgcctcatgctatagtccaggagatataagatagttcagagcagacagtgggaatactgtaatagttcaatcctaaatagagcagccactcaaaaaaacacccttggagttctttgggaaatattttagtttaagcaacactctttagacagcttgatagtgttaagcgtttggttaagtaaagattttgaagtcttttctaattttcttaattacccactattaaatcagttcattacccactcactactcgataagtcaatgaaaaatgcttactttaccataagctgagcatgattctaagctctatgtttacagcagttaacaagataaggttcttctctttagaacttatattttacagaagaaagcaattaacatacaaataaataataaggtttcacatatactataaagaaacataaggctaagaacctatatagaatgactgtgtaattttaaatctttttactaaaccttatctttatttcctttcctttctttttctttctttttattttcatttcttttcttttcttgtttttttttttgagacttggtctcactctgttgcccaggctaaaatacagtagcatgatcacagctcactgcagcctcaacctcccaggcccaagcaatcttcccacctcagtctcccgagtagctggaactacaggcatgtaccaccacaacaccagctcattttttttaaaaactttgtaaaggtgggatctccctatgttgtccaggctggtctcaaactcctgagctcaaggcaatctgcccaccttggaatcccaaaggtattacaggcatgaaccaccatgcccaacctatatgtatttctcataaacgctacatattttgatatagagtaaggctatcctcaccctaattgtcaaaataaacacattaccttttctaaaaacaaggaaaacaacaacatcatagaatcattttgtcttcctctcagtaagataccacaggaagacctctctaaaagttaatatttgaacagagacctgaataaaatgaaggtgtaaaatatgcaaggagtgttccaaaaataaggaacaaagtgtgcaaaggacttgatgtgggaacaagcttggtgtgtttaaggaatagcaagaaggccaatttggtgagagtagaataaaagagacagaaagtgataagagatgtagttagagaaataggcagggagatatcaagcaggattttgtgggctgtggtgaaagtttgtattttattctaagagtgacggggaagctattaagagtatactaagcaagaaagtataatcaagtttaggaaacagcatatactatgctaaggatccttcctgacagatttaaggcagagctccaaggataatagcagggctcagaaaatgctgactcaaggcatttcgaactcaataagactaagaggacttcagaaacaagaaagtcactctgatctttccctgcctttctgtgtgaagcatggtcataaaggaattctctgacctaccttgtctaaaagtctaagaccctcattccagggtggaatggtcctgtctcatacccacggaatggtcctatctcatgcccgagaagaaagaatgctacatagagaggccaagaagaatctgaacaaacaggccttgttaagttcctcccagtttattaacattagataataccctttttgtccagtcatgtttctcaacaactatccatttttttcattagaattgccagagaaattcagttttccctgggtctttgggtcttaatttctgaaggctcccatatcatacacaactttgattaaataaatttgttatgcttttctcttgttaatctgtcttgttacaggagtgtcagctgtgaacattgcaatgaatgaggaaaagatgttactttttttctctcctacaattccaaaaccttaatattcagttatatttagctattcttgtttataaggcaaaactttgctaaccctatactgactgaagacaaggcaagtatgagctgtgattctgctaatttaacaagagataaaacattaaagttatctgaatatagcaatatatctctttgtctaatttcttgagtgtatttgatcattattttcaaaatatatgtttaattaaaaattccattacaaaatttatcaataccttgaagataacacaacttataatctgtatttcaacgtgaatacagcagcattatgaatatatgctattggttatgaccatgttttaagaacatatttattctttaagcaagacaattttactgctttatctttatctctgcatttttatttgccacacatgtatatccaagtagagaataaatttaaattggctaaatatttttagaggacctaacatattttcttttactaaggagacagtttcaacacaatgaaaaggtagcaatttctaatctgaataaatgcctaacaatattttatattttaaaaaacaagtaagaaacactagttgattaactaaataacaaagctgaggttggataggaatacatctttggcacaggttgggatacaaagcccataatcaatctaggcttatatttttcaattaaaattaagtagaaaagaaaaatacatgttgggcatggtcgctcacagctacattctcagtgttttggaaggcagaggtagtaggataacttgaggccaggagtttgagaccaggctggaaaatacagtgagaacccctttctaaaaaaaatacaaaattaaccagttgtggtggctcacgcctatagtcccagctactcaggaggatcatttgagctcaggagttcaaggttacaatgagctatgatcacgccactgcattccatcctgggtgacagagtaagactgtctcttttaaaaaaaagaaaaaatacagagtgtgtatctgtaggcatattttcaaagaccagggtgatgttagaaataaaaaccaaataaaccaagttaacatattatacaaagaaagatattctgatagaataaattgattaattcagcaaaaaagtatatatgccaagctttttgtgtgaaaaagaaatagttcacattatttttctgcagacaagtttcctttttaaaaaatgatttacaaaagcatattcttactttcacaataactgaactttttcactaaaatatatagaatctaatttttagaatgaaatgcatctaaccttgtaattttgcttcaattccatctttgttcaatccagatgcaaaacctgcatgtcatgaaaaagtaaaatagaatttagctcatctttacaggctcagtttataccccagttaactagtgaagagcagtctaatgaaatcttatataagaaaaaaaaatctcagctgattgagttcaaacaaggcttaaatatccacagaaacaatgaacaggaatatcatattttaacaagaatggtatggaataaatttccaaatgttttatacatagcaagtatctatcaagtgattaatatcttctaatgaactttcattataacatgaatgttcctaggaaaatatgtttggtaataacaaccattttgtgctattcactaaagctgaaactacacataccctttaacacaataatttcactcctaggcacatacccacagatatacatatacatgtgtatcaaaagatatacatataacaatgttcacagcagcattatttaaaattaataatttcctttcatcaaaagatttatattcatataaacggaatcttttcaagaatagataaagctagcctatggtatgtaagtcagaatagcattgacttctgggggcaaatactgacagaaaaggagcatgagggaacatctagaaaatgttctatatcttaatctgggctgtggttacatgtgtgtatatgtgtgtataaacacatatataaaacttcattgacctctacacctcatatttgtgcagtttactataagtgatatctcaatacaaaaaagtaactacagaaaataaagtaactatgaaaaggaagaaatgaaaattaaaacatgaaaagataccaatattcatacataatattgataaaaatacacaagcatacaccctgaaggaaaggctggagaaacaaaatatggcacttttgaacactgctggtagatatatgagctactaaggtaccaatttagccacaggtatcaaatttataaatgcatatatcctttgacacaggaatttcatttctagagatttatcatacggatagattcatacatgtaaaaaatgaagggtttttttgctgcattgttcgtaagagcaaacaattagacaaagtataaatgtccatcaattggggatcatttaaataagtgatacataagtaaatggaatattatttagctattacaaaaaaaagcttccagccaggcatggtggctcacagctataatcacagcactttgggagggtgaaatcagaggattgcttgagcccacaagttctagaccagcctaggcagcatagggaagctctgcctctacaattttttttttcaaaagttagccaggtgtgctggcatgtgcctgtagtaccagctactctggtggctgaggtgagaagatcacttgagcccagaaggttgaagctgcagtaagctgtgatcacaccattggacttcagcctgggcaacagagtgacagcctgtctcaaaaaagcttccaagacatactaagaaaaaaaggaatgtgcagaagactaaaataatggaggtttaaaaaaatatgccacaaggccaggcatggtggctcacacctgtaataccagcactttgggaggccaaggcaggtggatcacctgagatcaggagtttgagaccagcctggtcaacatggtgaagcgccgtctctgctaaaaatagaaaaaattagccaggtgtggtggtgcgtgcctgtagtctgagctactcagaagggtaaggcagagaattgcttgaacctgtgaggtggagattgcagtgagccaagattgtgccactgcactccagtctgggcaatcaagagaggctatctcaaaaaaaaaaaaaatgcccagaaattctttgatattctgccctctgagagatgaacttaatccctctcgccttcatgtgaccaggactcagtgacttgcttctaaaaaacagaataaagcagaagtaatgatgtgtgacttcagagacaaagttataaaaaagtactgctgcttctgatttagtctgtctctgtctctgtctctctctctctttctctctcagatcattcatcctgagaaaagtcagctgccatgctatgaggaaagatccacctggcaaaagactgaggcctgccaacaactgtgagaaactgaggcctctaacttatagctctgtgagtgagacaatttacaagtgaatcttcaagacccaggaaagccttcagatgactgcagccctagctgacatatgttgcaatctgaagagagcatctgacccacagccacctagctaagacactcccagattcctaacccacataagctgtgtgagataataaattctggttgtttctagatgatttgtttcagggtaatttgttaaaaggaatggaaaactaatacaatatgccacgatttgtgtttaaaaggtgcgaaactaaaattacattttcttatttacttttatatgcaagaattatacaaaaaagatataccaatgattacagaactaggggaaggaaaggcaagagataggaattgaacaactgtgtgggtggggatatacatggaagaattttagttgtatatattccttcactttatgatttttgaactaagtaaatgtattacctagttgaaatataagtttttaagtgatatgagtatttatatagatattcttttaatataggcttatattaattactctttgagatctgaaagttttgaacctctgtacattagaatgatacttcaacaagtcaggctttaatttggtatttcaacaaccccaagttgaatgaatgagtgaaaaaaccctctggaagccacataaccagatgtgggttagctttagaagcaagatgaaaattgtggcagcaacagtagtactatatactttcatttcttataaactgaaaaataaacagtcataaactcagaaaaagtgagtagctgaacactaagtacagaaaaaattcaaaactttttgtaactaacttattttcaatgatttagacatttctgttatttttattggagctgaatttttttctactagatctatttttaatggtgttgatttcaaaccttgttgaaacactagaagtaaaacagataaaaatttctcagcttgtctactcttgtctctaaatgtatttgggactgttgttaccttttgttttgttacctattagtttctgtaatctatctatcctgtaacttattagtataaatacaggcctagctggcttgaaaaaattactacttttccaagtcaaagtaacaaaccataatgagatggatttttcaaggctctgatataaagcagagttgatcgtatccattccacagcaatattcacatccgtgatggtatgcagtactatctctgcatttaaatgttcaataagatgtctgtgcaaactaatgaaaaaaaactttgcattatgaatatgcagttcaatgccataactcttactttttaactttaataatatagaatatacccattgctactttactaattcatgaaatataacttaatttccaaaaacataaaagaaaaccttaaaaagtcagttcaacttctaaaaggcttcagatatacctctctactctatggctgtagaagacaggttattgctttaacaaaagttgaagcgtaaattatatcctactttctccaaaagagaatacattaaatactttactaataggttccagatttcctctattattaagttaaaataagaagtgaaaatgatatttctcctttattacaaattagtaattataaatttacataatttcatatataaattataacataatcataattactaaggctttattacaaattagggtttgttataaacaagaatacatgcttgccaagaaataccactgaataaaactagtaccttttaaaaaaattattaaattccctaaaatgacacaaactttctagttaaatagttgaaaactttacagaaaattgccttaaaaaaatctccaaaccaaatttccctttgatattttaaaaggaaataaaataagctatattagcattagtatctttttggaacttttttttatactacctgctttctacagtgtctctacaagctaacatctgaatgtacttgtcccttgtgcttaatcgagtcatgataactgcagtagctgtagtgtcaaactggggagaaaacaaacagaaatttagtgaagaagagcacatcttggtagcagtcctcttcaataactgaagacttccattttatattaaacagtctccttgtctgaaataatacttcaaaaaggccttaaaaatgctctcatttttttaacctaaaatttaatttaaaagccttccaagagtatagctgtaaatatcactttggtttcaatgtaacataattttggcaatgttaaaatcaaaacaaactttggtaactgtataaaagttgtaagatttggtataatttacatataatctgatttactctatgaaattgtagaactgtacaacataatatttacaaatgttttgaaaatataatcttcctgatgttcccataatacctataaaaatgacttattcatgtatttgtcagagtagggtatgttttgaaatgtatttggacttttgtcataattcctgggaacacaattagcatttagtgctaggacctagggatgtttcatgttctgtaatgtgacagccctaagcaaggaaaacctgttccatccaaaatgctaagagtacccccattcagaatttaaaaaaaaaaaaaaacagtcaaaatcaaaaagacctttaacagcatacccattcataaacccatcccctcatcagccaagacaagcttagacagaatgaaggaagtatgtcccagttggtgaggcttgtcttacttttattcctccactaaaggtaaattttctctgctatattacttttaagcctgatacaattatgacatgctaatcaaaaaatacacaatttttttgtttttatcatgtttttaagtataaaaagcaaagttattgtcacttacttgaggtcgaccagctctaccaatcatctgtagaatatctgtttcactgtactcttcaaacagtcctccagcataatgcattgtagattttataactactaggtgagcaggcaaatttactcccatagctaaagtactggtagtaactgcatcagattaagacatagtaattttgagccatttaactttgttgcttcaggaacattttttaataaaagacattcttataaatgtaataaaaactcatacataagaaatttagaaaagaaaaaagagcattacaatctaaaatagtaacacaccttaaatccaaaaacctattaaattcttgtttttcaaattacaccatgttcaacaatatgataaagaactaaacactaccaaagaatttactgtagcatctacatgcataggtaaccacttaattttatattctcagaagaaaagcagaaacaagcagaacacttgcgctttttccttttttcctcttaaaaataattttccaaaatattttatagtatccacgagaaatatgttttacttacaaagaactggtaaatctccaacagtaaaagctccctcaactacttttctatctgacagctccataccagcatgatgataagcagcaccatcttttaagatatctgtaatagaaatatatcagctgttactattaatatttcatcaataattggcacctttcatctatatgtgaaaatgctattcaaaaattatctctaaacctacctctcagttttgaatctcttacggaatatgcatacttctgtaacctatttaaaaataccataaaattattgagttactcccagtaacattagagaactctgaaacagtttattattttaaaacttagagatatcaaaaaattttcacaatatcattatctgaaaactattttaagaagtagaaaatatccaactttcatattcaaaagtccctaaacttatgagctacaatattaaagctcacttttaaaccaagaatttggaaaactcactttccccaagaaaacaacataattggtgattaacaagtcagtataaaagtctactctcataatttgcctaaaaaaaattataagaagtaaccatttctaaaactactatattactagtaaataagcaaaaaaaaaaaaaaaaaaaacatggaaataaaccatagtgtttccagtgctctgagacatggcatttaaaaaaactaggttaggaggaagcaagatggtcaactagagatgcctaatgctcatcttccccacaaaaaagagcaaaacaatgaataaacaactaactacattttgaacagaatgactaaaggaaagtgcctctctataaatttgaaagaggtgattattccactagttgtgcagacatcaatagagggacacaggaaacatgaaaaaaaaaaaaaaccaaccaaaaaaccaggaaatacaccaccaacaaaggaacgcaataattctccagtaactgattccaaaaaacagaaatttgtaaactgtctgaaaaggagttcaaagtaatgatcctaagaaaactcactgagatacaagagaatacagatagacaggtcaatgaaatcaggaaaacaattcattatctgcacaagaaagttattcaaaaagaaccaaacagaaatcttggagctaaagaattaaatgaatgaaatcaaaaatagagagcttcaacagcaaaccaaaacaagcagaagaaagaatctgtgaaatgaagttaggtttctgaaatagcctagtcagagggaaaaaaaagaaagagaaaagaacaaaaaagagtgaacaaagcctataggacttatgggacaccattaagcaaacaagtattcatattatggaggttccagaaggagaagaatgaggaaaaggcatagaaagtttatttaataaaataattgctgaaaacttcccaagtcttgggagagacatggacatccagttccatgaatctcaaaatcaccaaacacgttcaaacccaaaaaggtcctcactgaggcacattataaccaaaatgtggaaagtcaaagacaaagagagaattttaaaagtagcaagagaaaagtgtcaagtgatttataggggaatctccattagactatcagtgtttctcagcagaaaccttgcaggccaggagagcatgagatgatacattcaaagtcctgaaagaagacaatattgccagtaaacaatactatacaaagcaaagctgttcatcagaaatgaggagaaataaagtctcagccagataaataaaagctgaagaaattcaccactagacctgccttataagaaatgattaaagcagttcttctaccagatacaaaagaatgataattagtatcatgaaaacatatgaaagcataaaacacactggtagaggtaaatacacagtcaaattcagaatgtgccaccactgtaatggtggtgtgcaaatctttcaaatctctattatgaaggtgaaaaatcaaaatagtcaaaaatacagctacaatgagttgttaaggaatactgaatataaaaagatgtaaactgtgtcaacaaacataaattgtggggggagggcaaaaatctagagtagttgtatgtgactgaagttcagtttaaaatagtctattataactctaagatattttacgtaagccttgtggtaactgcaaagcaagaagctacagaagatacagatgagaaagagaaaggaatcaaagcttagcgctacagaaaaacaacaaatcacaaacttatacaacaagaggaagaaaggaacaactgatctaccaagcaaccagaaaacaattaaaatggcaggagtaagtccttatctatcaataataaccctgaaggcaaatgaattaaattctccaatcaagacatatagtgtctaaattgatagaagaaaaaaaaaaaaccaagatccaactacatgctgcctaccagagatccatcttagctataaggacaccggctgaaagttaaggggtaaaagaaaatattctacataaatagtaaccaaaagagagcagggtggctattcttacatcagttaaaatgactttaagtcaaaaactgttacaagaggcaaagaaggtcataatttaacgacaaaggggtcaattcatcaagagcacataagaattgtaaatatataagcacccaacactgaagcataacatatatataaaacattattaaaggacatgaagagagaaatagacaacaatacaataataggaggggtcttcaatatcccactttcaataatgatagattaaccagaccgaaagttaacaaagaaatactggacttgaattgtactttgagtcaaatggacctaacagacaaatatagaactttgcattcaatagcagcagaatgtatacgcttctctagagcatacgaaacattctacaggacagatcatacattaagccacaaaactagatttaactatttttaattaatctaaattcaagacgattgaaatcatatgtagtatcatttctgaccacaacaatatgaaactagaaatcaataacaggaaaaatcttgaaaaaaatcacaagtatgtggaaactaaacaacatgctcctaaacaatcaatggtcaaagaaaccaaaagggaaattaaaaaatatcttgagacaagtaacaatggaaagacaacacaccaaaacctatgagatgcagcaaaagtggttctaagaggaattttttttttttttttgagacagagtttcactcttgttgcctaggctggagtgcaatggcatgatctcggctcactgcaacctatgcctcccaggttcaagcgattctcctgcctcagcctcctgagtagctgggattacaggcatgtaccaccacgcctggctaattttgtatttttagtagagacatggtttccccatgttggtcaggctggtcttgaactcaagaggaaattttatgcaataagtgcctatattaaaaaaagaagatactaaatagacagcctaacattatacctacaggagctagcaaaagaacaaactaaatgcaaagttagcagaagaaaggaaataataaagatcagaacagaaataaatcaaatagagatccaccaaaaaaacatagaaaatgatcaataaaaccaagacttggttctttgaaaaaataaaataaacaaatatctagctagactaaggaaaaaaaaagaagaaacaaataaaataaaaaatgaaactggagaaatcaccaacagatgcctcagaaatcaaagagatcataaggggctattatgaacaattatatattaatactaacaaattggataacctacaggaaatggacaaactcctagaaaaatacaacctgctaagtttgaatcaggaagaaatagaaagcttaaacagaccaataacacataatgagattgaagtagtaatgaagaatcttccaacaaggaaaagcccagaaccagacagcatcacaactgaattctaccaaacattcaaagaagaattaccaccaatacttcataaactattccaaaaaatacagctacagggaatacttccaaacatattttgtgaggctactatcacgttgatacctaggccacataaagacactacaagaaaactataggctagtatctctgatgaatattgatgcaaaaatcctcaataaaatatatgcaaactgaattcaacaacacatcaaaaaggattatacaccatggccaagtggatttattcctggcaagcaaggctggtttaatatatgccaatcaaccactgtgatatatcacattaacagaatgaaagataaaaaacacaagaccatctcaattggtgcagaaaaagcatttgacagcaagttcaacatcctttcttgataaaatctcttaacacgcaggcatataaggaaaacttctcaactaatgtaacaaaggccatttatgaaaagcccacagccaacatcataatcaatggggaacaactgaaagcttttccaccaagatacagtacaaggcagggatgcccactctcactgcttctattcaacacagtactggaagtactaccaagagcaatcagataagaaaaaaataaaaggaattcaaatttgaaaggaagaagtaaaactatctttatttgcagacaacattatcttacatgtaaaaaaacctcaaagattcattaaaaaactgttagaactaataattcagtaaagttgcaggattcaaaatccatatacagagattagtagcatttttaaacaaaaataataatttaactgaaaaagaaatctagaaaacaatcccagttatgacagcataaaaaaataaaatgcttaggaataagtttaattaaggaggtaaaagatctgtacactgaaagctatcaaacaatggtgacagaaatccaagacaaaaataaatggaaagatatcctgtgttgatggattgaaagaattaatattgttaaaatgtccatactacccaaagaagtacagattcaatacaatccctatcaaaattccaatggcatccttcacagaaatagaagaaaaaatcataaaattaactttgggatgccgagatgggtggatcacaaggtcaggagatcaagactatcctggctaacatggtgaaaccccatctctactaaaaatacaaatggtgtgaacctgggaggcggaccttgcagtgagccgagatcgcgccactgcactccagcctgggcaacagagcaagactccatctcaaaaaaaaaattttttttcataaaattagtatggaaccacaataaaccctggatagtgacagcaaaactgagaaggaaaagaaagttggagctacacactttctgatttaaaattatactacaaagctggactaaccaaaacaatatagtacttgcataaaaacagaaacacagaccaatggaacagaacagagagcccagaaataagtccaaacatacacagtcaactaattttccattagggcaccaaaaaaaatggggaaacaatagtttcttctataaatgaggctggaaaaacaatttccatatccaaaagaataaaattgcacccttataccatacacaaaaatcaactcaaaaattgacaaaagatctaaatgtaagacctgaaatcataaaactcccagaagagaacatagggcaaagcaccttgatattggccttggcaatgcagcacacctgctctaccaaaaaaacagtcagactgtttctttgggggggtccctgatcctgttccactgactgggtgagacatcccaactggggtttccagccacctcctaaaggtacatgcagactggcaacaggtcagtactccctggggatggagcttctagaggaagtagctggctgtcatctttgctgtttcacagtcttcactggtgatatttccaggtacgggagaaactgaggcaactagggtttggagcagatccccagcaaactgcggcagctctacagtagagtggcctgttaaaagcaaaacaaacagaaaacaccaccaccaacaacaaaaaagatcccataaaaacctcattcaaaggtcagcaacatcaaagatcaaaggtagataagcccacaaagatgagaaagagtcaacgtaaaaacactgaaaactgaaaaagccatagtgtctcttctcctaatgactgtaacatttctccagctaagaactgggctggaggctgagatggctgaatcgacagaagtaggctacagaaggtgggtaataacaaacttcactgagctaaaggagcatgttataacctaatgcaaaaaaaggtaagaaccatggtaaaacagtacaggagctgatagccagaacagccagtttagagaggaacataactgatctgatggaggtgagaaacacaacacgagaacttcacaatgcaatcgcaagtatcaataacagaatagaccaaatggaggaaagaatctctgagctagaagattatctttctgaaataagacaggcagacaagaatacaaaaaaaaaaaaaaaggaagaagaagaatgaaaaggaatgaacaaaacctccaagaaatatgggattaagtaaagaaaccaaacttacaactgactggtacctgaaagaaacagggagaacaaaaccacactggaaaacatacttcaagagaacttccaggagaacttccccaacctagcaagacagcccagcattcaaattcaggaaatgcagagaaccccaggaagatactccacacgaacatcaacctgaaaagacataatcatcagattctccaacgttgaaatgaaagagaaatgttaagggcagccagagagaaagtcaggtcacctacaaagggaaactcatcaaactaacagtggatctctcagcagaaaacctacaagccagaagagactgggagccaatattcaacattcttaaagaaaaaaatttctgacccagaatttcctatctggccaaacaaagcttcataagcaaaggagaaataaggttcttttcagagacagcaaatgctgagggaagtcgccaggcctgccttgcaagagttcctgaaggaagcactaaatatggaaaggataaacaagtctgaaaaataaccagctagcatcatgatgacaggatcaaattcacacataacaataccaatcttaaattgtaaatgggctaaatgccccaattaaaaggcacagaatggcaagctggataaagagccaagacccactggtatgcagtcttcaagagacccatctcagatgcaaagacacacaggctcaaaataaagggatgaaggaaaacttaccaagcaaatggaaaacagaaaaaagcaagggttgcaatcctagtttctgacaaaatagactttaaaccaacaaagatcaaaaaagacaaagaagggcattacataatggtaaagggatcaatgcaacaagaagagctaactatcctaaatatatatgcacccaatacaggagcacccagattcataaagcaagttcttagagatctacaaagagactcagactcccagacaataatactggagactttaacaacccattgacaatattagacagatcactgagacagaaaattaacaaagatattcaggacctgaactcagctctggatcaagtggacctgacagatagctacagaactctccactcaaattcaacagaatatacatttttctgatagctacatggcatgtactctaaaactgatcacataattggaagtaaaacacttctcagcaaatgtaaaagaatggaaatcataacaaacagtctctcagaccagagcacaatcaaattagaactcaagattaagaaatacactcaaaaccacacaactacatgaaaactgaacaacctgctcctgaatgactcttgggtaaataatgaaattaaggcagaaatcaagaagttctttgaaactaatgagaacaaagagacaatgtacctgaatctctgggacacagttaaagcagtgttaagagagaaacatatagcaccaaattcccccatcaaaaagctagaaatatcccaagttaacaacctaacatctcaactaaaagaactagagaaccaagagcaaacaaaccccaaagctagcagaagacaagaaataacgaagatcagagctgaaccgaaggagatagagacatgaaaaaacccttcaaaaaaaaaaaatcaccaaatccaggagctagttttttgaaaaaattaacacaatatatagactgctagctagactaataaagaagaaaggagagaaggatcaaataaacacaatcagaaatgatatgggggatatcaccactgaccccatagaaatacaaacaaccatcagagaatactgtaaagacctctatgcacataaactagaaaatctagaagaaatggatgaaatcctggacacacactctcttccaagactgaaccaggaagaaattgaatccctgagcagaccaataatgagttctggaattgagacagtaataactagcttaccaaccaaaaaaagcccaggaccagaaagatccacagctaaattctaccatgggtacaaagaaaagctgtcaccatttctactgaaactattccaaaagactgaaaaggagggactcctccctaacccatttatgaggccagcatcatcctgataccaaaacctggtggagatacaacaaaaaaggaaaacgtcaggccaatatccttaatgaacactgatgcaaaaagcttcaataaaatactggcaaactgaatccagcagcacatcaaaaagcttacccaccatgatcaagttggcttcatccccaggatgcaaggttggttcaatgtacacaaaccaataaatgtgatgcatcacataaacagaatgaaagacattattatcccaatagacacagaaaaggacttcgatacaattcaacactccttcatgttaaaaactctcaacaaactaggtattgaaggaacatacctcaaaataataagagctatatatgacaaacccatagccaataccatattgaatgggcaaaaactggaatcattccccttgaaaactggcacaagaaaaggatcccttctctcaccactcctattcaacacagttttggaagttctggcaagggcaatcaggaaagagaaagaaatacaggtatttaaataggaagagaggaagtcaaattatctttgtttgcagatgacatgatcctatatttagaaaacgtcatcttctcagcacaaaagcttcttaagctattaagcaatttcagcaaagtctcaggatacaaaatcaatgtgcaaaaatctctagcattcctatacaccaacaacaggcagtcagagagccaaacagtgaatgaactcccattcacaattgctacaaaaagaataaaatacctaggaatacagctaactagggaggtaaagaaacttttcaaggaaaactacaaaccactgctcaaagaaatcaaagtggatacaagcaaatagagaaacattccatgctcatggataggaagaatcaatattgtgaaaatggccatactgcccaaagtaatttatagattcaatgctgttcccactaaactaccattgacattattcacagaatcagaaaaaaactattgtaaaatttatatggaaccaaatagctgagatgatcctaagcaaaagaacaaagctggaggtatcattctacccatcttcaaactatactattatagtaaccaaaacagcatggggctggtacaagaacagacacatagaccaaaggaaaagaatagagaacccagaaataagacgacacacctacaaacatctgatcttcaacaaatgtgacaaaagcaagcaatggggaaaggacaccctatttaataaatggtgctgggagagctggctagccatatgcagaaaattgaaactggaccccttccttacaccctacacaagaattaactcaagatggattacagacttaaatgtaaaaccgaaaactataaaaaccccagaagaaaatctaggcaatacccttcaagtcataggcacgggcaaagatttcatgaagaaaacaccaaaagcaattacaacaaaagcaaaaattgacaaatggcatcaaattaaaatcaaaataaggagcttccattcagcaaaagaaatatcatgagagtaaatagacaacccacagaataggagaaaatttctgcaatctatctatctgacaaaggtctcatatccagagtctacaaggaacttgaacaaaattacaagaaaaaaaacaaacaaccccattaaaaagcgggcaatggacatgaacagacacttttcaaaagatgacacacgtggccaaccaatattatgaaaaaaagctcaacatcactgatcattagagaaatgtaaatcaaaaccacaatgagataccatctcatgtcagtcaaaatggcaattactaaaaagtcaaaaaaaaaaaaaacagatgctggcgaggttgcagagaaaaaggaacgcttttacactgtttgtagtgtaaattagttcaaccattgtggaagacgttgtggcaattcctcaaagacctacaaccagaaataccatttgacctagcaatcccattactgggtatatacccaaaggaatataaattattattttataaggatacatgaacacatatgttcattgcagcattattcacaatagcaaagacatggaatcaacctaaatgcccatcagtgatagactggataaagaaaatgtggcacatatatactctggaatactacacagccgtaaaaaggaatgatatcatgtcctttgcagagacatggatggagatggaagccattatcctcagcaaactaacacaggaacagaaaagcaaacaccacatgttctcacttataagtgggagctgaatgatgataacacatggacatatggaggggaacacattgggacctgttggggaggttggggagggagagcattaagaataatagctaatggatgctgagcttaatacctaggttatgcgatgatttgtacagcaatccaccatgtcacatgtttacctatataacaaacccatacatcctgcacatgtacccttaaacttaaaagtggaaggaaaaaaaaaacataagaatggccaacaggtatatgaaaaggtgttgaacatcactaattatcaggaaatgtaaattaaaaccactatattatagacaacaaatacaggtgatggtgtggaaaaaagggaatcctagtacactgttggtgggaatgcagattggtacagccattatggaaatagtattgagatttctaaagatattaaaaatggaattaccatattaccaagcaacctcttctctgggtatatacccaaagaagagatcattacctcataaagatatctgcactcccatgttccttgcagattgttcatagtagttaagatatggaaacagcctaaaggtctgttgatgaactaatgcataagaaaaatgtggtatctgtgtgtgtatatatacatatacatatacatatatatatatatatatatatatattttttttttttttttgagacagagtcttgctctgtcgcccaggctggagtgtgcagtggcacgatctcagcttactgcaagctctgccccccggggttcacgccattctcctgcctcagcctccagggtagctgggactacaggcaccagccaccacgcccggctaattttttgtatttttagtagagatggggtttcaccatgttagccagggtggtcttgatctcctgacctcatgattcgcctgcctcggcctcccaaagtgctgggactacaggcgtgagccaccgcgcctggtgtgtatatatatataacatagtatacacacacatacacacacacatgcacacacacaatggaatattattcagccttataaaagaatgagattctgcgacttgccacaacatggctggacctggagtacattgctaagacactaactgaaataagccagtcacagaaagaaaaatattgtatgttctcactcacatgtgaaacgtgtttttaaaaagtcaactatacagagatagagaataaaatagtagttatcagaggcaggaagggtgggaacgggggaagaaatggggagatgtaggtcaaaggatatacagaaaagcagatacatagtgtgaacaaatctagagacctaatgtacaacataaagactatagttaataaaaattattttggattagggattcttgttaagtaagtagatttagctgctcttgtcaaaaaaaaaactatgtgagatgagagatatattaatttgcatcactacagtaaccattttactagctatatgaatcacataacatcatgttgtaaacctcaaatatgccatataaaatttattttttaaaaaagaaaactaggtgaaaagacaagaggaagttaagaaagtgtgttgataatttgaaaatgaattctgggtacattaaaagattttggaagttggtaggcttggttcttaagtatataaaaacatctagtatttttctacttccttgttgcagatatgacactaggatgaattatttttatgataacactcatgactttttttaaggattcacaatggaatgaagataaggcaagaggaaaggcatgttactattaagtacaaactctgctacccactgttaggtatcttagaaatgtcgcttatttaattatcatagaaacatggtgagatgattgattctcacatatacaatattgattaagaaattgaagttgaaagaagttaagtaatatgtccaatagtacacagctagtaaaagtagcagcactgtaattcaaatctgagtctctaactccggtatgttcctgaaaaaaaaaaaaaaacaggaataaaaagagataaagaaaaaataaggggcaaagactgaagaaagaagagaggagagttaaaggagagagaaactttccattagtaactaggtaagagtgggaaatgagaaaaggaattaagatatatgtttgcaaaaaaatgattatctgaaacaaaattagctaatttgttcacaacagaaaaaagggagaggataaattgtaaattagttttaaaggaacttgtagtgtatttcaattccctactcatatagataagttcagctcaaaaatgtttattatgtattcaccttaggacaccagatatttctatgtgaatcatgctgccattgcacaaagaattccgtaagtctctcaaaactgccttcagagttaagtttatgagcaagcaaacaagcctcattacttgatccccacatcttgtttctgacaaaaagtgatatgaaccaacttgatcatctagtttattcacccaacaagtagaaagcttcaaattgtttagacctacttacagcctctctaccctatacctacacgttttaaaaaaatcccagtttacctttattctattactagttttataatgaactggtcaatgtttttgaaaccccatctttgttttaaaaacttagaaaattaataagaggtgggtggagccaagatggacaaataggaacagctccagtctacacctcccagcgtgagcaatgcagaagacaggtgatttctgcatttccaactgaggtactgggttcatctcactggggagtgtcagatagcgggtgcagtgcaccgagcttgagctgaagcagggcgaggcatcgcctcacccgggaaatgcaaggggtcagggaattccctttcctagtcaaagaaaggggtgacagacagcacctggaaaatcgggtcactcccaccctaaaactgcactttcctaatggtcttagcaaacggcacaccaggagattatatcctgcgcctggcttggagggtcctacacccacagagcctcgctcattgctagcacagcagtctgagatcaaactgcaaggcggcagtgaggctgggggaggggcacccgccattgccgaggcttgagtaggtaaacaaagcagccaggaagctcgaactgggtggagcgcaccgcagctcaaggagggctccctgcctctgtagactccacctctgggggcagggcatagccaaacaaaaggcagcagaaacctctgcagacttaaatgtccctgtctgacacattggaagacagtagtggttctcccagcacgcagcttgagatctgagaacggacagactacctccacaagtgggtccctgacccccaagcctaactgagaggcaccgaccagtaggggcggactgacacctcacacagctgggtactcctctgagacaaaacttccagaggaacaatcaggcagcagcatttgcggttcaccaatatccgctgttctgcagccaccgctgctgatacccaggcaaacagggtctggagtggacctccagtaaactccaacagacctgcagctgagggtcctgactgttagaaggaaaactaacaaacagaaaggacatccacaccaaaaacccacctgtacgtcaccatcatcaaagaccaaaggtagataaaaccataaagatggggaaaaaacagagcagaaaaaccggaaactctaaaaatcagagtgcctatcctcctccaaaggaacacagctcctcaccagcaatggaacacagctggacggagaatgactgacgagttgagagaggaaggcttcagaagatcaaactactccaagctaaaggaggaagtttgaacccatggcaaagaagttaaaaaccttgaaaaaaaattagacgaatggctaactagaataaccaacgcagagaagtccttaaaggacctgatggagctgaaaaccacagcacgagaactatgtgacgaatgcacaagcctcagtagccgatgtgatcaactggaagaaagggtatcagggatggaagatcaaataaatgaaatgaagtgagaagtttagagaaaaaagaataaaaagaaacaaacaaagcctccaagaaatatgggactatgtgaaaagaccaaaactacatctcattggtgtacctgaaagtgacggggagaatggaaccaagttggaaaactctctgcaggatattatccaggagaacttctccaatctagcaaggcaggccaacattcaaatttaggaaatacagagaacgccacaaagatactcctcaagaagagcaactccaagacacataattgtcagattcaccaaagttgaaatgaaggaaaaaatgttaagagtagccagagagaaaggttgggttaccaacaaagggaaacccaacagactaacagctgatctctcggcagaaactctacaaaccagaagagagtgggggcaaatattcaacattcttaaagaaacgaattttcaacccagaatttcatatccagccaaactaagcttcataagtgaaggagaaataaaatcctttacagacaagcaaatgctgagagatttttgtcaccaccagccctgccctaaaagagctcctgaaggaagcaataaacatggaaaggaacaactggtaccagccactgcaaaaacatgccaaattgtaaagaccatcaaggctaggaagaaactgcatccactaacgagcaaaataaccagctaacatcataatgacaggatcaaattcacacataacaatattaaccttaactgtaaatgggctaaatgctccaattaaaagacacagactggcaaactggagaaagagttaagacccatcagtgtgctgtattcaggaaacccatctcacgtgcagagacacatatatgctcaaaataaagggatggaggaagatctaccaagcaaatggaaaacaaaaaaaggcaggggttgcaatcctagtctctgataaaacagactttaagccaacaaagatcaaaagaggcaaagaagactattacataatggtaaacggatcaattcaacaagaagagctaactatcctaaatatatatgcacccaatacaggagcacccagattcataaagcaagtccttagagacctacaaagagacttagactcccacacaataataatgggagactttcacaccccactgtcaacattagacagatcaacgagacagaacattaacaaggatatccaggaactgaactcagcactgcaccaaccagacctaatagacatctacagaactctccaccccaaataaacagaatatacattcttttcagcaccacaccacacctattccaaaattgaccacatagttggaagtaaagcactcctcagcaaatgtaaaagaacagaaattataacaaactgtctctcagaccacagtgcaatcacactagaactcaggattaagaaactcactcaaaaccgctcaactacatggaaactgaacaacctgaatgactactgggtacataatgaaatgaaggcagaaataaagatgttctttgaaaccaatgagaacaaagacacaatgtaacaatctctgggacacattcaaaacagtgtgtagagggaaatttatagcactaaatgcccacaagagaaagcaggaaagataaaaattgacaccctaacatcacaattaaaagaactagggaagcaagagcaaacacattcaaaagctagcagaaggcaagaaataactaagatcagagcagaactgaaggaaatagagacacaaaaaacccttccaaaaatcaatgaatccaggaactggttttttgagaagatcaacaaaattgataaaccactagcaagactaataaagaagaaaagagagaagaatcaaatagacgcaataaaaaatgataaaggggatatagccaccgatcccacagaaatacaaactaccatcagagaatactataaacacctctacgcaaataaactagaaaatctagaagaaatggataaattcctcaacacatacaccctcccaagactaacccaggagaagttgaatctctgaatagaccaataacaggctctaaaattgaggcaataattaatagcttaccaaccaaaaaaagtccaggaccagatggattcacagccgaattctaccagaggtacaaggaggagttgttaccattccttctgaaactattccaatcaatagaaaaagagggaatcctccctaacgcattttatgaggccagcatcatcctgataccaaagcctggcagagacacaacaaaaaaagagaattttagaccaatatccctgatgaacatcgatgcaaaaatcctcaataaaatactggcaaaccaaatccagcagcacatcaaaaagcttgtccaccatgatcaagtgggcttcatccctgggatgcaagcctggttcaacacacgaaaatcaatacacgtaatccagcatataaacagaaccaaagacaaaaaccacatgattatctcaatagatgcagaaaaggcctttgacaaaattcaacaacccttcatgctaaaaactctcaataaattaggtattgattggatgtatctcaaaataataagagctatctatgacaaacccacagccaatatcatactgaatgggcaaaaactggaagcattccctttgaaaactggcacaagatagggatgccctctctcaccactcctattcaacatagtgttggaagttctggccagggcaatcaggcaggagaaagaaataaagggtattcaattaggaaaagaggaagtcaaattgtccctgtttgcagaagacatgattgtatatttagaaaaccccatgttcccagcgcaaaatctccttaagctgatagataacttcagcaaagtctcaggatacaaaatcaatgtacaaaaatcacaagcattcttatacaccaataacagacaaacagagagccaaatcatgagtgaactcccattcacaattgcttcaaagagaataaaatacttaggaatccaacttacaagggatgtgaaggacctcttcaaggagaactacaaaccactgctcaaggaaataaaagaggatacaaacaaatggaagaacattccatgctcatgggtaggaagaatcaatatcctgaaaatggccatactgcccaaggtaatttatagattcaatgccatccccatcaagctacaaatgactttcttcacagaattggaaaaaactactttaaagttcacatggaaccgaaaaagagcccgcattgccaagtcaattctatgccaaaagaacaaagctggaggcatcacactacctgacttcaaactatactacaaggctacagtaaccaaaacagcatgatactggtaccaaaacagagatatagaccaatggaacagaacagagccctcagaaataatgccacatatctacaaccatctgatctttgacaaacctgagaaaaacaagaaatggggaaaggattccctatttaataaatggtgctgggaaaactggctagccatatatagaaagctgaaactggatcccttccttacaccttatacaaaaattaattcaagatgcattaaagacttaaatgttagacctaaaaccataaaaaccctagaagaaaacctaggcaataccattcaggacataggcatgggcaaggacttcatgtctaaaacattaaaagcaatggcaacaaaagccaaacttgacaaatgggatctaattaaagagcttctgtacagcaaaagaaactaccatcagagtgaataggcagcctacagaatgggagaaaatttttgccatctactcatctgacaaagggctaatatccagaatctacaatgaactcaaacaaatttacaagaaaaaaacaaacaaccccaacaaaaagtgggtgaaggatatgaacagacacttctcaaaagaagacatttatgcagccaacagacacatgaaaaaatgctcatcatcactggccatcagagaaatgaaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagtcattgtggcgattcctcggggatctacaactagaaataccatttgatccagccatcccattactgggtatatacccaaaggattacaaatcatgctgctataaaggcacatgtgcacgtgtgtttattgaggcactattcacaatagcaaagacttggaaccaacccaaatgtccaacaatgatagactggattaagaaaatgtggcacatgtacaccatggaatactatgcagccataaaaaatgatgagttatgtcctttgtagggacatggatgaacctggaaactatcattcgcagcaaactatcgcaaggacaaaaaaccaaacaccacatgttctcattcataggtgggaattgaacaatgagaacacatggacacaggaaggggaacatcacacactggggcctgttgtgggtggggtgaatggggagggatagcattaggagatatccctaatgttaaatgatgagttaatgggtgcagcacaccaacaccacatgtatacatatgtaacaaaactgcacgttgtgcacatgtaccctaaaacttaaagtataataaaaaaaagaaaattcataagaatgctataaaactacatgcagttggtatgaaaattattaatcattttttgatggtattcttattagcaataatttcactttctccctttctttctacctctcagacttcatctactttttgactgtgagctctttgttggtttttctcattctgtcttgctctctactgtttcttattgcttaatcttgctttgttgacgtgtattataaaagaactactctacatgcttcacaccctagagattttttttcatatggtagtaactaagaagatcaagttaaatcctttaaatggaaggaaaagtgtcaaaatagtatctagagggtgaataagtggctatgtttgtaattctttaatagactatctttatagtctacctttttagtggattaaaaaaaaacaaagaatgtaaagaagactaaattggctcctctaggcttgctacatatctttggttgacaagcaaccagaggtggtggcaaaggaacagactggtaattggaaagctgatctgacccaaagcggagagaagtatattcccccaccatacaaaattaggcagaaaaaataagtatctgctcatatccacatgtccaattttagtctgaggtctaccactaaacatatttactgatttccagaagttattaacaataataataagttaatgttcattacatagtaatcatgtgctagcactctgctgagaccttctgctataatttggatgctgtccatttaaatctcatgctaaattgtaatctccagtattgaaggtgaggcctggtaggaggtgaatggatcatgggggcagatcctcatggcttggtgctattcttacaatagtgagtgagtttttgtgacatctagttgcttaaaagtgtatggtaccccccgacccctactcctgctctcaccatgtgatacaccaactcatcctttgccttctgccatgactgtaagcagcccaaggcctcaccagaagccgagcagatgtggtgccatgtttcttgtacagcctgcaaaactgtgagccaattaaacctcccttctttataaattacccaggctcagaaatttctttatatcaatgcaagaatgacctaatacacctgctaagattgagtggtaagcaggatgaacatgagtccccctttcctcaagaagttgataatctaattaatagaaaagatattaaaataactattaaacaaaaggatattataattatagtaagtgctatgaaatcaagtacaggttgcttataaaagtaaatacagggaaactgatggctatggaaaactgatattaaagtttagacatgaaggataaataggagttaggtgaaaaccattccagtaaaagcaagcaccatgcaagacaatgctgtacagagtaacagtttggtgtattcacagaacacagaggctaatacagcttgaccgtgatgattaaagggggagaatggtcatgaaaagtctggagaattggctaggcatcacattacatgggctactgcaggctacactaaggatttagcatttaatccccagaacaataagaatctattaaagggttttaggcaggaaactgccatttagatttgcaatcttacacaatctatgctatgtagagaataaagctggataagagagtgtgtgtgtagtgattaaagaaaaggatacagcctaggcaagagattactagtgacttgaattagggaagtggcagtgttgatggagacaaaatgacatatttgagatatatttagaagtaagaataaacaggacttcgtaattgattgtggggtataaggtgaagaagatatcaatcatagttttctgctatgagtaactaaggagataatgtataattaagatggggaacactggagaaggagctggtctgagagcaagaaccaaggttctatttggtacatagtgagtttgagataactgttggtagacatacaactggattcagttacacagatggactataggcctggagctcagtaaggaagtctgggccgaaggcataaatgtgggaattcatagacatgcataaatattatctgaacttcatgtgagtacttacaaacacctaagagtgtggcattagaaagaatgaacctcaggtatactcactcgaatgtcaacatttaagagttgggtagaagaggtgaaaaggggactgagaacgaacagcctgcaaaggaggaagaaaatcagtagaaatgatcatggaagcacagagtccagagtgtttaagtaaggtggaagtggccaaatatgatagagagtccttaaagattaattcgcaagatcagctttagtgaaagactataaaagatgctggattgaaattaggttaaaaaaaatagatagtagtatggataatctttatcattcaagaaatctggatcacccctgtacgaagattcactatctcacttaatcctcaaaattatcattatccttattttatagatgaggacactgaggtttaccccaaggttatgggacaagcctaattttctcatgtcatctagatgagccctaaaagtccttctacttccatgaaaaaataaaatactatacctctgtttctgttccacagtcataataaatttagcatctttcacaagaacagaagcagcctgttgcacacccttccttgttgcacaaaactgaaaataaattcataacgtttgtattaatcatgttaaaaactgaatatactaaaaaataagctatcaacaatccataccacaagtgtgggtttctgatcagagtacatttgtataacactggcaattttgtagttgagggttaaatcaaacttaaactcagtttggttactactgcagggaaatccaaggaccactttctgaagtttcactggtctatggctctcatccattttcagacacacagctggtctttcaccatctgaaagccattctgcaatctttgaaacacaaaaatatgtgcattaaaattttcttctagtaaagttttattgctaaaaacaacccaattacaaagcactttaaggtcaagctataaaagtatttaatcaagtatgctgtctttttcaatattacatattccattaatattattctgttgatatagtggtcaacactaccaatagtagtatttcaagattatacccacttttcaccatggtaaacttccaattaattattattattttgttttattttccttcataagaatccaaagaaaaattatcaattttgtcatagaggccaaatttctcactattattttaacttctttgctatttttgaaaactacgcctcaaaatggctgacatctcttttgtgttgtcctaaatattagataaatagcagcaaattaatagttggtttaggttggcaagggttgacaagtttttaagcaaacaacaaacacttgagagatgccagtgccaaaagcaaacttcagactcaagctagattctggaactgtggtaagcaatccttatctttacatagcccagttaataatcaggctccatgctctgctatgaaattgactgttgttttgacaggtagaaaacattaaaataatctcaaggttatcatgagtagggataagatcacataagaatttacagacagaggggagcagaaggccaagaataaaaaccttaatttagggaaaaacggaggaagaagatctgacaaaagagacagaaacagcattcacacaagtagtgtttatcacaaaggggaaaagtttcaagaattagacagtactagtacataataattgcttacaaataagttaagaaaaatttagtattccaatgtgaaaaaaaggcaaatgacataacctggcaagttttaaaaaaagaactcaaagtagttgataaatatatttaaaattttaccttagtagaaatcaaagaagtaaaaaatttttaaatgagatactacactcaacaataaatcctataaatatttaaaaataataatagcaataataattccattattatactatccagtgttaggatacaggaaaatagcctctggtagaagtgtaaatgaatataacatttattgaaagaagcacttctttagagttttatatatcctttgattcagttaattcattctagaagttcatcctaaggaaataatcatggatgtttcagatacattaatttcactgtttacaatagcaaaaattggaaataacttaatcttccattgttatagtgtttgataaataaattacaataaaaccacaaaaatagtattgaagaatatttaatgatataaaaatgtttaaaggtgaaatgcaggtcaaaaaaagagtatgtacattatgattcctacatgcttacaaaaaaaagtatgtacattatgcttcctacatgtgtaaagataaacgctaggatttagttttgttgttgtaataaactttaaatttttctatattattcttgaaaaatatgaacaaaacaagttgtcatttcaagaacaagaaaatgattaattgtgccaaattaacgataaagacaaaatattccattggaatagacaatatagtggctatttgtgaaaacaatttctaagaagtagtaggggaaaaccagtattatagtaggctgagaagtaagtaggagtgagaaagtagagtgagactattatttttcaagacgtttacttaaaaattgaagaaaaaattaagtcatatattcattatggaaagtataatagtgcacatgattatttctttacatgtccatgtaccccattaaccatgagatcctcctcaaggacggagtccatatattttcacttttgcatctatatttagtgcttaccacaatgccaagcatacagaattgaggagcaagtggtaatcatctaagcaattatttttattctccaccatactttgctatacaattagagtcagctagttacaacaaccatcacatattgttagtgaagttactatgaggcacctgaaacccaggaaactaagactgttagatactagcaaacgagatgtccacatgtccacaaaaaatgttttattaaacctgattaaccaaattttatggccttaatactgttatatttatgagatctagccacaactttctacaacatactttcctattaaaggaaaggacaaaaaaattcacttttctctatgatcaagatgactaaatatttcacaagtcataaaaaacctaagagctcagttaaaattgtaactcacatcctcagcatttggaattgttgcagatacagctacaaatcgcattggaatagcagtgctggtattttttaaagtctgagaaacagactgtacagttttcattctgctaactacaacttcaagagttggaccacgattttcatcttttacaatatgtacctaagcaggaaatcaagaaaaaatcattagctatagaattaaaaatacatttaatcaattaaaatattcaataatattaacattcttgcttgagaaaatgagcattttccacttgaagggataaaacaaacatatagtttggttgcaatgtcttttttctttctgtcttattctaattatccttttatgtttatctctgaaagcgaatgcattcattacctcatcaatgagaaacagtcgaaccagctgaaccaaagagttgtctctccatttcctagtcatgctatcccatttttcctagagagaaaaaaaagcatacaagtagtttaatgtgataaggaattataataaatattaagatatcaaaaacatttttaacatgacgtattacaaataataggcaattttggttgatcccttaagagtattctgaaaaatattttaaaattaaaaaatacttaaagaatttttacagtcttaaaggtatttttaaaactgggccctcaattgtttttacactgaaccacaaaatattcaaagtccaagttttgttacctatttttaaattctaccaaggacctccctctataaaacatactacttaggtaaaagaaaaaagcaataaatatgattacaaagtatccacaataacaaactgcctattctttgtcaatttttccaatttggtcatttgtcttttacttactgatttgtaggtattctgtctgtaccttgaattgtagtatttttttaatgtttgtttgtttgcattgtaaatatatgtttctagtttatattttttaaactttttatctcagtaaagaaaaataggtattttctaacaaactaaagaaatcataaagtataaataatacctactggagttgtcataataatatgggcatgctgaatctcaaatagatcatccattactgtatctccagtaagttctttacaattcaatcctattggtccaaatttttctttccagtcatcaaaacgctgactgcacaaggcttttattggtgccactgtaacaatataaaatatttactttgaacatcagttcaattttaaaattcttttcacaaactttggttaataaagttagcataaaaaatacacatctacatactcctaatattgataaattaaaaatgaacaatataggcacattatttacagcaggggtgtccagtcttttggcttccctgggccacactggaagaagaactgtattgagccacacataaaatatgctaacactgacgatgactgataagctaaagaaaaaaaattctcataatgttttacaaacattacaaatttgtcgtaagtttacaaatttgtgctgggccgcattcaaagccatcctgggccacatgcagcctgcaggccacaagttagacaagcttgatttagagatatcaaggtaatagccaaaaagaactaaaaatagaaatagaaatgatttctcaggcaagtgtaactaaaagtggagaaaggtagggcagaagattattgcttttcactataaggcctttactgatatttgatttttaatccatatacatatattactttgattaaaaaaaattttttaaatacatacctaagaaaggagagtaaaagttcctatgcaaatttctagaattacaaaatatttgattttatttgttcattttgcctgtcctttaaaaaataagcatgtaaaagtcaaattctcaattcaaatattactttttatttataattttggaaaatgtgttttaaatttaatgacaaataagaccagactttactagaaatatatagaaaatcaagtaattcctgaggccagaaactgaatttatttcttcattttgcttcaatggtttttcattattataattagtcatcactcttataataaatacttactgtaaacaattttaatattcaaccatggcaatggtacttccattaacaatcttgttatagctagttcaaacactacagtttttccagaaccagttggagcacaaatcacaaaattcctatctgtgtaaagaagctaaaaaataaaaagtaatcaatcatgtaacatatagactttttcacacacattctcaatttgttaaaaaaaaagtcttagtaagaatctaaggaataatagttcaaacatttttcctctaaagttataaaaattgtaactttgctccagagcctccactctcgaaaaataacactattagtattttatcatgctgttttatttgtcaatgtagacctaggagaaaatcattcctggctgagtgcgatggcttacacctgtaatcccagcactttgggaagccaaggaaggcagatcacttgaggtcaggagttcgagaccagcctggccaacagagcaaaactctgtctccactacaaatagaaaacttagccaggagtggtgtctcaagcctgtaatcccagttacttgggtggctgaggcaggaaaatcgcttgaacctgggaagcagaagttgcagtgagctgagatttcaccactgcactcaaatacaaacaaatccacctatgaaaatcacatgtattcatttaccaaatattttctgagctcctaaatgtgctagacatggagtgtggcagtgcagacataaagatctagtaaatcccagctgtcccaatctagtgatcataacctagtgaaaggtagaaaaataaataagtaaaataaaatacttacatcatcaaaggccttggactgtatatagttgaaatatggaaattctttgaaaatacttctaaattttgccgcttacaataacattaaggagtcaaatatttcagaatttaaaaaattagttacttttattttaaaactaagttacattaatatagattctgacaatatttaatgatgaggttttaacatttgctatctggcatcttaggaaaagaattatcataaattattctagtctccagtcacactccatattctgaaaagaatttgcaaagttcttatagggaaataagagattatataagggttatacctgagtgctaaatatgatggaagagatgcaagtacataatggcaagtaaatcagaactacacttctagtttatcttttccagagtagtgctttttcttatttaccttgacaaggccacttgatttttatctcttctttaatgtacagaatttcactcaactatttcattaagcattgattgtacttcattagctgatgtgtttctggttacctaataccaaatctctttgtttttgataatttggttgtgttaagtggtgggtttaattataactatcaacatactggcttgacaggaagaacttaaatcatccttcccctgtaagaaagttcaaaaatattaacagatatgaagaataaactgtcccctctccaaggtgagggtctattgacagattgggagatatctgtatttacatggtattcttcttacaatatatcaactacagtcattgaacactatatacagaatacattactagatttagaaagctgtgggaagctataaataaagaagaaaatgagttcctacaattgagactgttataatctattagaagttataagatggttaagaacatatctgagaacacaagtacacagttacttaaacaactggatttttataaagatatacaagaactgatggattgctgtagtgatcctgtttaaacttacatcatattacttctctgatcaaattcctccctttctctcaaagtgtatggctataaggctccacatgatcgtctccccactgccactccctccccgcatcagcccctgcctttatctctctgacatcatgtcctactactctttctccctgactcatctcctctagctatactgaactctgctgttcttcaaaaacatcagctacgatcctgccatgaggccttccctctgcctagactgttattccttccatatttccttggctcttttccctccattaagtgcttaaatctgaccttctcaaggtctaccctaagtactgtttaattctacaccctgagccacaaatcccagcagtcccaatttaacccgcttaccctgctctacttttttcttttcccataatagtcaccactttctaaaaaactctgacttatttatatgttattatagttgttgagatctagcttcctccccaccctcatcccaagaatgtcatctcctcaaaagcaaggattcattgtctgttttcttaagtgacatatcccaaatacttagaacagtgcctgacacataactcagttaatataggtttgcaattattacatcaagcagttaatttataaatcctcattttactttctgatgtgcaaagtgtcatatctgtgccaaaacaaaaacgtaattttgagtttgaaaatccatcagctttagaaggaatctcaattttccttcaaaacatgtctctttctatcaaatatttatttgtaacaagcccacgagtgggccatcatgttggtttttctctcattagatagttccatatcattcacaaaatgaatctttgattcagagtatagaatcagtatttcagctcataagaaaactcaactgctaacatcatttatcatcactatcaacacttgaaatcaatttttttccttacattcaataaactctcagcagtgtcactgaaataatggggaaatgtctgcagaactgaaaatgacaagactactgtggtaggaccaatctgagaaaacgtctattgccctgaggattcaaatgcagtaaaatatttaaagagaataagaaaataaggtgtgtccaagtaatctacaaactctcaaattatcacaaatagcattcagtcttccactttaaaatacatacttggaaacaataaggtataggacaatgagttttacacaaaatgaactttttggacaataaatcagtggacacaagtgtaggcagtagtcctaactaataaagacccctaaacaacagaatcacttcagctgtgctaatatagcataaaaatcctcaaagctctttaaaagccagtgtcatattatggaaaggctttccagtaagggataagaagaatcagccatcgtacagataattaaacatctttaacagcttactgctaatatatttcctatgtttccatcctattttgatcaccacagaaaagaaaatgtggcagcattgagacactatgctgaataaagtgctaaacactggctatgtttatagttactatatcaacatgtataactctcttattgatccctctccctcatttttaatcaaatcagccatctgcattggaggcaacttttcatgagaagtcaggcaagtattttctaaccatacttcagaattatgtcagatgatccttcgagtgcccaggattagagttattgttgcctagatttctctagcacagctatgcaatatctggaattcatttttcattttgtcaactagaccataacttttgtggatgctagagcattgccaagcattgagtcactaattatatattcctaaagcatagtttaaatgatatttgaactgcttaaaaaatattgcatggtttctcctcattacagagattgcattttcactacaaaaaagaagtaactatgagaggcgatagatacattaattagcctgattgtggtaattatttttgcaatgtttacatattaaaaaatatcatgttgtactccttaaaaaatataccatttttatttgtcaattatacctcaacaaagctgggggaaaaaataaaaaataaaaataaaataaaaaaacctttgaccttggtattcatgacattatatgatatgattctaagataactatctaatatttcttattacttctttaatcatatctgtcactttagccaaactggaaagcttattctttccaaatgtatttcatacttttttacctccacccttgcttatgtctctacttttgccagaacaatttccttactttacctgccttactttatctgcctttcaatgtatttggaaataggcaggtaaataagtcatgatgtttgccttcaaagagttcatagatcatggggaaacagtcacataaactgctggtgaattaaaacaaaataagtgcactatcataggcatacacagggtattaaagaagcaaaaacaatgttacctccagaacacacaaacatactcaaaatatttacactggaaatgtccagacatgaaaattggattctaggtataaactccaaattagattttcaaaaatactagatctgtagaaatgtccccaatccacacaatatcccattctcatccatttcccctacccagttcaacccaatttggctgctctttctcaaaggatgagaaattatctgtacctatttgtaagtaaatatgctcagagttctgccaataatacaaatctgacttctgtacttaatttgccataaactgataacaaacaggtcacaaatcggcaccagtctgcaatcacaccctgagtagcactatcacacacatacatctttttttttttttttgagatggagtctcactcttttgccatgctagaatgcaatggcacaatctcagctcactgcaacctctgcctcccaggttcaagcgattctcctccctcagccccctgagtagctgggattacaggtgcacaccaccaggcccagctaattttttacatttttagtagagacaaggtttcaccatgttagtcaggctggtctcgaactcctgacctcgtgatctgcctgcctcagcctcccaaagtgctggaattacaggtgtgaaccaccgcacccggccacatgtacctcttacaacaccaaaaagattaatttttccctctttttctccatcaaccaaaataaacaaacacaattaaacaaatgttttaaaattatgatttaataaatacaaagcagctattgtaaataacttaaaggatacgaatttctgtgacagccttcaaggaacctaaaccattttctgttacctctgaaaaaaaaatgctacatatttatataaatatcaaaaaaaaattaatggtcagaagctaggacctgaaatgaatatttttaacctttccataaaaactgtttcaataaaactaacacaactttttattgagagcaaagttaaaaatatttttagcacacaggataaaatattttaacacacagcacagcttagaaaataatgcaatataataaaaaaatgcagaaattgcacagagagataatttactcaaatttactatatttttacattttcccccatgctaagaaatgtggtttagtctgtactcataaaatgaactgaaaaagcaagaaattaccttgaatatcatgaggttggaaagcaactgaaaaagatggtgctttgaacatgccttctccgatttcagaagcagaaaaagcattatttgctgtaaacacatttgcagaatactgaaatttttgcttactattgctatagttccttgatttccctttgttcatttctgtttgtacaattttcactgagccaatgtgagagtccaattcattgtcattagaataagcactcccatgtatattgtcagatattttaaataatctgcaaacaaaaaaaagacccacatattttctcacgtgtaacacttgcttggaatatgaaaaactagcataaaattggcccccttaaaaacactcatagattatggtttactcaaacaaaaaagctaaacattctcctaaaatataacttgctagtttaccactgaagtatgtctttctactttcctaaaactcagataaatccatttgtggcagtcatcctccaaaacagcccaatgatccttgcctgctcctcacccctttacagtctcctacaaattgaatcgctgaatcaggactggcctgtctaactagcagagtactgcagaagtgtaaatgtttgacttacaaggctaggtaataaaagacattgccccttccccatggtctcttagatctctcactctgtggagagctagtcacaatataaagaaagcactcaaacaaccctatgaagaggcccaggtggagaggtactgaggtctcctgccaacaaccagcactgacttttcagtcaaggacagcaagccaccttgaagagagacctgatagctcctgtcaagctttcagatgactgcagcatggctaacattttgattgtggccttcttgtgagaggcccccaatacctttacgcattctcacaagagagcctaagccagaactactagctaagttgttcctaaattcctagcctggagaaactgtgagagataataatgttcattgttgttttaaactactacattttgggataattttattatacaacaacagataactaatgttccatttaaagtcagtaaagtgcttaagagagagaaaaagccactaaatatagtcacagtaaatagtaaatttcataacacctaatagtatttaaatttaactgaagtgattcaagttactgaattatattaacatattcaatttataggaataagttaacagacttgttatgaattaaaagttgtcagcaactgcatttcacgccacagaagctaccagataagacagttttcctagccaatcaaatcagcattgtgtatccccccaaaaaggaaaagatataaactaagtatattagcagattaaatcatcccaaacactatatccaataaccatttcaatgtaagaactacttctctgcaaagttctaaaaacaaggaaacactttatgactgtactgtattatatttgatcaaaagacaatctatcgaagtaacttgttcacaatatccctaagggatgaagtaaccgttaaggttcctaataaaacattcacatcttatagaataagtaatggagatgacttatccattcaggggctgaagatcaagtttaattagcaatggccagtgatttcatcagtcttgtctatgaaatagaacctccagctcacgttccctattagtgggtgaacaatccaacgcttggtgaattctgcttcacaatgataggaagagccgacatcgaaggatcaaaaagcgacgtcgctatgaacgcttggccgccacaagccagttatccctgtggtaacttttctgacacctcctgcttaaaacccaaaaggtcagaaggatcgtgaggccccgctttcacggtctgtattcgtactgaaaatcaagatcaagcgagcttttgcccttctgctccacgggaggtttctgtcctccctgagctcgccttaggacacctgcgttaccgtttgacaggtgtacagccccagtcaaactccccacctggcactgtccccggaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagtgcaccagcatggcacatgtatacatatgtaactaacctgcacaatgtgcacatgtaccctaaaacttagagtataattaaaaaaaaaaaattaaaaaaaaaaaaaaaagatttttaaaacaaacaaacaaaaaaaagaaatagaacctccattaaaatgcctaaacaacagggttctgagagcttctggaatggtgaacacatcaaggtgctgacagagtgtcatgctcagagaagttatgggaactctgcaccccctccctcatattttgccatatgtatctctttcatttggagttgtaccctttataataagctggtaaatgtaagtaaagtgtttcccttaggtctctgagtcattctagcaaattattaaacctaagatggggtcatgggaagcctcaaatttgtagttggccagacagaaatgtgggtagcctgggaatctcattttcagctggaattcaaagtgaggtcagtcttacagaactgagccttcaacctgtggggtctgacgctaattccaggagttaagtttcaaattgatttaaattgttagatgccaagttggtgtcagagaatcagtcggtgtcagtcaacacccagtctttacatttatggtcagttgatttccaatgacagtgtcatgacattcagtagggaaagaacagtcttttcaacaaatgaggctggaacatctgaatatctacatgcaaaaagaatgagaatgaactcctacttcacacaaatatttaaaatatgaaataatagatcacaaatgtaaacataagagctaaaaactctgaaacccttagaagaaaacttaagagtaaatcttcatgaccttggattaggcaatagtttcttagatatgacaccaaaaccataagcaaccaaagtgacgccaaatcagtattacatcaaagcaaaagcataagcataaaagaaaaattagataaactggactctatcaaaatttaaaacttgcgctgcgaagaacaccatcaaaaaagtgaaaacccacagaatgggggaaatacttgcaaatcatacagatgataagagactgttattgggaataaagaactcttaaaactcaacaattaaaagacaaatagcccaattaaaatatggacaaaggatctgaataagacattactccaaagaagacatacgaatggctgataatcacatgaaaatattcttaacattattgctacagactggatattaatgtccctccctccagattcatatgttgaggccctaatccccagtgggtttttttgttgggttttttttttttttttttttttgagattgagtctggctctgtcacccaggctggagtctcgctctgtcacccaggctggagtgcagtggtgtgatctcggctcactgcaagctccgcctcccgggttcaagtgattctcctgcctcagcctcctgagtagctaggattacaggcgcatgccaccacatctggctaattttcgtatttttagtagagacagggttttaccatgttggtcagactggtctcgaactcctgaccttgtgatctgcccgcctcagcctcccaatgttatggtatttggaggtggggcctttggcaggtaattgggtttagatgaggtcatgagggtacctccccatgatggaattaatgcccttataaaaagaggatgaaacatgagctctctctgttcatacacacaccaaagaaaaaccatgggagaacataactaggaagagggtcgtcatcaagaacccaacaatgctggcactctgatttctgacttccagcctccagaatcgtgtaaacaaatgtttgttatttacaccacccaatctacagtatttcattataccagctcaaaataactaagacaattagtcattaagaaaatgagatacaccacaatgagatacctcttcacatacccagtaggatggctataataaaaaagacagaaaataacaagtactggacagaatgtggagaaactggaactctcaaatattgctgatgggactataaagtgacgcagccactttggaaaacaatttggcagttcctcagaaaagttaaatataaagttaccatatgacccagcaattctacttctgggtttatatccaaagaattgaaaacacacattcacacaaaaacttgcatgcattttcatagcaatattattcacaatagacaaaaagtgaaaacaacccaaacatccatcaactgataagtaaataaacaaaatgtgatatatccatttaatggattattatttggccattaaaacaaaatgaaatactggccaggcatggtagcttacgcctgtaatcccaatactgggaggccgaggcagacagatcacacagtcaggagatgaagaccatcctggtcaacatggtgaaattccgtctctactaaaaatacaaaaattagccgggtgtggtggcgcacgcctgtagttctagctactcgggaggctgaggcaggagaattgcctgaacctgggaggcagaggctgtagcgaaccaagatcacaccactgcactcaagcctgggtgacagagtaagactcccaaagaaaaaaaaaaaaagagagaaagaaaggaaggaaggaaggaaggagggaggcagggagggaaagaatgaaagactgatacataacacaacatgcatgaaccttaaaaatattaagtgcagccattcatgctaaaaactctcaataaactaggaattcatgggatatacctcaaaataataagagctatttatgacagacccacagccaatatcatactgaatgggcaaaaactggaagcattccctttgaaaactggcacaagacagggatgccctctctcaccactcctattcaacatagtgttggaagttctggccagggcaatcaggtaggagaaagaaataatgggtattcaattaggaaaagaggaagtcaaattgtccctgtttgcagaagacatgattgtatatttagaaaaccccattgtcccagcccaaaatctccttaagctgataagcaacttcagcaaagtctcaggatacaaaatcaacatgcaaaaatcacaagtattcctgtacaccaataacagacagagagccaaatcatgagtgaactcccattcacaattgctacaaagagaataaaatacctaggaatccaacttacaagggatgtgaaggacctcttcaaggagaactacaaaccactgctcaatgaaataaaagaggacacaaacaaatggaagaacattccatgctcatggataggaagaatcaatattgtgaaaatggccatactgcccaaggtaattgatagattcaatgccatccccatcaagctaccaatgactttcttcacagaattggaaaaaactactttaaagtccacagggaaccaaaacagagcccgcattgccaaggcaatcctaagcaaaaagaacaaagctggaggcatcacgctacctaacttcaaactatactacaaggctacagtaaccaaaacagcatgatactggtaccaaaacagagatatagaccaacagaaaagaacagagccctcagaaataatatcacacatctacaaccatctgatctttgacaaacctgacaaaaacaagaaatggggaaaggattccctatttaataaatggtgctgggaaaactggctagccatatgtagaaagctgaaactggattccttccttacaccttatacgaaaattaattcaagatggattaaagacttaaatgttagactaaaaccataaaaaccctagaagaaaacctaggcaataccactcaggacataggcatgggcaaggacttcatgactaaaacaccaaaagcaacggcaacaaaagccaaaataaacaaatgggatctaattacactaaagagcttctgcacagcaaagaaactaccatcagagtgaacaggcaaccaatgggagaaaacttttgcaatctacccatatgacagagggctaatatccagaatctacaaagaacttaaacaaatttacaagaaaaaaatcaaacaaccccattaaaaagttggcaaaggatatgaacagacgattctcaaaagaagacatttatgcagccaacagacacatgaaaaaatgctcatcatcactggccatcagagaaatgaaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagacaatatggcaattcctcaaggatctagaactagaaataccatttgacccagccatcccattactgggtatatacccaaaggattataaatcatgctactataaagacacgtgcacacgtatgtttattgcggcactattcgcaatagcaaagacttggaaccaaccaaatgtccatcaatgatagactggattaagaaaatgtggcacatatacatcatggaatactatgcagccataaaaaaggatgagttcatgtcctttgcagggacatggatgaatctggaaaccatcattctgagcaaactgtcgtaaggaaagaaaaccaaacaccacgtgttctcactcatagatgggaattgaacaatgagaacacttgcatacagggtggggaacatcacacaccggggcctgtcatggggttgggggtggggaagggatagcattagaagaaatacctaatgtaaatgacgagttaatgggtgcagcacaccaacatggcacatgtatacatatgtaacaaacctgcatgttgtgcacaggtactctataacttgaagtataatttaaaaagaaaagaaaaatattcacctccaaaaaaaaatgttacgttaagtgaaagaagccaggcacaaatagccatattttgtataattgcacttatatgaaatgtttagaatagataaatccatagagatgatagagacagaaagtagattagtggccaccaggtgctgtggaaagggagaaatgaagagtaactgttaattagtaaggaatttattttgcaggaggtgaaaatgttttaaaattagttaataatgatggttgcaaaagtatgcattataaaaaccaacgtgggtaaatacataagaatgaaaaaaataagaaaataaaataattctacactttaaaaaggtgaattttatggtatgtgaattatatcttaataaagctgttattacaaacattatagaaatcaacctcagctggaccctttacagtgtccatcagtcctaccattattctaattagactgctttcccattctccataatttattccattcttctcattcttgctcaatactctcactttctctctcaaactccacagataaccacatctcctatgtcacagaaaacaaaaacaatcaactaaacttcttctgaatcttgaatccacatacccaactgaatatctgaactatttataaatatctaaaatcaacatgtccatatctgtactcatcaccttcccccgaacctgttcttactttatagttctttaaatcaaaaaagggcactaccaaccttcatcattctggctcaaaccaaaaacctaggagtcagatctcatatccaataatcacttaagtcctgtgggattttatctcctaaataattctggattgtttccattcctgataccactgtcctaggtcaggctaccattttctcccatctagactaataagataacctttcaagtggaccttcatattttaactcccttctattataatttatcctccatactggggccaaaatgaactcttaaagaaaagaaagtctaatttcactcctctgttcaaacccaaggcattaggaaaatgggtctcaaacttttgtgtgcataataatcacctagaaaatttgttaaaaatgaagattcctgtgtcccacctggactgttgtggtaccatttatagtagatagttatatattacaattatggttatttttatgtgtaggaccaggactatgacaccaggaatggagaaagtaaggaattatttaggagatagaattttgctgtttttctcattcacattgtaccatatttaatacttttatatgtacaaatattcaactttattcacagaatattatttagtttaattataataattaccttttccggaatactgatgtgctctctcctttatcttctgcaaaattaactaattttgtatcatcaggaacactcttctcaggtgctatctcagtgccaatgtgatttttatatttctgagaagcatatgtcagcttgccagcaatatgtgataagtcattattacctaccccttctaaatttagatcatcctgttcatatttatcagaaggaaaggcaaactggaatttttgtgttagtgaaatataatttgtatcttcattagttatctttaaatttgatgttaacatttttggcctcttttcctgacctacaaaaaaggaatatcttaattattacatgttctccattaaaggaaattttcaaaatgatgatgaaaaactttaataaaaattccaagttaagtatgaaagccaaaagcaaagcactagtaataagctcatctgtaataccatatacggttttaaaatataggtgattgttacacttatggtatattacatcattaacagacactcagaaattaatgtggaagtattgaattaaatttgaagtttatatggcactgcattataaaatagatttaatttctttctgacccataacaaatgatataattatacaattatgaagatttaaaatttatataaatgatttacacacagaaatacaatgaccaattatataaaatgttaccaaacacaattcattattaacatatctaatgcttttaagtttgcaatcttgcttctaaaatcaaaataaaggaatgttttcatcagagtgacagaagtttaaaggtttctttagaggctttgcaagaatttttagggaagtttagggggaatttggacgtcttactagaacttaaatttgctttagcatctatgtatctacattatacactatgctatatattatttgatataagtatatatataacatatatgtaaattacaaagcttaataataaaatgaatgtgcatgaacctatgacccaatttaaaaattaaaattttactaatattacattaggtcacatacattgtttgagtgtgcttgtttttgagctttttaaaaatggtatcaccctatatttaatcttctgcatctagcttttttcactcaatatttctgggatctggttaccaggcgatcttacctttaggaaatggcaaggcaaaaactgaacagcagtgataggagtttaatagtcacagaaaaaatattcataaaacaaaaatcaaaacatgtagtagtgtattatgtgcatttatgtacacgtatgtatgtgtattatatgtatagagaagaaaaatattttaaattttaagatttggtgggcactattttgtttttgggggtatgtatgtatttagagatgaggaggatctgtttgtttgtttatatatttatttatttatttagagatagggtcccactatgttgcccaggctggagtgcagtggctattcacagactcccaagtagctgggactacaggtgtcaactgcatccagcttggtgagcactctttttaataaaagaaggatctgactttcattttatttcattaaaataaagaaattttaattgtttacataacgagtatacatattttgggggggtatctgatattttgatacatgcatatacaatgtgtaatgatcaaatcagagtttttaaaaaaatattgccatgaactgtatgggtttggcttcacaacaaatatgtgataatttgcctaacagtttattactttttttttttttttgagacagagtctccctctattgcccaggatagagtgcagtggtgcaatctcagctaactgcaacctctgcctcctgggttcaagccattctcctgcctcagcctcccgagtagctgggactacaggtgtacaccaccacgcctagctagtttttttgtatttttagtagagatggggtttcatcatattggccaggctgggtgatctgcccacctcggcctcccagactttctaattcttcctttaactcctgagtatctgaaatttctgaaatcaatacccaatatgagtatacatattttgggggcatatgcattattttgatacatgtatacacaacgtgtaacaatcaaatcagggttttttaaaaaaatattgccatgaactgtatgggtttggcttcaaaacaaatatgtgataatttacctaacagtttatgactttctaattcttcctctaactcctgagtatctggaatttctgaaatcaatggagcaggagggagaaaccaatccaatgacttttcattgtctggatggctatataaaatataaaaatgtgagtatatatgttaataaagatataacatgagaagctatgtgtttattaaacattactcaattggactcttaaacattctataaattaactttctgtcagcactttgatttatccctatacagcagtgttctcaaccttttacccttatatatcataggattaatgataccgctgtgtgagatatgctacctaaataatggcaataactctatctccttttctccaattcaaatgccagtaacaggaatcttaaatctgctccaatataaaaacaaagtagtaaatcattctcaaactttagcattttaactattacaagtaacaaattacttgacatatctcacaactaatcacgggtcatcaatgtgtaaacgataccattactggtattccagagctgggatccccaacccctgggccgcagactgatgctggcctgttaggaacccggctgcacagcaagaggtgagcagtgagcaagtgagcattactgcctgagctctgacttctgtcagatcagcaacgacattagattctcacaggagtgcgagccctatcatgaactgtacatgagagggctctaggttgcatgctccttatgagaatctaactaatgtctgatgatctgaggtggaacagtttcatcccgaaaccatctgtggaaaaactgtccacaaattcagtgtctggtgccaagaaggttggggaccgttgttctagagtattcctataacattattacaaattaatgtcctaaccgaaatattcttagtccaaaccatctacaaactacagaaaaatccaagaaatcatttgaaactgatgacctctttataacctatagtaattgatatttttgccaccctgttggcatcattaactacccctcctcatctttcaactgtgatcgtgttaactgatactgctttaatggttcctttcccatcaaagttgacttgttcttcattaggacaaaaagataagtgttaggtgacaggaaataaagttgagaagagcatcatatattttgtctataccaagtcccaaagattttatgatctagtcatttaggatgttacgctctctaaagtgagaaactcagtcttttacttttctgtctctccgagcacctagcacatagctactctgaccatattttccaagtaaaaaatctacaacacattatctggcaacgtctaacagactgtttaataacaagccagatcttttaaaatttaggactgtgtcagagggtccccaagatcacccccagttcaataatatcctaaaatgactcataagactcagcatgtagtcctactcacggctaccaggacgaagtccaaggaaaaccaggcatgagctttcaagagtcttctcccagcagactctgcgggaggcacttaattatctgagtaatgacttaggacaatacccatgaaatgttgccaaagaagggaagctcttcagggacccaatgcccaggtttttattgggggctaacattaacataagcatcccctgtctggcacacacctaaattccagaatctcagaaaaaaagcaggtgttcaacataaaccacactatttgtataaacagtttacacatagtaagccactgttgtcagttaatggaagggatcttcctgaaatctaagttctcagactctagccaaagccgccctcgcaaacaggccttttcaagaacagcagtttaggtctgctatattaactcttttctacacaaggactatttcagaaaacctaagaaagaggaataatagctgtactattctgcctcttaataaaatcaaatcttccttataatttcccaatttttttccagaggtgacatcatcatcccagtcacccagaatccaaaccatagtatcttttttactaactatatctagatacatattaggtcttactgtatattccttgtaatgcttcttaaatttatcatttcctttgtgtttccacggtcattatcataatcaaggctcttactaacttgttttaactgccctcactgcctccaggctttctctctattttacaagttcctaccacattcatttggaattgttttcattacattactccattcaaaattcttcaatggctttcaaagattgccaaacttcctagtggccttagaccaccttatagttttaactctcctacacataccttacagtccaaactaaactgaactccctgttgtataacaaatagataatgcattgtctctcctcatctttttttttttttccctcctgagacaagagtctcactctgccacccaggttggagtgcagtggccagatctcagatcaccacaacctccacctcctgggttcaagtgattctcatgcctcagcctccccagtagctgggattacaggcatataccaccatgtctggctaatttttgtatttttagtagagatggcgtttcaccatgttggccaggctagtctcaaactccgggactcaagtgattcgcccacctcaacctcccaaagtgctgggattacaggtgtgagccaccgtgcctcgtcactcctcaccctcattcaaagatatttactcagcttgcccctgtgccctgccccactccgatatctacatgcagaagttctactattttattcattcattaatccattcagtaattacttactgagtactatgtgccaggtattgttctaggcactagagcttatattcaaaggctggctcaaatcctaccttttccaagaaatctccctaggttcccaaagattttctcctcccttcttcttatagagggaacctataatatgtattatagtctgccttgagctgtgtgaatgtacagatagataatagagagaaacagataagcaaatggatagctttgacagatagatatttgatactccctctagattatacctacagttttatttttacgtccatttacatcagcagtacttagcaaagtcctttacataatttcaataaataattgttgatttaattcaatggcttttaacccacagtgaattatatccaaaatccttattccagcattcaacgcacatcaccatctaacctcaacttagaatttctaactttatgtcccaaagttcctccttcatgaattgtctattccaggaaacttctctacatgttatcccttaaaagtaccatgaatgtcctatctccattctttttctcttgctctaacactctgccttcaaatgcccacttcttctctttctataggaattatcaaatccttcaaagcctcctgaagtctccccctactacccaaaaagcctgacctgactgtgtactccaagacgaccttccttccaagtctgaaatttcattgcatgaacatatgcttgtcatttgctttgcacatatttttgaccatattttcagaaaaacaaccgtatattacaaaatttgcattggccagacctgattaacacatgttgccccagttggatgtgctctttcactctcaaaagtgtcacagtatagatgattatttacatggtcctattacttattaatgtctttccatttgtgtgtttaatctcttcaactagattttaagtactttgtaagtaaaagtctgtttcatcctttttataaccctttcaactttcaatcaatatttgaatgaacaagtaaaataatgaggcaattaatacacctcattaaaataggataatacaatacactaaaaatacacagaaaattcaaaattgaacaatgcacatgaaaatccataaaagccagtatttaacatactacctactctctagtcttgttttctttggtctcacatctttattcccgcccctacttcctgccagcatttaatgtgcctatcatactttgcctttggcatactgtccattctgtttccagatggtgacgtcattccttgtcctgagctactctttgagcattatttcccatctttagcttggccaaaaataatctgaacaaaccagaaatacaaataaatgcaagccaaataggcaagaatcttttttttttttttttcttttgatagagtttcactctgttgctctggctggagtgcagtggcgccaccttagctcactgcaacctccgcctccgggcttcaagcaattctcatgcctcagcctcccaagtagctgggattagaggcatgcgccaccaggcctggctaatttttttgtgcttttagtagagacagggtttcaccatgttggctaggctggtcttgaactcctgatttcaggtgattcacccgcctcagccttccaaagtgctgggattacaggcgtgagccactgcgcctggcccaaatctattctatttttaaaattataacatttaagatgttaaacttcagttactcccctatactactggtaagagaattccatgtttaccaaatatgtaactgaaatatcgttctgttgattcctcatttttatttgtatatttaccagagagaaagctaaaactcacccaaattcaaaaaaccctaaagtaatatactatgctatcaatctttaagggagacttacttttcaacttcatctggtttttcaaaaaacaaattttccaaagaaaacaggcaatcatttgatttcagcattgttgaaaactggactttgtcataaatctacaaaatatggaaaaagtagtttatattttatttataaagatgtaaaaaaatatttctgtataatcactaattttccacagtctcctgtaaaatataaccacagactatccttccagcttcatcgtctgcaacttccttcaaagcacctcaatattcacatacattattctctgttttccattcattcatggattcacacttgctcccttctcttcatagtgctccaatgcttggaatgtgttttctgccattctccaactggcaaattcctaaccatccttcaagttataggtcaaatgtcatttcttcttcaaaggcttttctgaatttgtcttcttcctcaaggcagaattaatcagtcttcttgggctcttaatactttgttcacaccattattttcaagttaggacagcacattttattgtgaatgtgtgcacctctaacaatatactatgtacatatgcagggatttgcttcaaaataaaggggagagatgaaggagtattgaaataatattgacaatgagttgatcaaagctaaagctatgtaataggtacatggggttcattataatattttttcataggtttgaactttttcaaaataaaaaaattacaagtttaacatacatatgcatatttatttatatgagttaatgcatatactacacacgtttacattcttttttaaaagataatttttgcactcagagatattatctaaacataaaggataaaaacattcagcattggccacctttgaacataacaaaaatctggggctgaacaaagatgcaaatgtgattaaaaaaaaaaactagtctctagatacatacattgctcccattagaattatttttccctgcatatcctatttttttctaaattcttaaacatcatagaacattctatatgacaaaccataaaatcagacgaacaaactgtaaaacataaatcacatttctgtttcttctgttttagttaatacattgtaaatttgtcctcaagatagaaactacaatcaaagaaattctattaatgccatctagtggagaaatacgcattaccaagtcagattatgtctctccaattttgaatcctccttgatgtggggatgagatacaagtgggagtgatatggggaagggagaatgtttccacatacaacacttgacaaatgctactgtatgagaactaaacctgtatatatacttcagggctgttcttactgatatagaatattgtggggtttttcactgttttcgttattgggttcttcccccttccatctgtttaatataattgccctcttcatttttctctatctattaatcagttaccaacaaaaacaagtagtaaaaatgaaacaaactagtgtggttctataaatgtctaaaacaatttgactatacgaaaaatagaagcctaggataatagggcaggaggtagagggagtcattcagaaatatgcgaagtctttaacagctttaagtaaacaatttcagaacttgaaaacaattatctgaaaaagtataaatgaaaatgttaatcatgtttttatattgcccaaaaagtaacaaataaaatgttccctttctagttttaggaaaactatgttcaaacaaaagaaacttttcctaaaataaacctcaccagaccagtttcatatggctttgctacctcagaatttaagtcaaaaatcttaaggctaacatttatacacttgaatactttcttcctaaagcaactacaaatagacaacaaaactacaaatttaaaacatttgggaagaaaagcgttgcataaactgacaaaaacctcctatacaaacagcaaatattttcaaaagaatttttgatttctagttctagcatacaagaatataacttgtttgggttcagaataaaaatatcatgtacatattttagttcttatatactcctgtgaaaaaacaccccttatctaaaactgcatcctctcattccgcattatttttcttcatagcatgaactgataactaacattatagtatatgcttagttgtttattatgtttctccctttagagcaagcagggactttttgctcattaatgtgttccaataacccagaatagtgcctggcacacagtaaatggtccataagaatgcattgtggaataaatgcattagcaagaaccagtttataaaaatagtgtcaaataaaaataattttctgttaatttagaaacttaaaatttgagccccaatcttcaacgttcagttaaaaaatgtgaaatttttttctagttcaggatttatgtaaataaaatcatgaaggttctaaaagatgatgaatttggcactttcattatgtaaatctttttttaaaaaagaaacacaggtcctaaaagggaccttgctacagttcagtatgagtttgtgatgtgaggggatgctattttaaattaattaaagttctaggtttagattcagattttttaagttcctattatttattattaaagttttagtttcagcacgtggcacaaaattagattgccaaacacaataaacaatatcatcccaggtagttttaagtgtctgctctgctataatcactgttaaaatacttaagctatttttgagtctacataatttgcggtgccgaccttctctagttatattaatgacaatctctagttaaatattaatacaactagatacaattaatctttagttatattaatgacaattcaccattttgtcttctgtaatctttacttattgtataaaattattgtatacaattattgtataaacttattgtataaaattgcaggcctattacttcttacaatttttactcagaaacatactccttattttaaaagtacagaaactcagataaaaattattgatttgctagaaatttttgtgagttaaggaagaagtagggaccaacatttacgggaataaccgaccgtcacaaataactgcagagaatctgacaaagaaggaaaaatcaacgggaacaaattactccgaggctcggcctgggaaaggaccatacaattgtcggagccccagatctcaccccctctccccaggcaccaacagggctggctggaagggtccggctggggaccgaatcagcacctaaagcaaaataacagctctgtggatttcctaaggagaatatcctaaatccaaggcagaggccttagggccccgagagtggcacaagaacggggcgctggggcgcgtcactccaccccccgggtcccgtttcctcccaccgctgtgaaacccgcggctcagacagatgggtacgtcccccccagcgctcgctcagggggcgccacacaccggaacacaagacacaggaaccgaacaccaatcagccgactttaggggcgggccggacgcccagccggtcccacctcgcggggagctgggcccgccctgcgcccgagcgcgccgcaggcctcaccgctttctgactggaaatgcggctgaggcgctggcgcgggccggcggcctggagacgcctggtgaccaacaactcgccgcgcccgtccgctgcctgcccggcagacggctctagagatcgaccgctgcccggacggctcggctgggtccccacttccccgcgggcgtcgggcccccgtccccaccttccccgcgggcgtccgggcccctctcctcacctccctgcggacagctcctaggccagtcgagcgccgatttatcagcccctctgaggaccgccaagcctggct

SEQ ID NO: 1213 - DNA, 9750 bp, Homo sapiens
ctacctattaattacaataatgtttatatatctttgatcattttttaaagttctttgaacatgttagcaaactttatacttcctatcttttaattaaattttctttaaataactaagcattgaaaactttacaaaccatcagttatcttaaaatggttgagattttttttccttttttcccataaagagtctacaccagggtgggtcttttagacacccctattttctaagggcatgtaatcgattctcaaatcaactttttccaaatacaaattcctgtatgaacagggccagtctatggtaaattaatttagatgatggtgttagttttccaaacgtctttaataagtaaataaaggagcaatgtaaaatgttgcagtttgcttggtaaatcttaattgcgaaatttcttcttctttcggaacttttttcctgctgcatttgctgctttttcagccatgatctctgagtacttccttcggttgtatctgaaaaagaaaaatcagaactttatgtttgatatatcagacattagaagttaatataaccttagggtaaaagttgggaatggagtggtggacaagacaagtatagtctctgacctcatagcacttgcttgcaatctagggagaaaaaatggcaactgtagtaggaagactttcctactatatgcactatatccatctatctatccatatatccatatatgatctatatatgcactatatccatccaccaggctgtatcaaatgctttaaacatttttgagggataaaaacacaaaaatcaggactaagcaaaacaaaaagtcacacttatcctgaaaatgcacagtatgatatatatatttcttagaagcgaccaatggttttcaaagtgtggtctgtggagtagaccctttcaagggattcattaggtaaaaactattttctcaagaatactaaggcattaatcgcttttttcaccctcgttctctcatgagtgtagtgttttccaggggctacgtgatgtatgttatctgcagaagcaggtatgagcctctgtctttagttaagccagacattaaagagatttgcactaaattatttttcataaaaatatatattcatgttaatatgttatgggttattataaatgagttatttttaaattatttgaaaatttataagtttatacatttttaaagcaaagtatacatattataaaataaatatgaattcctttaccttctgaattcagaatcagccagcagttcttccacaatagttcttttcctttgcttcttgggaattcgtgaatggtagaaatcagctggattgtcaacaatggttccaatctgtgaacaattgattgaaataagtcatgcattgagtgccaagatgctttcatacttcagtgtagctctaattatatttagagaaaggaatggaaagaacaagcttacattacactaatagtaatgtaaattttgccatttatttaaagcaaaaaaaaaaaagtagcatagtggtgctattatgtttcttcagtagtttatagtagatccaaaatttctttgctaaacactaaattcatgatgcacagtgtaactaaaggagaaaagtggaacagataatatatactttttgttctagtttcccaaatcaatgaattagacacataaattctactacatacctatttggtttcctaggtcatcacaaaggctgccagtttggcctacttagtgatcattctgtatttgttcatacactcaactgaataaaatttacagtgatcactatgcaccaggcactgtgttacatgttagggaaacaaagaacatctggttcctgcagtgcagagcctgcagtcttaaggaagctccacaaaaagtaactaaaatattaaagcataacatgtgctgaacaaaacactatagacgctctgaagacaaagtgaccaattgtacctaagagaggtaaggaagatttaacaaagaatgacaatttagcttgaatttgtatgggtaaaatttcaccaaacaaacaagaactatggatatgcaaagtcaaattatgcagggactggtatgtacgtgttctgacaagactgagtagctaagtgtgttggaatttgttgggctatatgatgaaaggcaggtgaactagtttgggtatggattattaatggctaaatgaaaggatacagacccaatcctatgtcataattcatcactgaatgtttctgagcagaggtgtaacacgaacagatgaaaacattttaaaaaccaacttggattagtacacgtgatacccttttacccctatcccgtatggactcttgctgttaggctgatactattcatacattcacatagtgaactttataggttcaacaggttttagctgacctggaaaccatttgtaacaccatctctctaaatgtgatcaaattaaaagttagtggctgaattgggtaatggccattcttatatggcctatgcagatatgttccatacattaggcatgcacaatggaaatatcctctattttaggagtaaactttaaagaacactacagtgctttccaaactaaaattcacagatcatcaccactattctgtttgcttcatacctggaagtacttggggaagccatctctatcatttttcttgtaaaatcttttcgggtccatgctggctctcatcttcagtgctttgagatcatttttcagttcatttgtcatttctggagctttcataccaaaccagccatcccctgctgttttttgtcgttctttctgaaattatgatttcaaaaataaacattctaacagctaagagtatacattataattcatttcccctgaagtaacacatacagaaaattttgtaaattaaaaacaaatggttactttattgaaagcacttaaatccagaatcatagagataaaaggaattaaatcacaaaaagtgacttctccgctaaattagggacaggattatcagtttcataaatgagggctccgtaaaatctattttctgtctcagagagtaactgctgacttgctgggagaataacacacaacttcaatttttattgtctaaaacagactatatgcagtaagaaaatgtataaaaacactttcgtttctagagcttatatgtaaacatttttattcagtcacccaggagtctcagaatgccactcatacaaggatccagaaccttgtgttatttctacaataaaacaaaatactattctttagaaaactcctacaagttatttaattttgtttcattcatacaacaagtatttagttagtgcctaccatgtgccagggtgctccatattacagtaacattactagaataccatcctcaactttccttcaagctctctggataactagtcgaaatggcagatagaagtaatctatatatatatatatttttttaaaaaacctctacttatagatgcactattgtggctgcaaagatgtgaaaatctatacataatgtgtttatggtactatattttacagcccttagaaatctgtaattattttctttggactcatatatagaccaacagatacagtttaattgtgcagttatgttgtataagctgaaaatatatagccaaacatatctaagcattttaattaagtcactgtacttactctgcgttttttctgaagttgatactttgattcactatatggtggaacacagtggtttttttcaaaatcaggtgtaatgacggctttctgcagaagctataaaaacataaaattggttttaaaataatgtcagaatgttatataagtttttcaacagtttaaacttctgtaagttttaaaatttttagtcagcctggcaaagtggctcacacctataatcctagtgctttgaggaggccaagggaggaggatcacttgaggccaggagttttagaccaccttggtcaacatagcaagaccctgactgtaaaaaaaaaaaaaaaaagaaaagaaattagttgggcatggtggcacacacctgtagtcccagctactcaggacgctaaggcagaaggatcacttgaggccaggagcttgaggctgcagcaagctatgactgtgccactcactccagcctgggtgacagagtgagaccctgtctccccccaaacccagctccctcccaaaaaaaaaaagaaaaaagaaaaaaaaggccaggcacgatggctcatgcctataatcccaactctttaggaggccaaggcaggacaatcacttgaggccaggagttcaagactagcctgggtaacataagaaaacgccatttctccaaaataaataaataaatttgtgcagtcaaatctgtttatcttttcctaaatgatttctgtacttttgttacttgactaggatgattatattctcctaaaactctgtgtgactaaaggaacctcaggttaattagtatttttctcagtacaagaaccaagtaagactgctctgtagccctcaaaatagtttacaggaatatagtacaagcattaatttgggactgacatttgaaatgatcaactcagaaattaacagtcaggcacacaattcaggttcaggcctagatgtttctgtgtggtataggtagccgtctaggctttcctatcactcataaaagggggcatgatatttacttaacaaatgattaagagtttgctgtgagtcaagtactgtagtacattcaaggacagtggttctcaactgggagcatctggcaatgtctggagacatttttggtggtggtgaggataaggaagaatgctactgacatctagtgggcaaaagatagggatgctgttaaacatcctactatgcacggaacatctcacaacaaaattatgcagcccaaaacatcagtagtgctgagactgaaaaaccctgttttaggaatataaagaaaagatggtaagttaatatatcacatgatcaacaatgaatcagatctatgctagatgttatggaaacagaggggttgtgagaaggactggaggtaaaatattccccaagggcaacgatcaattattttgcacttgcttggggaaaagcagggtaagttcaggcaactacagtagtcttcagtggcaagaatagagcagatgacagctgggtggggtagagaggtactttgaaggattcaagagaatactgtcacatctgtgtgtgtggtgtgttttttggggcagggaggagagatgtggtctagctatgttgcccaggttggtctcaaactcctgggcttaaacaattctcctgcctcagcctcccaaagtgctgggattatagatgtgagctaccttgcccagccggatttgtgtttttagacagagaaatctagaagtgtggaggatggcttgaagaacaagatgaaaacaagatcaataaggaagccactggagtagtccagatgagaagcaaaggcctgcactagctggtgacagtcgcttgaaaaggaggaagcagagaaatatcttcccctagaggcttggtgactgactacaaaaggaaaagagagtttggtttcattagccagaaaaaagaatacaagaagaggattcctggttcaggcagggaaaggggaattagtgacgtcaagtacctgaggacatctaaatgaacaaataggtacttggatttaaaggtctgaaagtgacagtgagaagcatcaaggctagaaaatatagatttaggagaaaacagtgcaaggtgttggctaaagctaagggtttgggtaaagttaccttaacagtaattccttctgaaattatatgtaaaatgtctatatgcacatgtgcatttttttccgggtggaagaggcaggcaggcattcacagctttcagattctcaacagtctacactagttaagaacttaagaactaaaagtatagcaagaaaagggaaaaaaacaaaacccctgggatcataattggtgggtgtaagatgaggaacactgaccctgtattgatttatttttaaagcattatcattcatagataggattttattgtaaaaagaaatgactgttttagagagaaggaaaaaactaacacattaggccaatgtggtttcactgtaggaaaattaagtcttttaccaaggactaatttctaaaagtgattggttagttctgtgaaaacctaacagcacaattaacttacctcatttttctttttctccttgatctgtgttagggttctcttgttagactgtagtttatctgcattaaaattaatatacaaaccacccaactgcttgatactcagaccagggtctatgctgctgcttgtcaacttcagactgaaaaagaaatcatcacttaaagatcaagtaattaaatcaaaatggaaacatataagatggcattttaaaaaatcacttattcttctcttcccttgtattgtccacaataaagaaaaaaaagcatcttatttttatgaggaattcctgaaaaaaaactctaaataaatatatttttcatcattttattttattttttgagacagggtctcactgttggcccaggatggagtgcagtagtgaccactgcagccttgaactcttgggactcaagtgatcctcctacctcaacctccctgggtggctgggactacaggtgcacacccaacacctggctccataatgtcaaatgaatgagccattccatgaagaacccaaggcagtgattttctcattccccaggctaacatttcatatttttatggtaaattaaccacttgaaatacatgtatcaaaaacttataaaaataaaggaaaaacttacagtttagcctttgtgctatttaggaagtcttcttcatcactaaactcatcttcattttcgtcatggtctgatgaatcttcttcacttttttcatcctcttcctcttctttttcttcctcaatggcaacctcacttgccttgtcttcctcttccaagtaaaaatttttatcagcactcattccaggagttgtgtcaattacaaacaatgcattgtcacatgacagacttcctgtgtctccacttaatgactccctttggccactattttcaacaaaacataaagtatcctcttcattctcactgttttcagactgttggctttcatcactgctgagaactagtaagacagaattatctttaccctgagatgtgttgggcgcagacgtgtatagtttggtatcacattcaaaatctacattcccttcactgttcatgtcttcactgacacttataactgtggactcttcttcatcatcactaccaccacaatcaccaaactttgtcaagtcacttgcttttatggggctctttttgttgttattccatctgcctacttccacagttgcaaatgtttgagttaatgatttcattacagcctcagagttcagattagagtgcactgatacagcatttttattttggggggttgaatgtctctgagaaactaactgttgaaggctagtgtcctgaagttcagaaagattcttcagctgagaacttttctcattaatttctttcccctcatctgttattccattggcatcttcatccaaatccttacaattctgttttgtttctttaagagattcaacattggcctgttcgtgcactgttaatatattttctgaacttctgtgggagaaatcatcatcaaagtcattattatagaaatttggcttatttatctcagaaagagatcttgcttgtaaatgggaagtttgtctggtatctgaatcctctgaattcacaggtgtacccacgatctgtttctcatttcctggtacaatcttactatctttcttttcagtttgtgcctttaatttcctctgcatactcctggttcttctagttgcaattccagagaatgaaatgtctgagcttgatgtctcagcatcagatatagcttctgtatgagattcttggcttggatctgtcagagatttagccttacttcttctggctcctgtagttttttctgtaggaagcacaattctagaaatacctgaaacatgagattctgcttcagacactatttcttcagtgtaagactcctttgttggagttactttcggctttttcctaacactggacactggggagcatgcaattaagatctgccttctcctagttacccttaaaatggtatcatggtgctcagacacagaataatttgactctgcctcagaggtttctccatccgtagatggttcagtcccctttggtagtgagcctgtagttctgctcttcctctttctagctttaggagttctagggattaaactttgcttcccagtggtctgtgattcagcagtagttcgggcatcagatccagtactactttctggatgcgcttgaatcccattagcagcaaaactctgcaaaccagagaaaacacactgtaatttaggtagggctggaacaagggcaaagcaaatgaaatactgaccccaaaagctaaaacccagtaaacaagattacctttaaaacaaaaaacaaaaaaacctgcccaactcatgatttttaaaaaatcaaaatttggccgggcgcggtggcttacggctgtaatcccagcactctgggaggccgaggcaggtggatcacgaggtcaggagttcgagacagcttggccaacatagtgaaaccccatctctactcaaagtaaaaaaattagcggggcgtgttggtgcgcacctgtaatcccaactactcaggagcctgaggcagaagaattgttggaatccgggaggcagaagttgcagtgagccgaggctgcgccactgcactctagcctgggcgacagagcaagactccgaatcaaaaacaaacaaacaaaaaaatcaaaatttaaacactggagccaaccctgcatttacttcactagcctcatccttcctagatgtaacttcagaagcagaacgattaaaatttttctgtttaaagtcaaatataatgggtagaccaacattctgacccacctatagaagaggggagaaagggaatattaactctgaacaccgatgtgtttaggaacacactgatggaatcagtcgccgcccttacctttacgtacaggaaaaaatcgccgccgctccgttccctgcatcgctgagtcagaatgagacagccgactaacgccactaagagtcaccaggcgacgacaccacagccctcctcacgccttaaggaggtgatgctggacagctgccagcctccccacgtgaaaacgaagctttttttccagcccccctaaatggggcttgtgcatggtggccgaaattaaccctccttggtaccgtgttaacagtaaggtttaaaagttcgaactgtgcttctgcattaaggagttgaacgacccaaataaagttatctaacctctcttccatactaaaaattgccttaagagacagtggtgaaggctaaacagtttccgtgacaggcttagcacggggcctgggagacccaagcgcgcggcaagctcgggtcctctctgtcggcaggtcctcacccttaaccggacccttgcgccgccccgcctgcctgagcgcggctctgcgaagcggcgagaagtagggaagactggatttcctaccttttgcccggaactttcagccgacgcggcttggatgctggccttagcccgtgcagatctggtaaccaccatctttccggctccctcgcgaccaccacgacttccctcttccctggcgctccggaaatgc

SEQ ID NO: 1214 - DNA, 54144 bp, Homo sapiens
tgaccacgcatggagaattttaccacccagagacacgcgagtggccctgtgcaagtttcaactgcgcggggggcggggaattccgcagacaggattctagaatttatgtcttgtgtggtaacatttcagccggtgggtggcggggattaggcgtgaagcggttcagcaggcagaggttctcggacgccctccggcgaagccacctgttgatgcttttgactttctgtccttgttcctcgtcccatctggagcatttccaattctggttttgcggagcagcaggtctgagcttgtccggcgagggtgggagttggtcccggcggagatccagtgggaagagccggcggctgcccgggcgtgagtagaccgagaatcctgcccgatccccgcccctgggctggtgtcgccctgggctcctgggacgtcggggcactgtcccccgatactggcagaaaaggattgagtcctcgcttttggccctaggtctccttgagcctccagaggactcacaacactccggggcatgttgctctttcaaataccaggaatggactctggggaatggggcacccttgaagtctgattatttcttccctgtagagccccaggggctaattaaactcgtgtttatggactccaatgcctccttgcctttaattcagtataatcctaccaacatttattgagcttctctgggccaggcagagttctgggtgccgaggacatagaaatggatctaaacttggttcttgtccccataacctcacaatgtggttgaggaagactcagcagttacctacacaggtaacttcgagtcaaggcagtttagacaagatccactgacagcctgactggaggaagcctgtgggccatggtggggcagttatgacaccatgggttctttttgtttatttgtttgtttgttttgtcttttcttttagtatgcccaggtaacttgcagaacccggtcgttctttcttactatagatcagtgaggtgaaaagcactatcattattggaatgccctgtctctcccttatactctcttcctgtcatctcccctcagaagacttgacaccccaccctggtgccctttctctgtactttcatatgctcagcggctgtctttgcacttgcttcaggattgtacctaacattctgtactgtaatgcattttcttcagacactcttcagtcaagttgtattataattatgagttaaaatacatgcaaagtaaatagagaaaacctccaggggttcattccgtagagataaccaaaggtttcagtttaatgttttttttttttttttcacacatgtgcgctctcaaatacagtcttttacatatttttaaaaataaacactcaatttttttggtttattttctagtttgcaagatatttcattttttaaaattgtgtttatttacaacctgcttttttctaaaaaagattcaaggtggggccttcttttcttttctttttttttttttttttttgagatgaggtcttgcttgttgcccaggctggagtgcagtggtgatcatatctcacttcagcctctaactctaggctcaagcagtcatctcacatcagcctctggagtagctggaactacaggtgtgtgccaccacacccagctacatttttttttttttttgagacagagtctcactctgtcacccaggctggagtgcagtggtgctatctctgctcactgcagcctctgcctcctgggttcaagtgattctcctgtgaaaattgcttccttttctacacttgttctgtatttatgttcctctgatggtctccacttctagccactttctttttttggcgatttaagtttttggcccaaatagataaacatcttctacattatttttctcttattctcgatactgggttgccatctttggtgatttagtacttattatgaaagagagaagctacaccacttgataccactttcatctgcatactcatgataatttgtatcttctgcagtgaactcttaagttgaagaaatgaataatttatatgtatatttgtatacttttaaaaatgtaattgaaaaatcctctcatagttacttaactccaaggtttaaaaatgcttcccagggtaatgagtttctttagtcatgtgactttagaaatgggaaccaaagcttccttatctacttgtgaaattcttgagttttttccttgaacttcctttttatcttccctttggcttatatatctgtgttttttgtttgtttttacttgcagctttcaaaagtagttttcaaagtcaatgagattgtttaaaagagtaggtacctgacagtctcttgcttgaatactatctagtgagtgaaccaaattccctgcaacaataaccacaactttgaatcaagagttaaatgaaaaaagtaactccttcagcatttactgagcacctgctggggctgaggaatgggggcatgtagatctccctctgctgtctggagctccctttctggttggaaaacatagaagcagcgcaaaagtttcacccaaaaccttggccatggtatgctattgaaaccccatagttcagattttatacttgagttcttttctaagccatggctggattatgttaatctggcaaataattataaagctggattattttaatctggtaagtaattataaggttgtgctccgtgatgtagctattaataaaatatgtggtagcacagacaagttgtatatagcacaaagctatacccccagaggagacactatatcagttgctgtctgcctaggctttctgtaaacgtgctggctatcattcagcctaaatgtagaatgagtctatccctttaacctgggccatcaccaggaatgtaaaggaacctagaacgaggacccaggcaagagatgagaaactaggggacagatgagtaggtaccagggatggtgatgagactgaagcaagtggggaatttttattttcttctctacttttctctattttccagattttcttagagcaaaaagcaggtagtgctttttacagaaaatgaatgctatataaaagtaattttaagaactttatatatccctagtgttatgtacaatttctgactttgaatagagatatctcccaaagggccaagtttggccctttagttacaatggagaatctgttgtgtaaactgagcaaatacacctgccaagttgaaatttaatttaagccaatcttgtctagatgaacttaagagaacgtctcctaaatattttattgcagtagtgtagcatgattgatagtatgctattctcttgaatagatggggttgtttcttgagccactttttattcctttgatcaaaaccttgaggagaaggaatgcctgttttcctgactgctgttgcatgaagttagacatccagttcctctaaaggtgacatcagatggtttagatacctaaaaagaagtgaggctaagccataggtcttcttcgtactacctgaagttgagacctggtctctgaactcagttattgctgaagcattaaaatcttacatcttgcttaaactcaggcagcttgacctgttctcatttttctctatcaaataaattgaagcctggtaataaattgatgatgagttccaaacatccccttggttggagacattgtattctccccactcacaatgaggtcctgccagtttccagaaaattttgcatgggggcttacccatccttttagaatcacattgcaagtcactctaaagcattagcattgttatctcatgtagctgcaaaagcttcctttcacaagctcttctggatccaacaaccagattccaagtatggtatcttaactacaccaccagctccatcttgcttcattgtatgttatgaagggatgagtaagcgttacacatgggctgcaatggtccaatgatgaccagtctgttcaagacccaagagggctgagattggcagccctggccattgtttaccacagcctaatgaagatgagtaaaagcctatctatccccaaggacctccacatatgacagtactcaactgagtctcacataggatagaataagataaaatgctggaagagaacacaaatagtgctacaaagcaggaagagagacttgatttggggatcaagacaagcttatagaagagacatcttgagagagaagatataatttcaggtacagactgagaggagggaaggggctttccaaatggaggcaaatgcttgagtgaagttgctgggacagaaaaatactgtccagggaacattgagatatttttggttcggagttagattatgggttgggctgaagtggggatgatactcttagtgcttgagctatgtatcagaagtttgtctatagtattatgcacaatttctgattttgaacagagctatctcctgcaggaccactcttggcccgttagttacagtgggcaatccgttgtgtaagctgagcaagtatacctgccaaagtgaaaatttaaatttagttaagggcactacatcaactgatttagctcccttgctcctggtgactttgcccatgtttctatatccaattagatgatgatttatgatcttttgatttagatgctttctcatttctgattcattctcattttctgcagcctacacataagtgttaggaaccaaggaagttattggcgataatgtctggttggaatttgtgggagcttccttgagagtcatgaaaagtctgttcttagtctgttttgtgctgctataacaaaatacccacaaccaggtaatttataaaaaacaaatttatttctcacagtctggaggctgggaagtccaagatcaaggtgctgacatctggtgagggctgctccccgcttccaatctggtgccttgaacactgcattctacggaggggaggaatgctgtgtcttaacatggcaaaaggtggaagggcaaaaagagaaataaactccctttatcagccccctttataagggcatctaatcccattcaggagggaggcgcctccagggaatgatcacctcttaaaggccccacttcttaatcctatcatattggcaatacctgaactttggaggggacacattcaaaccatagcagcctcatcaaataattttataaaatatgacttctaattttatgtcattttataactgggatcatctgttgttctgcacgccaatggagggggaaggtgaattttgttatgttcaagatgaatgcacaaaacttctgtgagatggccacattctactttacccagaattgtgcaacctcttctgcttttagaaacttctggatgacactttgtttcatgttcatatctccactggggcttcccagacacctgaaagttcaggtttgcatgctgctttctgcagctggcaagacaggtttctccattgccgcccagtttgtggggttgcaagaaattacatttgcattcacgctgtggctcactggacatgacattgctttcatgccatacgatgaccttgcttcactagagaagcagtagaaagaagggaatgttaagtacgtctttggatggcttagctggtcatgctgcatgctttgctactgattacagggaacaatatgtgcctttgttaccagatagtttgggggcagcgttggtgttctgtgagaaaggttgagaggcctgactaaacttaaccacatttgctgacacctggttagggctaatgtgggtaccagggaagtgtgttaagtgcttcaatagaggtgttttgttttgttttgttttgtttttcgagacggagtttcactcttgttgcccaggctggagtgcagtggcgcaatcttagctcactggcaacctccacctcccaggctcaagagacttttgtgcctcaacccctcgagtagctgggattacagacatgcagcaccacggccagctagtttttgtatttttagtagagacagggttttgccatgttggccaggctggtcttgaactccttgcctcaagtgatccgcccgccttggcctcccaaagtgctgggattacaggtgtgagccaccgcgcctggccagttcaggcatgaactttagaaatttcacttagatggaaggtagatttggagagggtgaggtctaaagcagggggaacagaatggctaggggaatgagtttggatgagagacggatggtaggcaccagcatttaagggacaggtgcagaaagagtatgctgaggagtagaagaaagttagagaagggtctgtgtagaatatagtggtgtgagctcagccaagggagaagagtttcaaggagggatgaattagcagtgtcagctggagttgagcagtcagatgaaagaggacttccaagtttttggatgtggcaaccaggaggtcaccagggcctcaacaagagctgtgtcatcagggctgggatactagcaggggcaaacgaggcactggcttcaggacaacatgtgagggggtgctcaaaaagtcagtcatcaagatagataatattttaatgcaatattttaaaaaacagacataaatgcaaaaaatctatgatgaacaaaataccaacattttaaataaagacagcgtcagtattgctgattgtcccttttgcctcagattccagtatggctcaggactgagtgtggctgtgtagaggagatggtggtgaggggatccaggtggaggcatgttgagaagtgaattgtggttgaagaaactgaagcactgagtacagactattccttcatgaggtcccagctttatgtgaaagggaataaagtgaaaggatggtaggtctaggggaccctcaggcttttttgagggtttggctttattttttaagatggaagagacttgcacatgtttacaagctgggaggagccgtctctggaggtagagaggatgaagagagtagacataggggattagtagagacaggagggcacacagggaggcttagccctaggcaagcagagggacaggagggaccagctggggcagtggaaaggtggaaggtggcaggagtttgtgcctgatacatggatgagaaatggcactgggggtggtgttgggatggaagagagttgtggagtgttggaggtttcccacactccttgaagggtgtgggaaaggagctgaacagagtcttcctgtaaatgaaactgttgagcagccgtaggggcccagctcaggaaaccaccagggtgtggtggtgagtagttttcagattgtgttatctcttctcccttccttcggaacttgctactggaggtgtaggagtggtagaggcttcctcattaaggcaggggtgctggagcgatcaaccatccctgtttgcctgggactgaggggtttcctgggactcggtcaccctagatgttgcagggctggcagtcaggagggaaaaaggccagataattgaaaatgctggccagagtttgtagcatgcgctgtctgattgttgtacctgagcgagttagagaaaacgccacactttgagatgaattaagagtccgtttatttagccggcggccaagagacagctaacgctcaaagttctctcagcctcgaagaaggggctagattttcttttatactttggtttagaaaggggaggggggggtctagttaaaacaattttacagaagtaaagtaggcaaaaaagttaaaaggataaatggttacaggaaagtaaacagttccaggtgcaggggctttaagactattacaaggtgatagacgcggggctttgggcgttatcaatctgacgaattcctgagaactgcggatattgctggccacagtatcttatcagttaattgcattcttggatgtgctgggagtcagcttgcacaagttaagtccttgcggaagggctgccagtgaaacagccaagatggagtctgtctggctctcttagctaagggagagtcaattcaggtgaaaacaaggctaagtgattaaaggaaagggagagtctaaaaacagcgttagtaaaaacaaggttgggcattacatgatcactgggtctccactgtcagagggtctttgagctcagttctagtggcagcctcctgatcctcacttccctggctgaggcaaggttgttgcagcagccccaggagtctttgttagaatcccaccccagagctccttcctccagtcctctcagcagttttgttagttccagtattaagtgtaatttctacaaaaaatgcctggaatatttctgtttccagaaccggatgctcctgttagctagtgtgtgaaagataactctgacttgcctaagctttgttgatgttttgaataataattggcgatagtctcttgacttctgcaagagaaatgaaacagaaattggtctcaagttttagttgctcttgtgaaggtcagggacagtttgtaccagggtgtgggtgtggaaaagaaggggagatatagtcattaaattagaatatgcctgtgaggggagttaaggggaattcctttaaaattctagaaaacacacacaggtgccaattttgtctggctagggaaaagtaaactgctgaaaacacttggggggagaaatgaagctaatggtatcttgatcagtcaggaggattgggtatttgaaagcagggaagaaaaataattggacttggatattcctttgccccttcatctgagtaaggtgaaagcaagtgactcttcagaagaggcgaatgggacactgagtccagcagctcaggcagggtggagttggtaactgatgggcacaagtcttttactgggctctaaagaactcattcatctgggtgtggtggcttacacctgtaatctcagcatttcggaaggctgaggtaggagaatcacttgagcccaggagtttgagaccagcctgagaaacacagtgggaccctttccctacaaaaaactgaagaccttatgagcttccctagtctaagagtaatttttatgttaatttcttggcttgggcttaaaccccaacaaagtggtgattattcggaccccagccctacctctccctagtatgctctcctttctcaagtactcaccacctctagccacagtgaactgcctccagcatacacacacgctgctattttgttgcatctgagtgggctggctccacacgggatctgtagtttccttttgatattttctttcaatgtgccagatgctaccactgagtaatctagattttgctgccaaactctacccccgttagcacagagggaagacagtatgccagtgctcttgctgagtgtgcgtgactggcagaaagcagtcatgggtgtgatggttggaagaaacaaactgagcagataatgttttttaaaatgattatctcattttgttaactcttggtggcattgttatattgttgatacttatgaattacaaaagttagatgactgtaaaaaaatagagaattaagcatttcatttctagtagttctgtttggttctttttcaaatatgtcagtgaatttgtataatatctcatttcttagtcttgtgtttaatgattttatttttgtgtttttataattccttctactgcatatattttatactttaatttataataacaactgttgacaaaattgtgactattcattaatacagtagaaaagaacttggcctccttttcatggaagctgatgatgagattaaagcactgttggcctgcgagtggagtatagatttgggctgtccagaacacataaaatttgtatttatctttctgataaaaaaaagtaaaatagtctgagtgccaatttttccactttcattgagcacatttaattttagtaaatttaacttagcaaatttaatttctccagttatttacaaataatcatatttaagtgaagttgggatgaatgggcaagcccatttcaaatttctaacctaatttttcctcttgttttcatataaaatttttctatttatgtgtttttattttaagatagctcaaatcttttgtggactgatactgtatgtatataaataaatggattcagtgcttctttcactaaatacagctagataaatatataaatatacttgaacacaaatacaaagcaaccattggcaatttagagttgggttgtgtttccacttattttttgttaataaatttgattttaacctgaaatattgtcttgtaggaacagataaagaacacaagaggtgatttaacataagttttagctgtgaaacttagagtagataggttagcaacttaaattttgaaagaaaataggatgagtttcaatggaagaaattaagaacacacccattgcatgagctccttacccctcctacccagccccctcccaggagtgagatctttccccagatcctctgtaacttccagatgttccactgagaacatcagaagcactaatggcaattgctgccatgtagcagtgcattgagagtcagggcctctggcacctccatggggctcagggtctgaagacgtgatccaaacctgacaacttggtggcaggttctgtgagcattcatgatgttgtgaaaagggcttggggtctaggaggatggcagcagaggtttctgccctcaggtgtgagtgaggggcttttgaagtaggagagcaactagaaaaaaggagtggcacagggacagaaacttcttttctccattgtttgttcaaggccacgtgggtggagtcattgaggtggaggtttaactctgtgacataagtttccctgatttagtcaggctgtctgtcgttgggcttttcccacttccttctactacgtacttcttccctattcctcctactgaggccattaaacccttagttgtaattttccctgaacatgctttacattctgatgaattctgaaaaagaatgtggggtttccttgcagatgagttcatctgttgtttcatttcctttacaatgtaggttttcttctctgtctttttggattagtctgtttttggttctgtctaccaaggatccctttctttagacttctatagatccctttctatagaacttaatctacttaagtcagggagaccacccagaaggaaagagcccatactttcaatcttaggcataagttagcttgataagattttcagaaaaattcccttttaaccacagaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactataggtaattcatcaactcttcctgaggctgggtgggtgggagggagtgaagtgtctcagactctactgaatggcagaaacgaggataataagaagtgcagccactttactgtctctgcccacttatccaactgccagatgatgtcacttcattcctgtgagccctttaaattcttgaaacttgttttcttgctttctttttctttctttcttttttttttttttttttttttttttgagacagagtctcaccctgttgcccaggctggagtgcagtggcgtgatcttggctcactgcaacctccgccttctgggttcaagcgattctcctgcctcagcctcccaagtacttgggactacaggcgtgcgccaccatgcctggctaatttttttttgtatttttagtggagacggggtttcaccatgttggccaggctggtcttgaactcctgacctcaagtgatccacctgccttggcttcccaaaatgctgggataacaggcatgagccattgcctccagctgaaacatgctttctcaaaggaattgggatcatatgcaggtagaagggcagctggtatgtgtttgcctgaaggatagaatgacaagacgtgaagaaagataggaatgactaagagctagtcattcttgccagcctctgacagtgtgagatctgcagcagtgtttactagttcattttctgtgaagtcagtccttgataatttgtggtacaaagaaaggaaataacaagtctgacagtaatcttcctacctttgtagagactccatcatcccttctgaatccctgttggccctaccctgctgaggaagtttatcagggtgggctcccttcctgcacttcctgcgcttggagacattggagagcccacattgaaaatctcttcagttaaccacatttaagtcccttcagtccaaagaggaaatggccactggagtctgctttagttcccacaagctttgggttgctccttcctcctgttcacatgttaatgtctttagaggttcagaggggcatggaagctactgagagactgacttcctggggaaaggaagataacttgtaaccttaagttggtgttttctttttttttttgagacaaagtctcgctctgcagcccaggctggagtgcagtggtgcgatcttggctcactgtaacctctgcttctgggttcaagtgattctcctgccttagcctcctgagtagctgggattacaggcacgcaccactatgtctggctaattattgtatttttactagaaacagggttttgccatgttggccaggctggtcttgaactcttagcctcaagtgatctgccctccttggcctcttaaagtgctgggattataggtgtgagccaccatgcccagccggtgttttttctctcgaccaccagccttttattatgttgataatgtgtatttggagatgataattattatcaagaactatactaaagagagctgaaagcagtgtgggctttggaaagtatatgagatttgaacttggaaagcctgtttttttggtttttgtttttttgtttgtttgtttgtttttgagacagggtcttgctctgtcatccaggctggagtgcagtggcatgatcatagctcattgtagctggaagacctgtttcaagcctcagatctaccaattatgggccaggcaggctgggccaatcactaaccttgttgggcctctgttttcctacttgtaaagcgaaaaataataatacctgactttacaaggttgttgtgagcatcagttgtaataatttactatgtgaagtactttttaaactgtgaagcactctacagatagaagggattattatcattgttattattattatttttttaatcttccacctattcagccatcagttttaatgtcagtaatcttcagactttccgggaggcaccaactgagtttcagtgaatagggcaatctctccatttcccatttccttgctatgatgagtggagattcttcaggccctctgggaagggttgcgggggcagttgaagaggagtgctagatttatttattcatctggtgagtgggcttcattgtgtattggtgctaagtgttttggtaagctctaggacaaaatgaaaagtctgccatcctcaagaatctgagagcctaactgggaaaatggccttgatgacaatgtcatggtaacaatactaaccacagggtgtccttaggagccccagaaaagtgtggttgttggttctcaaagtctatttcctagggggggaaaaatatatatatatatatatatatatagtgttagctccagccaccagtgagtcaggagaggctttctaggcaaagacatctaagttcagaatccttgtgatccagatgcctgtaccctttgagttcagaggtgggccagggtatctcaggtatttctttcctttagcatcttgcaattcaaaatatggtccttgaatcaacatcacctgagagcttgttaaacagagaaggctacttcaaattctatttctgtcttttatgttagtcatttgggttcttaagtcatttcactgtaacctctgggggagctaggggattctttaaggaagtttccattctctgagttgttttcagaaactgttagttggcaaaggatgtaccatctcctattaaacgggcaaggacaagttcccttttctgaggtcccttaagatctcttcctggggtgatctaggcttgctgttttatgagggagggacatatttacacaggggcaagaactagtcttttaatccattgttgcataggggaggcgtgggcacttggagttgtcttaggactgatgtctgaattaactaaatgaacttgtctggtttgcagagtgctgatggcagagattggtgaggatttggataaatctgatgtgtcctcattaattttcctcatgaaggattacatgggccgaggcaagataagcaaggagaaggtgagttttcttcttttggttcatggccccaggagcctatcagaagtgggagctactcttgttgatacagagagagggaagcaggcagtctgccgccactatagtgggagtcagacatctcaggtggcttttaaacaacatgaatgggaagagaattggtttatgaattgaagaaataggattataacatcttctggtgtggtcttggatgtttctttcatccttggattttatccttgtttctgtaaaattcataggtctggctcatatgtgtttccctccctggtttgatggggttgtggggaagacatcccatctgcttgtgctgggggaaaacaggaaggaggtgctagtccactatagtatcactctcctactgccatctatttctcctcagctgactcaaggtcattgtggggtctaggctgcatgtaggagtggggtggggggaggttcttgtgactggtgtatctgggaaatggtaaaagtagagatttagagttgaaaaccaggaggccgggcgcagtggctcatgcctgtaatcccagcactttggggggccaaggtgggtggatcacgaggtcaggagatcgagaccaacctggctaacacggtgaaaccctatctctactaaaaatacaaaaaaagtagccgggtgtggtggcgggcgcctgtagtcccagttactcgggaggctgaggcaagagaatggtgtgaagctgggaggcagagcttgcggtgagctgagatggcgccactgcactccagcctgggtgacagcaagactccatctcaaaaaaaaaaaaaaaaaaaaaaaatgaagaaaagaagaccaggtagtggtgaagatctcggggatgtcatgattgctagaaaaatatttaaaatccatggccaggcacggtggctcacgcctgtaatcctagcactttgggagactgaggtgggcagatcacctgaggtcaagagtttgagaccaacctggccaacctggtgaaactccgtctctactaaaaatacaaaaaattagccgggcgtggtggtaggcacctataatcccagctacaggaggtgaaggcaggagaatcacttgaacccaggaggcggaggttgcagtgagtcgagattgcaccattgcactccagcctgggcgacggagcaagactctgtctcaaaaaaaaaaattttttttaactccagttggcctagcacaatggctcatgggcacagtggctcatgcttgtaatcccagcactttgggaggctgagccgggcagatcacttgaggtcaggagttcaagaccagcctggccaacatggcaaaaccccatctctactaaaagtacaaaaattagctgggcgtagtggtgggcgcctgtaatcccagctacttgggaggctgaggcaggagaattgctagaacccaggaggcagaggttgcagtaagccaagattgtgctattgcactccagcctgggctatagagccagactccatctcaaaaattaaaataaaataaaataaaataaaataaaataaaataaaataaaaaaatataaaataaaataacattctagttggccctacatggtactgttgacctaaggataggccaggaaatgtttgagaacctattgtttctaaaatatgacaataggtcctcaaaataggcaggccagtgcctgcctgtaacgattcagataagtcattgcttgagaatttcctcatgttcctaatgattatagttttgtttcttaagtcccatcaaatgcaaaatgggaaggaaaatgaaactagaactccctttttggtttctcctagtaattgtctctcccagccatttatatatatctaaattatgattattattttcaaaaataaagatagcacttcagtaactaaatgttaaatgcaaaggaaatagatcccaaagcaatgcctgtttctgaaatatcgttcgttcataatcactgtggcccaaggtaaacgaatagcagaatactcaaaccttgttgtaatttcacttttttataatcccctgagtcagaacgtcagaatgagttggaaggcccaatattgattcaaatattttggaaactttaaaactataacatgtgatttttctcataaagtctttccccagctacctttcttctcctttttcagagaagcccttagagtttttcactatgacaccagcctggccttttggaaaataataaacttaggaggattgtcttttcagccctgctctttcacggtccttctcaatgacacaacatggcacacgtgtctctctgcaaccaaggagcagattgatgaccaaaagacttaccaccacctctgttctgagtaaaaatcaggagtctaagttgctcatgacagagatgtctggtttaagatcactgaaggtcactgaaagggctcatcttgtcacattttcttactgctataaatcacatggactgaggtttgcatttggggcttattagtcagctctattttttttttttgagacagggtctcgctctgctgcccaggctggagtgccgtggtgcaatcactgctcactgccttgacctctgagttcaagtgatcctccacctctgcctcctgagtagctgggaccacaggtgtgtgccaacacactcagcttattttttttattttttgtagagatgggggtctcactattttgctcaggctggtctcaaactcttgggctcaagcagtcttcctgcctcagcctcccaaagtgctgggattacaggtatgaacttctgcacctggcctagctagctctattgacatttgttttttgttggtggttctcttagagtttcttggaccttgtggttgagttggagaaactaaatctggttgccccagatcaactggatttattagaaaaatgcctaaagaacatccacagaatagacctgaagacaaaaatccagaagtacaagcagtctggtaagaattttggcctctcagtggtctaggggaagtactctgtgcatgggggtgggcatcatgactgataaatattcatttgttggataggtggatggaatggaacctggatgaccaaagcctcctttagcttgtggctagaaatcgcgtccctttatattcttcatatcccagatctgccaactccattgccctgtatattcatgatctctgcaaaatgctgccaagcagttcttaacatttcagtcttcaagaaagaatctgggatctgcacaggctggcagagctatggacattcaggggttttgcatgtatgctgaaccctactgccttgctctggtatttggcctcacaaccactgtccaacttcgggtgatgtcacttgggtctcataccttccttgcatgtgtcccaagtttcacaaaacctccttatggaaaagagcacattcgatttcttccttgataaaagggaccagattcacattggccttctgctttacttgcattcctcattgtcttttagactcagcctcagcttgggctttgttagcaagttcactgccaccatagcatcacagcctaaagggcatggctgagactcattgatctatagagcactcttttaccccaacatactctaaatgactgatcaaagatcaaaaacagaagagcatttatactccattcttgttttttgagacctgcttgatttattccgattatttaacacacagggacgcaacagtgatcccaaagtgtgtaaagttaaagccttcaactgcagctgaggagagggcaggaatggggacggtggtgagtcaggaatgacaggcaggcagccatgaccagggcagcctcctccccagggccagggactggggagtggcctaaggagcaggacctaagggtagcccagagctggggaagggggcagagacctccccttggcctaggtctggagctcagaagtgccacatgcctgagggggcagcggcctgggaagggccagaggcagggtcaggagagcaccatttcctggggggctggggacagggaggtgccctataggagaagccaggaggggccgtctgcccctgaggtgggggctgggctggagcaggctgcagcaagaaagacctgaggcaggcacagggcctgagagcccagctgcctgggttcaggggggctcccagggcagcctggcccagggagcagtcctgactctgcaggggatgcccagcaaggggggctgcagacccctcagagcctcccctcctctctccctggaaaggagctggggaacccatagtgcaaatctgtggaccactcagttatggagggaggctgtgcctgaaggtggacactggggtgcactccctccaccatctcgccctgcaccgctgtcctcagtacagccacttctcgtaagagtgcaggccatggatgccaccgtcgatctgggctgacatggtctgcttctcaaacttgagctcccctgagtacatcatggaccgaaggacagacaggctgtgggccccgatatcctggcagccatgctggatgcccactatgaggtagggcacgaacttctgaatggaccctttgtcctggatggagcccaagacatcctgcgtgatcttcgccttatccccgtcgttgaagtattgtttctggctgctgctgctcttctccatggcatccagtgagcccatgccctggtacttcttgagctgcattccgtctgagaagaagcactcgccgggggcctccatggtggcggccagcagggagcccatcatcactgtggaggctcctagggccagggccttgaccacatgccccatggtctggatgccaccatcggctatgatgggcacaccaaagttctgggtatgcttggccaccttgtacacagcagtgccctggggctgactgcaggctatcacttcctggttgatgtagatggagccgcgcagtccatgcccctgcccagcccatccacaccagcgtcaatcaggttgttggcctgggctgctgtcaccacgttccccccaatcacctggaggtggggttacttttgtttgatgtaatgcaccatggcgatctgatacaccgagttcccttgggacgagtccaagcctatgacattgacgcctacctgggtgagcaggtccaggtggtatttgtcatcctcatgggtacccacagctgccccgcccagcagctgctcatgggaatccttggaggccacagggtagtctcggttcttcagcgcggtgcaggtgataatggccaccagctcatcgcgatcattgacgataggcagcttcctttcttactaagctgcaggatctcatttgcctctttcaacctcacactgctggagccaccactagcttgatccttggcatcatcacctcactgaggagggtggtgtggtccttctcagcaagaaagtcgatgtctcgggaggtgacgatgcccaccagcttgctgcccatggtacccgtctcagtgatggggatgccagagaagccatgacgcatcttggcctccaacacatcacccacagtgtgcaaggggctcagcaccacggggtgtgtgataaagcccggttcaaacttcttgaccttctgcacctcactggcctggaactctggggtgcagttgtggtgaatgaaaccagtacctcccatcagagccatcacgatggccaggtcggcctctgtcacagtgtccatgggggaggagatcagcggcgtcttcagagtgaccattgggtcagggctgaggtcaggtccacctcatcagctatgaagtctatgaatcctgggagaatcaagaagtcgttgtaggtgagtccctggtcactggcgaagagctgctgcacggtgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgaccgtcccccagcccgacacccataaagggtctgtgctgaggaggattagtaaaagaggaaggaacgcctgtttgcagttgagagaagaggaaggcatctgtctcctgccagtccctgggcaatggaatgtctcggtgtaaaacctgattgtatgttccatctgctgagataggggaaaaccgccttagggctggaggtgggacatgcgggcagcactactgctctttaagtcattgagatgtttatgtgtatgcatatctgaagcacagcacttaattctttaccttgttcttgatgcagagacctttgttcacgtgtttatctgctgaccttctctccactattattctatgaccctgccacacccccctctccgagaaacacctaaaaatgatcaataaatactaagggaactaagaggccggcgggatcctccgtatgctgaacgccggtcccctgggcccccttttttctttctctatactttgcgtctgtgtctttcttttccaagtctctcgttccacctaacgagaaaaacccacaggtgtggaggggcaacccaccccttcagcgcagtgaacccgtcctcgaccacgtagccggtgctgctgctgataggtagtccctcatgctgccgcgagaccccgcgacccgacataaacgctgcagctgctgcgacgcggaggcgcgccgctgccacgctgcagccaggcgccgggtgggctgggtgggctgggggcgggggctgcggcagcggcggggcgggccagggcgccctatactccattcttcatgatgtttggtcgaagagtcatctgaaattttgaattcagtaaggtggctagaaagtttagggtattttgaaagatggtgattgaccttggactgaaccactattgaagatttatttgataataatttgtaagttttaactcagtacctcccttctgcttttatagttcaaggagcagggacaagttacaggaatgttctccaagcagcaatccaaaagagtctcaaggatccttcaaataacttcagggtgagtctggagaaaacatatggaatcccagcatgaaaccgtttcagagttctaataaaaatatgcatattctcacagcatgtactttatttaatatctgaaaaaattgtgatagaaatgtgtatttgttttaaaaacgtgtaacttcttatatttcaaagctaatacatgttcattgagatatttggagactatagagaaagataaaagaaaataaatcacctatattccactatccaaagacaaccactgttagtattttggtatatttccttctagactcttttttatgtgggtttgcatctgtatctgtatgtatgtatatatatatatatatacatacatacatacatacagttggacaattggacatttttttcactgttcatttattcacttgaaattgtaacttaaaaaaagaaaatgtaactttaaaaataaaaatagatgcaccatgcctatggaaaaaaatttaaatgtactacaagaggttttaaaagtatttttttgcccgggtgcggtggctcatgcgtgtaatcccagcactttgggaggccgagccggaaggatcacctgaggtcaggagttcgagactggcctggccaacatggtgaaactccatctctactaaaaaatacaaaaattagccaggtatggtggcaggtgcctataatcccagctacttgggaggctgaggcaggagaatcatatgaacccaggaagtggaggttgcagtagccaaatcgcgccattgtactccagcctgggtgacaagagcaaaactctgtctcaaaaaaaatgttttcttcctacccctataatactgacctccaattatttttcctaaaggcagctgttgtgaactagttcattctgtaactatccagagatagtctacacatatatttcatttttgcttttttctcttctacagatgataacaccctatgcccattgtcctgatctgaaaattcttggaaattgttccatgtgattaacatggaactgcctctacttaatcattctgaatgattaaatcgtttcattttctaaatgtgttataatgtgtttagccctttcttgttgctgtatgtttagatgctttccaatcttttgttactactaataatgctataaaataaatatccttgtacttctttgtgcatttgtttttttactgagctaattttaatgatttcagcaaaagttattttgttattgagtgatgaaacaaaagatttttgagggtgttcatgagcataagtgtatcatatagtcacttatggttgttgtgttcctagtacttagtacaaggtatcggaattgttctttagttaatcttttatcttgagaagttaaatcttggtgtaatcttatcctcatgttcatataaagatatgtggagtttgtagtgaggacttagagccgggtacaatttcatggttaaattagaaatgcttttggcagtgttaacagctcttttagaatttgtctagcaggcttttcagtttttgccagaaagccctaaaaaaaaagaaggaaaaaaatgcttttggctgagtgtggtggctcacgcctgtaatcccagcactttgggaggccgaggcaagcggatcgcttgagcccaggagttcgagacaaacctggtcaatatgtcaaaaccccatttctacaaaaaatacaaaaattagctgggcatgatggtgtgcctttagtctcagctacttgggaggctgaggtgggagaaattgcttgagcctgggaggttgaggctgcagtgaggtgtgagtgtgccactgcactccagccctggtgacagagtgagaccttgtctctaaaagaaaaaaaaatattatatatatatatataaatgctttccttaaaatatgtaatgaaaacccactcttgtaatataaatggtttcttggagaatatgtctgtaagagacactactgagcaatgcaatttcagagctaaaatggatttacggattatattatccaactcccttaatgaacaaaataaggaaacttagccctaaagaacattaactgattgtctacttctaactactagcagagctgggcccagcccatactcctttcactgcactgtgatgtatataataaactatatacttgtcataccatatcttagagcatactttttgtttttttgagacagagtttcgttcttgttgcccaggctggagtgcaatggcgcgatcttggctcaccgcaacctccgcctcccgggttcaagcgattctcccacctcagcctcccaagtagctgggattacaggaatgtgccaccacgcccgggtaattttatatttttagtagagatggggtttctccatgttggtcaggctggtcttgaactcccgacctcaggtgatctgcccgcctcagcctcgcaaagtgctgagattacagacatgagccactgcacttggcctagcatatattttttaaaagaatgaaatgtgctttgttttgtccttctgagtctctgtaataccaaataatgagaaaaagcagatttaggattcagatccaggttttctgagctttctctgctattgtctgtctaatataaattatattgtcattcttagttaaaaaacctgccatatttttactattgtgtttctattttgtaaatgaagcatattcattgctatgtagcctgttgtgagcccatatgctttgcatattagtttctccttaaactttctatatttaatatgtgaccctaaggccgggtgcagtggctcacacctgtaatctcagcacgttgggaggccgaggcaggtggatcacctgaggtcgagagtttgagaccaacatggagaaaccctgtctctactaaaaatacaaaattttccaggtgtggtggtgcatgcctgtaatcccagctacttgcgaggctgaggcaggagaatcacttgaacctgagaggcggaggttgtcgtgagccgagattgtgccattgcactccagtttgggcaacaagagtggaactccgtctcaaaaaaagaaaaaaaaaagtgaccctgattattcattcattcatttagtaagcaggcactatggcatatgaatgcagtgactttcttaaaaggtttaggagccgaatacctagaagttaattcatatgaggctgcagaagtgcttcaaaaattactgtatgattaaatgccacaggataccacaagatattatagaattaaaaaattatggctgggcatggtggctcacacctgtaatcccagcactttgggaggccgaggcaggtggatcatgaggtcaggagttcaagaccagcctggccaagatggtgaaaccctgtctctactaaaactacaaaaattaaccaggcgcagtggcaggcgcctataatcccagctactctggaggccgaggcaggagaatcacttgaacccaggcggcagaggttgcaggcgccactgcaccccaccctgggtgacagagtgagactctgtctcaaaaaaaaaaaagaatttaaaaattatttggctacaatacaatgcttttaaaatccatctttgatttgatatgttacctctctctaataatatgtaaaagcgaatacacatgcatgcggccaatttctatctgatatgatcagcctctggctaagttactaattattagtgaaaaaggcaacttacatgtttttaatttagacacacagacttagctactgacacagcttaacagatagtgtatttcactcttttggctaggttagcttcagagaagaactgtcatttgaaagctgagtgtctcagatgggttgacagcatgtggtatgtgtatcttacataggacctgtcatctgagaagagaaagggtcggtttaatctttcattctctgattactcttactctagccctcagaagtggtttatcaagaatatttgattatcaagaatcaggaccatatgttgcttatgtgtagctaggcaatgatagaaaagcaataactggacatttattatgtacttccatgtgcttggcactgtgctgagtgctttgtgtgcatttaatcttcatacaaaatctgtaaggtatctattattatcctcatttagcatatgaagaaacacacatacagaagttaaataacttgctcgaggttacatagctaataagtggcagaattaggattcctagccaggtctgtctggcctagaaatccgactcttaaccatgctgtactttgcccctgtgttgaaggaacaggtggaatgtcaatctcatgttccaacagcttatcctaacctggagctatgctagcaactatactatactgtaacatcagattttattgggctgttttgaaacattctaatatgctagcttagcatatttttcttttctttttttttaatttttgtgacagagtttcacttttcactcttgtcgcccaggctggagtgcaatggcaccatctcagctcactgcaacctctgcctctcaggttcaagcaattctcctgcctcagcctcctgagaagctgggattacaggggcacgccaccatgcccagcaaatttttgtatttttagtagagatggggttttaccatgttggccaggccggtctggaactcctggcctcagatgatccacccaccttggcatcccaaggtgttgggattacaggtgtcagccatcgctcccggcctattttcatcttttaaaagcagaatttccctgttctttggtaatatgatacgggatttatggagttaacagctcttgctattctttagataatttaactgttgggacgatatttttatttttttcctgagttaagaatcctattgagacatttaaagaggtgtaatgtatagtgtacctctgaaataactaacaggaagtatgaccttattctttgtatttgaagctccataatgggagaagtaaagaacaaagacttaaggaacagcttggcgctcaacgtaagaccacctttttttaatattcattatttataaatgcttgataattctagtacaaatattgcatttttagagttggtcatttcctttatctacataatctaagtaagctctcaaaataaaaactggttaaactcttacgatagactcattggcatttctagttgtctattgaattagcttatctaagtttgaacaccatcgtactccatcagcttcatcatcttggccgtatgttaagagatgtgatgtttataactgaaatggaatggagctctaatcaggccatgttaaacattgatccaaccatgataatgaaccatgttaaaccaaatatctagcagcaggaagaggaatggtaaataagttcttgtcttacagcctatttaataaatctggatactctacagatgatatcccccctttcctaagaaagaaaacgtgcaatttaaagatgggtcatttcaacccgcatgagctgttttctctcttaaaacattagcacttgatcccatagatcattttttaaaagattactcttttttttttttggagacggggtctcactctgtcacccaggccggagtgcagtggtacacttttggctcactacagcctccacctcctgaattcaagtaattctcatgcctcagcctcctgagtagctgggattaaaggcacgcaccaccacacccagctaatttttttcttatcttttcttttcttttttttgagacagagtcttgctctgtcacccaggctggcgtgcagtggtgcaatctcggctcactgcaacctccgcctcctgggttcaggtgattcttatgcctcagcctcctgagtagctgggattacaggcttgtgccaccacacccagtttatttttgtatttttagtagagatggggtttcattctgttgcccaggctggtctcaaacttctgacctcaggtgatccacccacctcggtctcccaaagtgctgggattacagggatgagccatggcgcccagcctaatttttgtatttttagtacagataacgtttcatcatgttggtcaggctggtctcaaactgctgacctcaagtaatccaccaccttggcctcccaaagtgccgggattacaggcgtgagccactgcacccagcaaaagtttacttcttttgcttgtcttgagtcctccttgaagtgagagctgagactcagtcttacactgatgaggcacatggctgtggttccgaactccaggaaacggattgatgggctgtgatggagggcttcagtcttatccaagaggcttggaatctgtcctgtgtgtggtgggacatcatgaatgttttgagtagggcagtggcctaatagaagccctctttgtgtggcagtccccttacagatatcttacgactcagtctttgtgctatctgcacctggaaacttattttgcccggattagtcagctggtgtagctcatgtctgtcattctctacctaatattgtgctctccagcaaaaactactgagaagcgaattaattcctgaaatgatagcatgtttcttaaaacactggtgaggtgatgagaattagtattccgaagcctgtttaaagggaaaataggagacctagtagatttgcataggaattaaaaacaattggtgttctttccatttgctccctgatggcaattttatccttggtcataattgtacagatgaggtaagtgagaatccaaatatccctatgatcctgttaggagagctgcttacttgctcttgcttggacttggtttatttgctaataaaagaaaaaggtttctgggctgggcatggtagctcatgcctgtagtcccagcactttgggaggtcgaggtgggtgcatcacctgaggtcaggagttcaagaccaacctgggcaacatggtgaaaccccgtctctactaaaaatacaaaaattacctggtcatggtggtgcatgcctgtagtcccagatactcgggaggctgaggcaggagaattgcttgaacctgggaggtggaggttgcagtgagccgagatcttgccactgcattctagcctgggcaacagagcaagaccctgccccccaccccagaaaagctttctaataacttgggcttaatttaatagaagtttaaaatactcggccaggcatggtggctaacgcctgtaatcccagcactttgggaggccgagacaggcggatcacgaggtcaggagttggagaccagcctgaccaacacggtgaaaccctgtctctactgaaaatataaaaattagccaggtgtggtggcacacacctgtaatcccagctactcaggaggctgaggcaggagaatcgcttcaacctgggaggcggaggttgcagtgagctgagatcgtgccattgcactccagcctgggtgacagagcgagactccatctaaataaataaataaataataataatcaaaccaaatatttatattaatttggacttccaaatagatttgaactgttcagccatcattgaatttgatgaggatggtgataacttcaatttagtaatttcttgctaaatgccttaaactgagatagatatatcacatagattattttgtggcttttctttgtttgtttgtttgttctgttaatatataattgctaaaatacaaaaaatataaaatgaaatttcctctttcaagtatcagagatagctgctattaatgtttgatttttatgcctccagattcttttatatttaagcatatattaatacatgtgtaagtatatgtacacaaatatacatttttaagttcacagaatcaatattatacatatttttaataatccatttttcacttaatatatcctgtgtatctttttttaatttttttctttttttttggagacagagtctcgctctgttgcccactttggagtgcagtggcacaatctctgctcaaaactggttgttcttccacctccctgacctaatcaagtcatttttttctagcaaattagctttaggctcatctccatttgccaggctcactgcccccattgtcactgtcttgccattgacattttattttatgatctcccagtatcactggactatgaaaacagtgccatctgttttataactagcaaacacatataaactttccctgctctgcactctctaaggctgttccctttaggtattgtcaacagtttcagcacatataggaaagctatcagtattgttgggtggtgaggttattagattctcctatcaagttaaaaactcaccagccacctgttcctcacctagaacggggtaggggagagccttctttcacttgctgtttaagcagcttttccagatagcccctgatagcactgggacttgtgttttcttatgtcactttcttcagtgtgaggttgaaaccttggggccaagtatagctggggaaagaagagataattgaagaaaataggaagggagaacagttgttatacaaagaaactcagccagtgtaggggtggacttagctctccttcagctttgtaaatggtttctctctctcatcccccagaagaaccagtgaagaaatccattcaggaatcagaagcttttttgcctcaggtacagaataaatgatctgatttggtattatatgtacatagctgtggataaccctgacttctttaaaaatacctgtccattaagaattctttgagacagtgggactctgagagtgttgttctcctgagaacttccatacaagggaaccctgaataacaaagagaaagatgttaaagtggattgcattagtgaactttggaatgcagggaagttccaaagtagcactcctcatctcaactcagtgactgctgaacatattagtcagcagtgatacttccctgaactttggcttgttctggctttttcttaggttgacacctctttgtaagcagaagcaatagaagggctccctttgtacttgggaacatgccacttatataacttcaggttactgtggagacaaatcactcatgttttctctctttttcaaattatctttattccacaaagccaataaagagagtgggattttcattaaaattaaataaaaatgaaaataatttgtcttaagcacattaccctaatagaggaaaaatttgatattaatgggaaacatttgccgtaatgggaaacttcaggctgtgtctgttgagtgactcacctgccaaaggaaatccaaaagaagagatggtatatgggtgggaccttatagaaacagagcaatatccagagtctttagcatttcttgtcttcctttccagagcatacctgaagagagatacaagatgaagagcaagcccctaggaatctgcctgataatcgattgcattggcaatgagacaggtaggtgtggaagctgcagattaactggtgcccccagattgagatcatggcacaggcaagctgtattcattggagtgatcagcaccaactgccgtgacaaaccagttcaagaatctgtgcttcatcctgggtgcggtggctcatgcctggaattccagcactttgtgaggctgagatgggaggatcacttgagcccagttaaaaattagctggtgtgggctcgggcacggtggcttacacctgtaatcccagcactttgggaggcggaggcgggcggatcatgaggtcaggagttcaagaccagcctggccaatatggtgaaaccccgtctctactaaaaatacaaaaattagctgggcatggtggtgggttcctgtagtcccagctacttgggaggctgaggcagaagaattgcttgaacctgggaggcagagcttgcagtgagccgagatcgcaccaccgcactgtagcctgggtgacagagcaagattctgtctcaaaaaaaaaaaaaattagctggtgtggtggtgcacacctgtagtcccagctacatggtaggctgaagcaggaggatcacttgagcccaaggaggtcaaggctgcagtgagccaagatggtggcattgcactccagtgtgggtgacagagcaagaccctgtctcaaaaaaagaaaaaaaaaatgaatatgtgttacaacacaatagagacttgtttctcattcatgtcacaggctagtgtggatcgggctgggggagctttgttcatgtggctattcagtggctccattatcttctgaggtcttggagttttctacagagtcccttgcatctggctagcagataagggaagagagaatgtgtgaaggatctcacaagagattttagggaccaggcctaaaagtgataatgtgcatcatttccaccccattagattggtcagaactcagtcatgtggctccatctaactgtagtggacatggagaaattagtctcgctgtgtgtcaggaggaaatgaaatggatttgggggacacataacagtgtctctggcacaaagacatcatttacggtagttggtgagccttagtcttgccttttcttttggatgctgaagcagggaggagtcctggaacccagaggggcattaatattaatggaaggcattctggcttcacatattatcacatgccccatcatttcacctagatagacgacaaaagctttcctgggaacattaaagacataataaatgtgtgttcacttacagagctttggatattttctgagctgtgtcagtcagttctgctgtcctttgctttggtcgttggcctcagtctcttctatctgcgcgtcaccattgcttggatctgagatgattcttttgctcagttgttgttggatgtctgactcaaactgaatcactggtgctgcatcaaaagagaatgagaagagcctagataagtggaatgacattctgtttaattatttagctcttccttaagaggatcgatcattgtatttccagttttagagcttctcaacattctcttaaaatgagtcagaactatctttcaggctcacttaaaatgttaccatggggagttttatgggaagaaaggctaagagaaggtcaaattagcaaatataatactaaattttccaggatttcagatacgatcctgcttggtcgtgtcctatttttggttagatgtgagaaagataagtgtcttcttttcagccattagtacccatataagaatgagaaaatattttcttaatgagtcacttcctgttttaagagattatgtaattgtcctgtacttctggttttggtcagttttgtttcattcatcagtagatgttgtacgtatatctgttgtatgagagaatcataaaaaaaaaaaagccatgacctgctgtgaattgaaaaactaagttttttggctaaaactcaatgtctgtgcttgcttctgttgctgggttatgggcctcttgggggcgggggctgaatgtatatttgaatttttctgcattataggagcatgatcagagttgagaaatggaatatgacagtgtgggtttgaatcatggctatgccatgttctagcttgtgaccttgggcaatgtccctggcctctttattttttttaatgtttttttttttctttcttgagagagaatctcactcttgttgcccatgctggagggccatggtgcgatcttggctcactgcaacctcttcctcctgggttcaagcaattctcctgcctcagcctcccgagtacatccctgccgggaatacaggcgcccgccaccatgcctggctaattttttgtatttttagtagagacggggtttcaccatgttggccaggctggtctcgaacttgctgacctcaagtgatccacccacctcggcctcccaaagtgctgggattacaggcatgagccaccacgctcggcttctaattttttttaatttaaattttatttttatttttcctgtagtgctgagttctcggccttcttaagtcccagtttctcttctgtaaagtgggttaataacaggacctacctcatagggaggttgggcagaatgagagttcatacttggaaagggcttagaataatgcctggcacagtgtgagcatgtactagatgccaactagcattatttcctcatttgcttgttcaattctagccataaaccacctaagcaagagctcaccatggctttgcacttggtacatagagtctgatctcagacaagtgagagaccagggcactgaggcctgccctaggcccaagggtgagtggaatgcatccccatagactgaggcgcactggaatggaggccataacttgagagggttatccaacttcttggataaacactcaagtggaaagctgagcacagcactcctaccagtcacagtctgaatgggcttggcagaggagaatctaagtacaaagtacaggagggcagagacctgataaaagagaaagatggaagaagatggtagaattggaggcagagcctggggcatcatgcttttggccacaggtatgagcaggtattggtcttgactgcactggtacatctgtttcctgccccatggttgcggatgtatctgtatacgagctccaagaatcagaatggcagctctagacagcaggtccttcctggtcagacatagtcctttaaagttcaacatcttggtggtacattgctggacaagagtaggcctgggccattagagggtaccctggatgctcggtgctgcctttcccctgagaatcagggtgatttgactcaagccttctctgcctctgggaacaaaatcagtaattgggcttgaggccacttataaacccccctgggctcaggtggctaattagcaagtaagaaacaaggcagcacacttttactcttcttgtgctatggttttcatcagctgagaggtcacaaatccacttacatgcagactcagagcagcaggagaacattaattattaagaagtggaaaggcacagtctcctctcctcacaccatctccctaggcctccagctcttcatttccctcctcctctcctggtaatttgtcactgaagattctaggcccagaatcctgccttggttgaaaatggttgttattattagtgcagcacccttcatctcttttccttctaatccgcagttagggggcttcatctagagtaattatgtggatttcctctgtctggttaactttgccatctggttaacattgaacacttgggaggagtgcaggagtcagataatgaacaagcgggtaaggtaattgccagccgaaataaggtctctgaaagaaagaaacaagaacatgataggactaacctaggcatagctgtgctcagagtatataatttattaaaaatctactacgtgccaggtactttgctaattgctttacacggattcttgcttaatcctcatgaataataccataatataggtactattctctccattaaattttttttgttctacttagaactaatttgctaggaatattctattttcttttctttcttttttttttttttttttttttgacagagtcttgctctgtcgccaggctggagtgcagtggtgcaatcttggctcactgcaacctctccctcccaagttcaagcgattcttctgcctcagcctcctgagtagctgggattacaggcatgcgccaccacgcccagctaatttttcttttttctttttatatttttaatttatttttaagacggagtttcccttttgttgcccaggttggagtgcaatggcgcaatctcagctcaccgcaatctccacctcccaggttcaagcgattctcctgcctcagcctcctgagtaactgggattacaggcatgtgccaccatgcccagctaattttgtatttttagtagagacaaggtttcaccatgtcggccaggctggtctcgatctcctgaccttgtgatctgcccacctcagcctcccaaagtgctacgattacaggcgtcagccatcatgcctggcttattctctccattttcaaggtgaggaagctgagcagtgaactacactcctaccttctctagtactgattgagctgggattcaaaagctggactccaaaacctatgcttttaactactttgcctcaatataatttccatgaaggtgagggagtttatctatctcctactatgggtctccagtacctggaagaatacctgctatgtaggtgttcaataaataattgttgggtgaatgaatgaaggaataagctctcccagtgtcagtgtgtttctaaaagccattcctttttatctttagagtttagcagactctcttctacctatcttcccttctctcctcaaaaaaccagacttttatccaaaaagcatgcaagtcccccaagtatttaaagctttatttctttgtttgtccagtaaatgttcgttgagggcctactatgtgcaaagcaccatgcttggccctgtgtgaagcaaatattaaggcaatgaggtggagtctgatctcagagctgtgttgtgcatgaaataaggttattctttggtagttctttcttgagaagaattcttatggagttcagtaacctcttcttgaggcagaagtaaatgctcagggatttgggaactaattatctcagtttggtagaattgaaaaataagtctttggtgttgtgtcatctgtgtcagtgacagcaaagctggacctgtgctaggccctggtgggtcatctttaagcactggacttttatcttgttaggaatatagaagcaagcgtctcacatctctgacagatgggctttacggcttggcctaaagctctggttgtttttaaggcccttgaataaaaataaaagacgatgtttgcagattttaagaggaagttttttttttttttgagacagagtctcgctctgtcacccaggctactggagtgcaatggcgttatcttggctcactgcaacctctgtctcccgggttcaagcgattctccgcctcagcctcctgagtagctgggattacaggcacccgccatcatgcccggctaatttttgtatttttgtagagatggggtttcaccatgttggccaggctagtcttgaactcctgacctcaggtgatccgcccgcctcggcctcccaaagtgctgggatcacggggatgagccatcgcacctggccaagaggaagtattttttttttctatcctgctctttctgaaaagcttgaacatttttctgtactttccttttcttttttgagacagggtcttgctctatcacccagaatggagcacaggggtacaatcatggctcactgcagccttcacctcccgggctcaagcaatcctctcacctcaccctcccaagtagctggaactacacacaggcgccaccacatccatctaatttttaaaatattctgtagagacagggtctcactatgttgcccaggctggtctcaaacttctgggctgaagcaatcctcccacttcagcctcctgagtggctgggactacaggcacatgctatcatgtctggctaactttgttttttatagagacagggtcttttgctgtatttcccagggcggtcttgaactcctggcttcaagtgatcttcctgccttggcctcccaaagcactgggattatggccatgagccaccacgtaatctttgttttatgcgtatttataagctttgcttccccaacaagattataagctctttgattgaagtacatcatatatttgatatgtattctcttgtccaagtgtttctgtaggcaataaggggaactttgtaaaacaagagttttccggtcaagtaaatttgagaagcgctgcctaatctcttccccctcagagatttgcaatgcatattgacctattaaaggctctgagaattcttcctgcgaagaaacctattttagccttgtccaccttgcatttcccaaacacgtttgacctcagaactccctttttcactaagaatgttttgcccatcttatgttttacccatgtgctctatagcagttaacactgggcttattaaaggtactcaatatgtgattgtaaattaactggtgaagcattccctcattcttgtttattttatacatttatttaatgaagcccttttcatagaaattgtcaagataaatgtatcctcatttagatcaaaacaaattctaaattaatgaagtcatgacattttactgtattttggtttttttggtttatctgtgaagtcctcaaacctgtgagtagtgctgaccctagccttgaatgaacagccctgtactaactgcaaggccagaagaacccctgcccttcccctccccacccccccacatcatttccagaagttctaaagaacagttgaaatttacggagatcagactgggttgagtgtgggatttccagggtgggttctagaaggagaagtgggtcttctgtagtttgttgaaattttattttccaaacccagcccccaagtttttcttcctctatttatgtgcaaggacaaaacagttactgtcctacctacataggatatggactctgtctgctctgagcccattttagtttagaatatagagacctccctccaggtcctaagagagagattccatgagagatgtgcaacaccataaggttggtgatttgtactttgaaatggctgcctttatttcctttaaagtcaatatcttatatttgaataaacacagtttgcaaagcatctttacagaaatctcattggatcctcacggtcaccttttttctgagacagagtctcactctttcacccaggctggagtgcagtggagcgatcttggctcctccacttcctgggctcgagtgatcctccttccttagcctcccaagtagctgggaccacagatgcgtgccaccatgcccagccaatttttgtatttttggtagagatggggtttcgccatgttgcccaggctggtctcaaactctgcagctcaagcaatccacccgccttggcctcccaaagtgctgggattacaggtatgagccactgtaccctgccctcacagtcaccttttgaagaacctcctgctcaagagatcctcctgcctcagcctcctgagtagctgtgatgactacaggcttgtactaccatgcctggctagtttttttattttttgtagagacggggttccctgtgatgcccagggtggtctcaaactcctgagctcaagccatcctcccacctcagcctcccaaagtgctgggattgtaggtgtgagccactgcacctggccaagcattagttttaatcttgttttatagatgaataaactggggctgactcaaactgactcaaagtcacactgtcattacctttttgatcctgtacgttagactgggctgtatgcatgttcttgctggcgcaataaagttgcaagtgccagctaacagcccttcccactccacctcaccacctcatagaggaaaattgtgacgttaatgggaaatgtcagcggtaatgtcttcaggctgggcctgtggagtgactcccttgccacaggatatttaagcaatgctgtgtcttgtctgaggctcagacctgctattcttattggcacttgggacctgcatggtttttggcttcacctccagctttagccatttttcttctgttcttttaggtaaggattttctgccccagacctcagattcccatttccttcctagcttctctgctgttatagctcagtctcttccaagaccatgcaagattcagaccctagtaggaggagatggaggaactaggacttaaacccacatcttgtgattccaaggctggttcctcttttgccctgcaccacacagctgtctgctcacagtcatgtgacaggggcttccccagccagaacctccagggagcacaaataaaggaaagagctggaaggcacagtacagcatttgttctgtccaagccttacatatcagcatgggcagggagaatgtggtgaagttttctttcaaggactttgtttgataaggaaggacatttatcagtgaagagaggttttgagggaagtgaaccaatcttgagataagtacacaaaagagctttgagtctggtgtttccctgtttgcttctgccccctggaggagcaaatactccatgattagagacgtgtgagtcctttggaatagaatagcagtgatggaactggagtcctagtccaggttctctccttgttcagcctggattcagcactgggtatcgaaacaagcctgcaccctcagaggagatggctaggggacagtgcgtccaggcctcttctaccacacagagttttcttttttttataaagggtatacacatttaaaatttaatgatactcccaaattgctcttcaaaaaggctgtgcaaaattacagtcctgataacagctacccagagatcctgtaacggcatttgccctcatcattattattattattattattattattattattatttgaatttgagacggagttctgctctgttgcccaggctggagtgcagtggcgcaatcttggctcactgcaacctctgcctcccgggttcaagcaattctcctgtctcagcctccctagtagctgggattacaggtgagcaccaccacgcctggctaatttttgtatttttagtagagacggggtttcaccatattggccagactggtctcgaactcctgacctcaggtgatctgcccgtctcggcctcccaaagtgctaggattacagatgtgagccactggggctggttgccctcactatttaatgggttatttgcaacctgtgaatcatgtctcctatttccttgttaatgatgcttattgattatagacttaggaatatcagcacctcctttgtagctcttcattcttacatgatataataattaatttttttttttgagacagagtctcactctgttgcccaggctggagtgcagtgtcacaatgttggctcactgcaacctccacctcctgggttcaagcgattctcctgcctcagcctcctgagtagctgggactacaggtgcgtgccactacacctgactaatttttgtatttttagtagagacagggtttcgccatgttggctaggctggtcttgaactcctgacctcaggtaatctgcccgcctcagcctcccaaagtgctgggattacaggtgagccactgcgcccagccaataattcattgtttaatccttagttgtgggccaagcaaaggagaaaagtaagaagccttttccttttaccgataggaaaggtcaaaggacttacctggtgaattatttacctaaaaatgtatacaaatcactccaaaatttagtggctaaaaacaacagtactaatttaattatatcttcacagttactaatttaattatatcctcacctgtgggtgaggaatttaggagcagcttagctgggctgttctggcccagagtctagtgaagttgtggtcagttgtcagctgggtcatctgaatgcttgattgggattggaggctccacttctatggtggtcactcacatgactgagaagttggtgctagctgttggcaggaagcctgttcttcatgtgggcctctctgagggactgcttgagtactttcatgatgtggtggtgggcttctcccagagtgagccactcagaagagagaaagattgtgaggtctggacttcaataagaagattgttgaagaaaaaaaggttttgtccccccttggtttgattggactagagtgggctcagtctgtgcctgtggctggcatcaggcaggaacagtggtatagcagggtatagaccatatttagggacctaaaatcacatctttcatgattcatgtggttcttgttccaactgcccaggactcaggcacatcaaaatatgacacaaaagcagaagcttttcataatggagattagaccatgtctaggattcctacccagtcctcttgagctctcctcactccagtgttgttttccgtgtttgttttttgttttccccagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaaggtgagcccccaggaggtggtcagttccggaccacctgcttattttcgtgccaccaggatgggaattaccactgtgccacatttgctgcccatctcttccgggaggaaaagagattttccctcctgcattgggcttgccctaggactacagtatagacccggcatgatttataaatactttgtagttagttagtttgtagtttgaatacttttctttaaaattaagaaattttcagcctgggcaacaaagtgagaacttgctctataaacatttttaaaattagttgggtgtggtggtgtgcgcttatagtcccaactgcttgggaggctaaggtaggaggattgcttgagcccaggagtttgaggctgcagtgagtcgtgattgcactactgcactgcagcctgagcaacagagggagaccttgtctccaataaacaaataaataaatacaaataacaaatttatttatttttatttatttttttttttgagatggagtcttgctctgttgcccaggctggagtgcattggcgcaatcttggctcactgcaacctccacctcccaggttcaagcagttgtcctgcctcaccctcccaagtagctgggattacaggcatgtgccaccacgccctggctaatttttgtatttttagtagagactgggtttcaccatgttgaccaggccagtcttgaactcctgacctcaggtgatctgcctgcctcagcctcccaaagtgctaggattacaagcgtgagccactgcgcctggccacaaatttttatttttaatttttctttttttttttttttttttttttttgagacagagtttcactcttgttgcccaggctggagtacagtggcatgatcttggctcgctgcaacctccgcctgctgggttccagtgattctcctgcctcagcttcccgagtagctgggattacaggcgtccgccatcacacctggctaatttttgtatttttagtggagacagggtttccaccatgttggccaggctggtctgcaactcctggcctcaagtgatccacgtacctcggcctgccaaagtgctgggattacaggcatgagccaccatgctcagccaccttccagatctttttttatttgatacccacacagtcatgtagaagtatatcttttttgtttgtttgttttttgagatgacatctcactctgttgtccaggctggagtgcagtggcacacctcggcttactgcaacatccacctcccgggttcaggcaattctcctgcctcagtctcctgagtagctgggactacaggcgcacaccactacggctttgctaatttttgtatttttagtagagatggggtttcaccatgttggccaggctggtcccgaactcctgacctcaagtgatcctcctgccttggcctcccaaaagtgagccactgcgcccagcctggaagtatgtttgtaagcccagatggaatcatcatctattgtttcttttttttaattaaaaaaattttaatacagttcaaatccccatgtctggctcatttcagctcctttactgccaaagcaggggacaaggactgcttcagtttctctgccttctctttctctgaaggtatctgctgcattgaacttgaaagttcacattatccttatttttcttgatcttgacagatttggcatcctttcacctggctgtgagcagaaagtccttgatttcctcaattttgcaaggcatggcgatgaggcacacagggagaggacaaggacaggcacccctctatcccatgtatcacccaaaagacactcacagcctgccatcactttataacctgcttttagtttgtttaacagtagatcacaaacatttttgcatgtcagtagtcacatttctacagcatcagtttaatgtatgcacaatagcccataatatggccatagcttaatttacttgatcaatcttcagttgttgcacagtgtttgctttcatacgaagtaagtattaaacatccttgtaacttagtatttgttcttatccttaattgttttctagggggacaattcccggaagtggaattacagagtcaaaggacatgcatttttcaagcctcggatgcatcttactagatgtcctataggatggtcatatcagctttataggagagtagctgtgtccctgaattctccctgacactgcatgctcttatatttcctcaagttttgacaatttgataggtgaaaagtggtatctgactgttcagatctggaaggctttgttatataaacatttttttaatgtttattggcaagaatacttttctaagagaaacatcagtgagctggtttccatttaagctgaatgaagccacaatgtacctcaagtataagattaactggcctttttcagttgcactctaattacaatttagaatgatgtttctgagccacctgtcaaatgcattctgggctgtacctctgcgtaccccaggaataaatctcatggccttctttacctggcctccttagtggtggcccagcaggaagcgggggttagagcaggagccactcagccttccaagatagatactccatgggccggtggtattactggccttttgagcccatccccatttgcatagatgatccacgtgggttatcatctggctggtatgttcccagagtgaaactcagcagccccttgagggaggggatggtggccatcaggccagagtattgcaagttagtttggatcatttgctaagcagcttgtggtgccttcagaaaggaacagtttcaaagaactttcacatctgttggctcatttcgccctaatgacagtcttctctttgatatttgcatggcattaaattttgcctttcttgttttctccagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacagctagtcaagtatatctttctctgatttgatagtgtgacctaaaaggggaccattgtttgaaatatcattagagttgcttattattattattattattattattattattattattattattattgagacagagtttcattctgctgcccaggctggagtgcagtggcatcatcttggctcattgcaacctctgccttctgggttcaagcgattctcctgcctcagcctcccgagtagctgggattacaggctcctgccaccacacccggctaatttttgtatttttagtggagacagggtttccaccatgttggccagcgtggtcttgaactcctgacctcaggtgattcaccagcctcggcctcccaaagtgctgggattacaggtgtgagccactgcacctggcctattattatttttaaattttttttttttaattgatcattcttgggtgtttctcacagagggtgatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcactgcccttaatccatttaaccctgagtggacacagcacatgtttcagagagcacagggttgggggtaaggtcatagatcaacagcatcctaaggcagaagaatttttcttagtacagaacaaaatgaagtctcccatgtctacttctttctacacagacacagcaacaatctgatttctctatcttttccccacctttcccccttttctattccacaaaaccgccatcgtcatcatggcctgttctcaatgagctgttgggtacacctcccagacggggtggcggctgggcagaggggctcctcacttcccagatggggcggccaggcggacgcgccccccacctccctcccggacgggatagctggccgggcgggggctgaccccccacctccctccccgacggggcggctggccgggcgggggctgacccccacgcctccctcccggacggggcggctgccaggcggaggggctcctcacttctcagacggggtggctgctgggcggagacgctcctcacttcccagacagggtggctgtcgggcggaggggctcctcacttctcagacggggcagctgcgggcggaggggctcctcacttctcagacggggtggccgggcagagaagctcctcacatcccagacgggggggcggggcagaggcgctccccacatctcagacgatgggcggccgggcagagacgctcctcacttcatcccagacggggtggcggccgggcagaagctgtaatctcggcaccctggggggccaaggcaggcggctgggaggcggaggccgtagccagctgagatcacaccactgcactccagcctgggcaacattgagcactgagtggacgagactctgcccgcaatcccggcacctcgggaggccgaggctggcagatcactcgcagtcaggagctggagaccagcccggccaacacagtgaaaccctgtctccaccaaaaaaatacgaaaaccagtcaggcgtggcggcgcccgcaatggcaggcacgcggcaggccgaggcgggagaatcaggcagggaggctgcagtgagccgagatggcagcagtacagtccagcttcggctcggcatcagagggagaccgtggggagagggagaagagagggagggggagagggctatttttaaaattttttaaaattgctgaacaggggtacctctgggcagtgtgtcagaataccactttttaaatattttatgatttatttatttttctatttcttgaggttttaactgatgtgtatctgtatgtctatttgtgtatattttgtcatgatcatgtaacagagtctgaaaagtgtcgaagagacagttttcaggaacaacaagcaattattcctactttccaagttattttgatgccatggtggctcatacctataatctgagtactttgggaggctgaggtggactgatcacttgagcccaggagtttgagaccagcctgggcaacatagcaagactccatctctacaaaaaaagacaaaatttagctgagcgtggtggcgtgttcctgtagtcccagctacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagagatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcggtggctcacgcctataatcccagccctttgggaggccaaggcgggcggatcacgaggtcaggagatcaagaccatcctggctaacatgtaaaaccccgtctctactaaaaatacaaaaaattagccaggcgttgtggcggtcgcctgtagtccctgctatttgggaggccgaggcaagagaacggcatgaacctgggaggtggagcttgcagcgagctgagatcttgccactgcactccagcctgggcgacagtgcgagactctgtctcaaaaataaataaataaataaataataaataaaatgtttggaatgttggcttcatccctgggatgcaaggctggttcaacatacgcaaatcaagaaacataattcatcacataaacagaactaaagacaaaaaccacatgattatctcaatagatacagaaaaggccttcaataaaattcaacgttgcttcatgttaaaaactctcaataaactaggtattgatggaaaatatctcaaaataataaccatttatgacaaacccacagccattatcatactgaatgggcaaaagctggaagcattccccttgaaaactggcacaagacagggatgccgtctcaccactcctatttaacatagtattggaagttctggccaagaaaatcaggcaagagaaacaaataaggggtattcaaataggaaaagaggaagtaaaactgtgtttgcagatgacatgatactatatctagaaaaccccattatctccacccaaaagttccttaagctgataagcaacttcagcaaagtctcaggatacaaaatcaatgtgcagaaatcacaagcattctatacaccaacaatacacaagcagagagccaaatcatgaatgaactcccattcacagttgctagaaagagaataaaatacctaggaatacagctaataagatgtgaaggatctcttcaaggagaactacaaaccactgctcaaggaaataagagaggacacaaatgaaaaaacattccattctcgtggataggaagaatcaatatcatgaaaatggccatactacccaaagtaatttataggttcattgctattcccattaaactactattgacattcttcacagaattagaaaaaaactactttaaaattcaaatggaaccaaaaaagagcccgtataaccaagacaacaataagcaaaaagaacaaagctggaagcatcacactacccaacttcaaagtatactgcaaggctacagtagccaaaatggcatggtactggtacaaaaacagacacatagaccaatggaacagaatagagaccagagaaagaagaccacacatctacagccatctgatcatcgacaaacctgacaaaaacaagcaatggggaaaagattccctatttaataaatggtgctgggaaaactggctagccatatgcagaaaattgaaactgaccccttccttacaccttatacaaaaattaactcaagattaaagacttaatgtaaaacctaaaactataaaaaccctagaagaaaatctatttaataccattcaagacataggcacaagcaaaggtttcatgacaaaaacatcaaaagcaattgcaacaaaagcaaaaattacaaatgggatctaattaaactaaagagctcctgcacagcaaaagaaactatcattagagtgaacaggcaacctacagaatgggagaacatttttgcaatctatccatctgacaaaggtctaatatccagaacctacaaggaacttaaaacaaatttacaaggaaaaaaacaaccccatcaaaaagtggacaaaggacatgaacagacacttctcaaaagaagacatttatgtggccaacaaacatataaaaaaaagctcaaccttactgatcattagagaaatgcaaaggagaaccacaatgagataccatctcatgccggtcagaatggtgattattaaaaagtcaaaaaacaacagatgctggcgaggctgtggagaagtaggaacacttttacattgttggtgggaatgtaaattagttcaaccgttgtggaagtgtgtgtggctattcctcaaagatctagaactagaaatactatttgtcccagcaatcccattactgggtatatacccaaaggaatataaaccattttattataaagatacatgcacatttttgttcattgcagcactcttcacaatagcaaagacacaatagcaaatgcccatcaaagatagactggataaagaaaatgtggtacatatacaccatggaatactgtgcagtgcagccattacagcttttggtgatacagtgaatcagatttttcattaattcttttaattggttattactgaacgtgaaaaagtaatgtttgtattgaaatcttgagtctggccatgtttctattttaaattcataaagaattctaacaagaggaattccaagaatgtcataaatggatgtttctccatggatgaaggaactgttttattcacttgctgataattcagcctaatccagtttgacatcatatagataagtagttgaattatggatttaaaatacatatcattttctaactccaaaggtaatacttatttaaatggttttgaaaatatagaaaggcacaatttctttttaaatctgttattctccaccaccactcaatctgtctatcatctatctctccattcattcttccatttgtttatatctgttaatctttgtatgtgttcatgtatagcttttacatgattggaatcataatgcatattccattttgaagtctgcttttttttacacaaaaatatgttgtgaatattttcctatattatgaaatatcattagctgagcttttagaattgactgcatgttttggtaccatttagatatagtttaagatacttagaagttatgtggctttgccactatggatgaatcttatttactcaatattaattacttacaaataacctcacctaaacactactcagccataaaaaggaatgaattaatgacattcacagcaacctggagactattactctaaaggaagtaactgaggaatggaaaaccaaacattgtatgttctcactcataagtgggagataagctatgaggatgcaaaggcataagaaggatacaatggactttggggacttaggggaaagggtgggaggggggtgaaggataaaagaatacaaattgggttcagtgtatactgctcaggtgatgggtgcaccagaatctcacaagtaaccacttaattacttacgcatgtaaccagataccacctgttccccaaacacctatggaaataattttgtttttttttttaaaaaaggaatgagatcatgtcctttgcagggacatggatgaagctggaagccattatcctcagcaaactaacagaggagcaggaaaccaaacaccacatgttctcacttgtaagcggaagctgaacaatgagaacacacggacacagggatgagatcaacacacactggggcctgatgcaggggccgtagcggggagagcatcaggataactagctaatgcatgtggggcttaatacctaggtgataggttgataggtgcagcaaaccaccatgggacacgtttacctatgtaacaaacccgcacatcctgcacttgtatccagaacttaaaatattttaaaaatctttagagaatacaaaaaaaaaaaaaaagattcttcaatgcatacacaataaaattgcagttcagtcaaacattggaagtctttctctgactgtctagttggtatcttcattttcagcttcttcaagatcccactccaaacactgttagctcagccaaattgaacagctcatatctcctacctctggatctttggttctggtgattgtatatttctggaccatctggaaccccagcatatcaccctaccccacatctccacatccccaaaatataaccatacttcaagggcagttcaaataccatctccttctatcctccatgaagtcagttatctcttccattggaattatcgccccctctcctgaacagtactatttcgtgtgaatctcctccaagccttcttttcattttatatctcatgctgtaattcttggaaagtatgctgtagctcaagtgcagaattctcatcagttttatctttatatctctcctaaacactttacctgatgaagagcctggcatacacataaatatatattgaatgaatcagtgatggattgaaaagagaaatgatggatctcctaaattttaacttttataaaatattttgatacattcatgaccttactttagcaagcaatgaacgtgatgtaaactattgttgatatagtttttatattggaagtgtaagtagtttgtggcatgggattgtgacatatcctaggtttcctcatcttctttttattgaaatgtaattcacaagccataaaatttgcccctttaaagtaaatgatgcagtggattttagtatatttacagagttgtgcaatcatcaccactatctaattccagaacatttccatctacctagaaactccataccagtgagctgccactctaatcctcctcttcccccagcctctagaaacaataatccattttctgtctctatgatttgcctgttctagatattttataaaaataaacatgtggcctttcgtgtctgacttccttcactta

SEQ ID NO: 1215 - DNA, 32415 bp, Homo sapiens
gaccttggactgaaccactattgaagatttatttgataataatttgtaagttttaactcagtacctcccttctgcttttatagttcaaggagcagggacaagttacaggaatgttctccaagcagcaatccaaaagagtctcaaggatccttcaaataacttcagggtgagtctggagaaaacatatggaatcccagcatgaaaccgtttcagagttctaataaaaatatgcatattctcacagcatgtactttatttaatatctgaaaaaattgtgatagaaatgtgtatttgttttaaaaacgtgtaacttcttatatttcaaagctaatacatgttcattgagatatttggagactatagagaaagataaaagaaaataaatcacctatattccactatccaaagacaaccactgttagtattttggtatatttccttctagactcttttttatgtgggtttgcatctgtatctgtatgtatgtatatatatatatatatacatacatacatacatacagttggacaattggacatttttttcactgttcatttattcacttgaaattgtaacttaaaaaaagaaaatgtaactttaaaaataaaaatagatgcaccatgcctatggaaaaaaatttaaatgtactacaagaggttttaaaagtatttttttgcccgggtgcggtggctcatgcgtgtaatcccagcactttgggaggccgagccggaaggatcacctgaggtcaggagttcgagactggcctggccaacatggtgaaactccatctctactaaaaaatacaaaaattagccaggtatggtggcaggtgcctataatcccagctacttgggaggctgaggcaggagaatcatatgaacccaggaagtggaggttgcagtagccaaatcgcgccattgtactccagcctgggtgacaagagcaaaactctgtctcaaaaaaaatgttttcttcctacccctataatactgacctccaattatttttcctaaaggcagctgttgtgaactagttcattctgtaactatccagagatagtctacacatatatttcatttttgcttttttctcttctacagatgataacaccctatgcccattgtcctgatctgaaaattcttggaaattgttccatgtgattaacatggaactgcctctacttaatcattctgaatgattaaatcgtttcattttctaaatgtgttataatgtgtttagccctttcttgttgctgtatgtttagatgctttccaatcttttgttactactaataatgctataaaataaatatccttgtacttctttgtgcatttgtttttttactgagctaattttaatgatttcagcaaaagttattttgttattgagtgatgaaacaaaagatttttgagggtgttcatgagcataagtgtatcatatagtcacttatggttgttgtgttcctagtacttagtacaaggtatcggaattgttctttagttaatcttttatcttgagaagttaaatcttggtgtaatcttatcctcatgttcatataaagatatgtggagtttgtagtgaggacttagagccgggtacaatttcatggttaaattagaaatgcttttggcagtgttaacagctcttttagaatttgtctagcaggcttttcagtttttgccagaaagccctaaaaaaaaagaaggaaaaaaatgcttttggctgagtgtggtggctcacgcctgtaatcccagcactttgggaggccgaggcaagcggatcgcttgagcccaggagttcgagacaaacctggtcaatatgtcaaaaccccatttctacaaaaaatacaaaaattagctgggcatgatggtgtgcctttagtctcagctacttgggaggctgaggtgggagaaattgcttgagcctgggaggttgaggctgcagtgaggtgtgagtgtgccactgcactccagccctggtgacagagtgagaccttgtctctaaaagaaaaaaaaatattatatatatatatataaatgctttccttaaaatatgtaatgaaaacccactcttgtaatataaatggtttcttggagaatatgtctgtaagagacactactgagcaatgcaatttcagagctaaaatggatttacggattatattatccaactcccttaatgaacaaaataaggaaacttagccctaaagaacattaactgattgtctacttctaactactagcagagctgggcccagcccatactcctttcactgcactgtgatgtatataataaactatatacttgtcataccatatcttagagcatactttttgtttttttgagacagagtttcgttcttgttgcccaggctggagtgcaatggcgcgatcttggctcaccgcaacctccgcctcccgggttcaagcgattctcccacctcagcctcccaagtagctgggattacaggaatgtgccaccacgcccgggtaattttatatttttagtagagatggggtttctccatgttggtcaggctggtcttgaactcccgacctcaggtgatctgcccgcctcagcctcgcaaagtgctgagattacagacatgagccactgcacttggcctagcatatattttttaaaagaatgaaatgtgctttgttttgtccttctgagtctctgtaataccaaataatgagaaaaagcagatttaggattcagatccaggttttctgagctttctctgctattgtctgtctaatataaattatattgtcattcttagttaaaaaacctgccatatttttactattgtgtttctattttgtaaatgaagcatattcattgctatgtagcctgttgtgagcccatatgctttgcatattagtttctccttaaactttctatatttaatatgtgaccctaaggccgggtgcagtggctcacacctgtaatctcagcacgttgggaggccgaggcaggtggatcacctgaggtcgagagtttgagaccaacatggagaaaccctgtctctactaaaaatacaaaattttccaggtgtggtggtgcatgcctgtaatcccagctacttgcgaggctgaggcaggagaatcacttgaacctgagaggcggaggttgtcgtgagccgagattgtgccattgcactccagtttgggcaacaagagtggaactccgtctcaaaaaaagaaaaaaaaaagtgaccctgattattcattcattcatttagtaagcaggcactatggcatatgaatgcagtgactttcttaaaaggtttaggagccgaatacctagaagttaattcatatgaggctgcagaagtgcttcaaaaattactgtatgattaaatgccacaggataccacaagatattatagaattaaaaaattatggctgggcatggtggctcacacctgtaatcccagcactttgggaggccgaggcaggtggatcatgaggtcaggagttcaagaccagcctggccaagatggtgaaaccctgtctctactaaaactacaaaaattaaccaggcgcagtggcaggcgcctataatcccagctactctggaggccgaggcaggagaatcacttgaacccaggcggcagaggttgcaggcgccactgcaccccaccctgggtgacagagtgagactctgtctcaaaaaaaaaaaagaatttaaaaattatttggctacaatacaatgcttttaaaatccatctttgatttgatatgttacctctctctaataatatgtaaaagcgaatacacatgcatgcggccaatttctatctgatatgatcagcctctggctaagttactaattattagtgaaaaaggcaacttacatgtttttaatttagacacacagacttagctactgacacagcttaacagatagtgtatttcactcttttggctaggttagcttcagagaagaactgtcatttgaaagctgagtgtctcagatgggttgacagcatgtggtatgtgtatcttacataggacctgtcatctgagaagagaaagggtcggtttaatctttcattctctgattactcttactctagccctcagaagtggtttatcaagaatatttgattatcaagaatcaggaccatatgttgcttatgtgtagctaggcaatgatagaaaagcaataactggacatttattatgtacttccatgtgcttggcactgtgctgagtgctttgtgtgcatttaatcttcatacaaaatctgtaaggtatctattattatcctcatttagcatatgaagaaacacacatacagaagttaaataacttgctcgaggttacatagctaataagtggcagaattaggattcctagccaggtctgtctggcctagaaatccgactcttaaccatgctgtactttgcccctgtgttgaaggaacaggtggaatgtcaatctcatgttccaacagcttatcctaacctggagctatgctagcaactatactatactgtaacatcagattttattgggctgttttgaaacattctaatatgctagcttagcatatttttcttttctttttttttaatttttgtgacagagtttcacttttcactcttgtcgcccaggctggagtgcaatggcaccatctcagctcactgcaacctctgcctctcaggttcaagcaattctcctgcctcagcctcctgagaagctgggattacaggggcacgccaccatgcccagcaaatttttgtatttttagtagagatggggttttaccatgttggccaggccggtctggaactcctggcctcagatgatccacccaccttggcatcccaaggtgttgggattacaggtgtcagccatcgctcccggcctattttcatcttttaaaagcagaatttccctgttctttggtaatatgatacgggatttatggagttaacagctcttgctattctttagataatttaactgttgggacgatatttttatttttttcctgagttaagaatcctattgagacatttaaagaggtgtaatgtatagtgtacctctgaaataactaacaggaagtatgaccttattctttgtatttgaagctccataatgggagaagtaaagaacaaagacttaaggaacagcttggcgctcaacgtaagaccacctttttttaatattcattatttataaatgcttgataattctagtacaaatattgcatttttagagttggtcatttcctttatctacataatctaagtaagctctcaaaataaaaactggttaaactcttacgatagactcattggcatttctagttgtctattgaattagcttatctaagtttgaacaccatcgtactccatcagcttcatcatcttggccgtatgttaagagatgtgatgtttataactgaaatggaatggagctctaatcaggccatgttaaacattgatccaaccatgataatgaaccatgttaaaccaaatatctagcagcaggaagaggaatggtaaataagttcttgtcttacagcctatttaataaatctggatactctacagatgatatcccccctttcctaagaaagaaaacgtgcaatttaaagatgggtcatttcaacccgcatgagctgttttctctcttaaaacattagcacttgatcccatagatcattttttaaaagattactcttttttttttttggagacggggtctcactctgtcacccaggccggagtgcagtggtacacttttggctcactacagcctccacctcctgaattcaagtaattctcatgcctcagcctcctgagtagctgggattaaaggcacgcaccaccacacccagctaatttttttcttatcttttcttttcttttttttgagacagagtcttgctctgtcacccaggctggcgtgcagtggtgcaatctcggctcactgcaacctccgcctcctgggttcaggtgattcttatgcctcagcctcctgagtagctgggattacaggcttgtgccaccacacccagtttatttttgtatttttagtagagatggggtttcattctgttgcccaggctggtctcaaacttctgacctcaggtgatccacccacctcggtctcccaaagtgctgggattacagggatgagccatggcgcccagcctaatttttgtatttttagtacagataacgtttcatcatgttggtcaggctggtctcaaactgctgacctcaagtaatccaccaccttggcctcccaaagtgccgggattacaggcgtgagccactgcacccagcaaaagtttacttcttttgcttgtcttgagtcctccttgaagtgagagctgagactcagtcttacactgatgaggcacatggctgtggttccgaactccaggaaacggattgatgggctgtgatggagggcttcagtcttatccaagaggcttggaatctgtcctgtgtgtggtgggacatcatgaatgttttgagtagggcagtggcctaatagaagccctctttgtgtggcagtccccttacagatatcttacgactcagtctttgtgctatctgcacctggaaacttattttgcccggattagtcagctggtgtagctcatgtctgtcattctctacctaatattgtgctctccagcaaaaactactgagaagcgaattaattcctgaaatgatagcatgtttcttaaaacactggtgaggtgatgagaattagtattccgaagcctgtttaaagggaaaataggagacctagtagatttgcataggaattaaaaacaattggtgttctttccatttgctccctgatggcaattttatccttggtcataattgtacagatgaggtaagtgagaatccaaatatccctatgatcctgttaggagagctgcttacttgctcttgcttggacttggtttatttgctaataaaagaaaaaggtttctgggctgggcatggtagctcatgcctgtagtcccagcactttgggaggtcgaggtgggtgcatcacctgaggtcaggagttcaagaccaacctgggcaacatggtgaaaccccgtctctactaaaaatacaaaaattacctggtcatggtggtgcatgcctgtagtcccagatactcgggaggctgaggcaggagaattgcttgaacctgggaggtggaggttgcagtgagccgagatcttgccactgcattctagcctgggcaacagagcaagaccctgccccccaccccagaaaagctttctaataacttgggcttaatttaatagaagtttaaaatactcggccaggcatggtggctaacgcctgtaatcccagcactttgggaggccgagacaggcggatcacgaggtcaggagttggagaccagcctgaccaacacggtgaaaccctgtctctactgaaaatataaaaattagccaggtgtggtggcacacacctgtaatcccagctactcaggaggctgaggcaggagaatcgcttcaacctgggaggcggaggttgcagtgagctgagatcgtgccattgcactccagcctgggtgacagagcgagactccatctaaataaataaataaataataataatcaaaccaaatatttatattaatttggacttccaaatagatttgaactgttcagccatcattgaatttgatgaggatggtgataacttcaatttagtaatttcttgctaaatgccttaaactgagatagatatatcacatagattattttgtggcttttctttgtttgtttgtttgttctgttaatatataattgctaaaatacaaaaaatataaaatgaaatttcctctttcaagtatcagagatagctgctattaatgtttgatttttatgcctccagattcttttatatttaagcatatattaatacatgtgtaagtatatgtacacaaatatacatttttaagttcacagaatcaatattatacatatttttaataatccatttttcacttaatatatcctgtgtatctttttttaatttttttctttttttttggagacagagtctcgctctgttgcccactttggagtgcagtggcacaatctctgctcaaaactggttgttcttccacctccctgacctaatcaagtcatttttttctagcaaattagctttaggctcatctccatttgccaggctcactgcccccattgtcactgtcttgccattgacattttattttatgatctcccagtatcactggactatgaaaacagtgccatctgttttataactagcaaacacatataaactttccctgctctgcactctctaaggctgttccctttaggtattgtcaacagtttcagcacatataggaaagctatcagtattgttgggtggtgaggttattagattctcctatcaagttaaaaactcaccagccacctgttcctcacctagaacggggtaggggagagccttctttcacttgctgtttaagcagcttttccagatagcccctgatagcactgggacttgtgttttcttatgtcactttcttcagtgtgaggttgaaaccttggggccaagtatagctggggaaagaagagataattgaagaaaataggaagggagaacagttgttatacaaagaaactcagccagtgtaggggtggacttagctctccttcagctttgtaaatggtttctctctctcatcccccagaagaaccagtgaagaaatccattcaggaatcagaagcttttttgcctcaggtacagaataaatgatctgatttggtattatatgtacatagctgtggataaccctgacttctttaaaaatacctgtccattaagaattctttgagacagtgggactctgagagtgttgttctcctgagaacttccatacaagggaaccctgaataacaaagagaaagatgttaaagtggattgcattagtgaactttggaatgcagggaagttccaaagtagcactcctcatctcaactcagtgactgctgaacatattagtcagcagtgatacttccctgaactttggcttgttctggctttttcttaggttgacacctctttgtaagcagaagcaatagaagggctccctttgtacttgggaacatgccacttatataacttcaggttactgtggagacaaatcactcatgttttctctctttttcaaattatctttattccacaaagccaataaagagagtgggattttcattaaaattaaataaaaatgaaaataatttgtcttaagcacattaccctaatagaggaaaaatttgatattaatgggaaacatttgccgtaatgggaaacttcaggctgtgtctgttgagtgactcacctgccaaaggaaatccaaaagaagagatggtatatgggtgggaccttatagaaacagagcaatatccagagtctttagcatttcttgtcttcctttccagagcatacctgaagagagatacaagatgaagagcaagcccctaggaatctgcctgataatcgattgcattggcaatgagacaggtaggtgtggaagctgcagattaactggtgcccccagattgagatcatggcacaggcaagctgtattcattggagtgatcagcaccaactgccgtgacaaaccagttcaagaatctgtgcttcatcctgggtgcggtggctcatgcctggaattccagcactttgtgaggctgagatgggaggatcacttgagcccagttaaaaattagctggtgtgggctcgggcacggtggcttacacctgtaatcccagcactttgggaggcggaggcgggcggatcatgaggtcaggagttcaagaccagcctggccaatatggtgaaaccccgtctctactaaaaatacaaaaattagctgggcatggtggtgggttcctgtagtcccagctacttgggaggctgaggcagaagaattgcttgaacctgggaggcagagcttgcagtgagccgagatcgcaccaccgcactgtagcctgggtgacagagcaagattctgtctcaaaaaaaaaaaaaattagctggtgtggtggtgcacacctgtagtcccagctacatggtaggctgaagcaggaggatcacttgagcccaaggaggtcaaggctgcagtgagccaagatggtggcattgcactccagtgtgggtgacagagcaagaccctgtctcaaaaaaagaaaaaaaaaatgaatatgtgttacaacacaatagagacttgtttctcattcatgtcacaggctagtgtggatcgggctgggggagctttgttcatgtggctattcagtggctccattatcttctgaggtcttggagttttctacagagtcccttgcatctggctagcagataagggaagagagaatgtgtgaaggatctcacaagagattttagggaccaggcctaaaagtgataatgtgcatcatttccaccccattagattggtcagaactcagtcatgtggctccatctaactgtagtggacatggagaaattagtctcgctgtgtgtcaggaggaaatgaaatggatttgggggacacataacagtgtctctggcacaaagacatcatttacggtagttggtgagccttagtcttgccttttcttttggatgctgaagcagggaggagtcctggaacccagaggggcattaatattaatggaaggcattctggcttcacatattatcacatgccccatcatttcacctagatagacgacaaaagctttcctgggaacattaaagacataataaatgtgtgttcacttacagagctttggatattttctgagctgtgtcagtcagttctgctgtcctttgctttggtcgttggcctcagtctcttctatctgcgcgtcaccattgcttggatctgagatgattcttttgctcagttgttgttggatgtctgactcaaactgaatcactggtgctgcatcaaaagagaatgagaagagcctagataagtggaatgacattctgtttaattatttagctcttccttaagaggatcgatcattgtatttccagttttagagcttctcaacattctcttaaaatgagtcagaactatctttcaggctcacttaaaatgttaccatggggagttttatgggaagaaaggctaagagaaggtcaaattagcaaatataatactaaattttccaggatttcagatacgatcctgcttggtcgtgtcctatttttggttagatgtgagaaagataagtgtcttcttttcagccattagtacccatataagaatgagaaaatattttcttaatgagtcacttcctgttttaagagattatgtaattgtcctgtacttctggttttggtcagttttgtttcattcatcagtagatgttgtacgtatatctgttgtatgagagaatcataaaaaaaaaaaagccatgacctgctgtgaattgaaaaactaagttttttggctaaaactcaatgtctgtgcttgcttctgttgctgggttatgggcctcttgggggcgggggctgaatgtatatttgaatttttctgcattataggagcatgatcagagttgagaaatggaatatgacagtgtgggtttgaatcatggctatgccatgttctagcttgtgaccttgggcaatgtccctggcctctttattttttttaatgtttttttttttctttcttgagagagaatctcactcttgttgcccatgctggagggccatggtgcgatcttggctcactgcaacctcttcctcctgggttcaagcaattctcctgcctcagcctcccgagtacatccctgccgggaatacaggcgcccgccaccatgcctggctaattttttgtatttttagtagagacggggtttcaccatgttggccaggctggtctcgaacttgctgacctcaagtgatccacccacctcggcctcccaaagtgctgggattacaggcatgagccaccacgctcggcttctaattttttttaatttaaattttatttttatttttcctgtagtgctgagttctcggccttcttaagtcccagtttctcttctgtaaagtgggttaataacaggacctacctcatagggaggttgggcagaatgagagttcatacttggaaagggcttagaataatgcctggcacagtgtgagcatgtactagatgccaactagcattatttcctcatttgcttgttcaattctagccataaaccacctaagcaagagctcaccatggctttgcacttggtacatagagtctgatctcagacaagtgagagaccagggcactgaggcctgccctaggcccaagggtgagtggaatgcatccccatagactgaggcgcactggaatggaggccataacttgagagggttatccaacttcttggataaacactcaagtggaaagctgagcacagcactcctaccagtcacagtctgaatgggcttggcagaggagaatctaagtacaaagtacaggagggcagagacctgataaaagagaaagatggaagaagatggtagaattggaggcagagcctggggcatcatgcttttggccacaggtatgagcaggtattggtcttgactgcactggtacatctgtttcctgccccatggttgcggatgtatctgtatacgagctccaagaatcagaatggcagctctagacagcaggtccttcctggtcagacatagtcctttaaagttcaacatcttggtggtacattgctggacaagagtaggcctgggccattagagggtaccctggatgctcggtgctgcctttcccctgagaatcagggtgatttgactcaagccttctctgcctctgggaacaaaatcagtaattgggcttgaggccacttataaacccccctgggctcaggtggctaattagcaagtaagaaacaaggcagcacacttttactcttcttgtgctatggttttcatcagctgagaggtcacaaatccacttacatgcagactcagagcagcaggagaacattaattattaagaagtggaaaggcacagtctcctctcctcacaccatctccctaggcctccagctcttcatttccctcctcctctcctggtaatttgtcactgaagattctaggcccagaatcctgccttggttgaaaatggttgttattattagtgcagcacccttcatctcttttccttctaatccgcagttagggggcttcatctagagtaattatgtggatttcctctgtctggttaactttgccatctggttaacattgaacacttgggaggagtgcaggagtcagataatgaacaagcgggtaaggtaattgccagccgaaataaggtctctgaaagaaagaaacaagaacatgataggactaacctaggcatagctgtgctcagagtatataatttattaaaaatctactacgtgccaggtactttgctaattgctttacacggattcttgcttaatcctcatgaataataccataatataggtactattctctccattaaattttttttgttctacttagaactaatttgctaggaatattctattttcttttctttcttttttttttttttttttttttgacagagtcttgctctgtcgccaggctggagtgcagtggtgcaatcttggctcactgcaacctctccctcccaagttcaagcgattcttctgcctcagcctcctgagtagctgggattacaggcatgcgccaccacgcccagctaatttttcttttttctttttatatttttaatttatttttaagacggagtttcccttttgttgcccaggttggagtgcaatggcgcaatctcagctcaccgcaatctccacctcccaggttcaagcgattctcctgcctcagcctcctgagtaactgggattacaggcatgtgccaccatgcccagctaattttgtatttttagtagagacaaggtttcaccatgtcggccaggctggtctcgatctcctgaccttgtgatctgcccacctcagcctcccaaagtgctacgattacaggcgtcagccatcatgcctggcttattctctccattttcaaggtgaggaagctgagcagtgaactacactcctaccttctctagtactgattgagctgggattcaaaagctggactccaaaacctatgcttttaactactttgcctcaatataatttccatgaaggtgagggagtttatctatctcctactatgggtctccagtacctggaagaatacctgctatgtaggtgttcaataaataattgttgggtgaatgaatgaaggaataagctctcccagtgtcagtgtgtttctaaaagccattcctttttatctttagagtttagcagactctcttctacctatcttcccttctctcctcaaaaaaccagacttttatccaaaaagcatgcaagtcccccaagtatttaaagctttatttctttgtttgtccagtaaatgttcgttgagggcctactatgtgcaaagcaccatgcttggccctgtgtgaagcaaatattaaggcaatgaggtggagtctgatctcagagctgtgttgtgcatgaaataaggttattctttggtagttctttcttgagaagaattcttatggagttcagtaacctcttcttgaggcagaagtaaatgctcagggatttgggaactaattatctcagtttggtagaattgaaaaataagtctttggtgttgtgtcatctgtgtcagtgacagcaaagctggacctgtgctaggccctggtgggtcatctttaagcactggacttttatcttgttaggaatatagaagcaagcgtctcacatctctgacagatgggctttacggcttggcctaaagctctggttgtttttaaggcccttgaataaaaataaaagacgatgtttgcagattttaagaggaagttttttttttttttgagacagagtctcgctctgtcacccaggctactggagtgcaatggcgttatcttggctcactgcaacctctgtctcccgggttcaagcgattctccgcctcagcctcctgagtagctgggattacaggcacccgccatcatgcccggctaatttttgtatttttgtagagatggggtttcaccatgttggccaggctagtcttgaactcctgacctcaggtgatccgcccgcctcggcctcccaaagtgctgggatcacggggatgagccatcgcacctggccaagaggaagtattttttttttctatcctgctctttctgaaaagcttgaacatttttctgtactttccttttcttttttgagacagggtcttgctctatcacccagaatggagcacaggggtacaatcatggctcactgcagccttcacctcccgggctcaagcaatcctctcacctcaccctcccaagtagctggaactacacacaggcgccaccacatccatctaatttttaaaatattctgtagagacagggtctcactatgttgcccaggctggtctcaaacttctgggctgaagcaatcctcccacttcagcctcctgagtggctgggactacaggcacatgctatcatgtctggctaactttgttttttatagagacagggtcttttgctgtatttcccagggcggtcttgaactcctggcttcaagtgatcttcctgccttggcctcccaaagcactgggattatggccatgagccaccacgtaatctttgttttatgcgtatttataagctttgcttccccaacaagattataagctctttgattgaagtacatcatatatttgatatgtattctcttgtccaagtgtttctgtaggcaataaggggaactttgtaaaacaagagttttccggtcaagtaaatttgagaagcgctgcctaatctcttccccctcagagatttgcaatgcatattgacctattaaaggctctgagaattcttcctgcgaagaaacctattttagccttgtccaccttgcatttcccaaacacgtttgacctcagaactccctttttcactaagaatgttttgcccatcttatgttttacccatgtgctctatagcagttaacactgggcttattaaaggtactcaatatgtgattgtaaattaactggtgaagcattccctcattcttgtttattttatacatttatttaatgaagcccttttcatagaaattgtcaagataaatgtatcctcatttagatcaaaacaaattctaaattaatgaagtcatgacattttactgtattttggtttttttggtttatctgtgaagtcctcaaacctgtgagtagtgctgaccctagccttgaatgaacagccctgtactaactgcaaggccagaagaacccctgcccttcccctccccacccccccacatcatttccagaagttctaaagaacagttgaaatttacggagatcagactgggttgagtgtgggatttccagggtgggttctagaaggagaagtgggtcttctgtagtttgttgaaattttattttccaaacccagcccccaagtttttcttcctctatttatgtgcaaggacaaaacagttactgtcctacctacataggatatggactctgtctgctctgagcccattttagtttagaatatagagacctccctccaggtcctaagagagagattccatgagagatgtgcaacaccataaggttggtgatttgtactttgaaatggctgcctttatttcctttaaagtcaatatcttatatttgaataaacacagtttgcaaagcatctttacagaaatctcattggatcctcacggtcaccttttttctgagacagagtctcactctttcacccaggctggagtgcagtggagcgatcttggctcctccacttcctgggctcgagtgatcctccttccttagcctcccaagtagctgggaccacagatgcgtgccaccatgcccagccaatttttgtatttttggtagagatggggtttcgccatgttgcccaggctggtctcaaactctgcagctcaagcaatccacccgccttggcctcccaaagtgctgggattacaggtatgagccactgtaccctgccctcacagtcaccttttgaagaacctcctgctcaagagatcctcctgcctcagcctcctgagtagctgtgatgactacaggcttgtactaccatgcctggctagtttttttattttttgtagagacggggttccctgtgatgcccagggtggtctcaaactcctgagctcaagccatcctcccacctcagcctcccaaagtgctgggattgtaggtgtgagccactgcacctggccaagcattagttttaatcttgttttatagatgaataaactggggctgactcaaactgactcaaagtcacactgtcattacctttttgatcctgtacgttagactgggctgtatgcatgttcttgctggcgcaataaagttgcaagtgccagctaacagcccttcccactccacctcaccacctcatagaggaaaattgtgacgttaatgggaaatgtcagcggtaatgtcttcaggctgggcctgtggagtgactcccttgccacaggatatttaagcaatgctgtgtcttgtctgaggctcagacctgctattcttattggcacttgggacctgcatggtttttggcttcacctccagctttagccatttttcttctgttcttttaggtaaggattttctgccccagacctcagattcccatttccttcctagcttctctgctgttatagctcagtctcttccaagaccatgcaagattcagaccctagtaggaggagatggaggaactaggacttaaacccacatcttgtgattccaaggctggttcctcttttgccctgcaccacacagctgtctgctcacagtcatgtgacaggggcttccccagccagaacctccagggagcacaaataaaggaaagagctggaaggcacagtacagcatttgttctgtccaagccttacatatcagcatgggcagggagaatgtggtgaagttttctttcaaggactttgtttgataaggaaggacatttatcagtgaagagaggttttgagggaagtgaaccaatcttgagataagtacacaaaagagctttgagtctggtgtttccctgtttgcttctgccccctggaggagcaaatactccatgattagagacgtgtgagtcctttggaatagaatagcagtgatggaactggagtcctagtccaggttctctccttgttcagcctggattcagcactgggtatcgaaacaagcctgcaccctcagaggagatggctaggggacagtgcgtccaggcctcttctaccacacagagttttcttttttttataaagggtatacacatttaaaatttaatgatactcccaaattgctcttcaaaaaggctgtgcaaaattacagtcctgataacagctacccagagatcctgtaacggcatttgccctcatcattattattattattattattattattattattatttgaatttgagacggagttctgctctgttgcccaggctggagtgcagtggcgcaatcttggctcactgcaacctctgcctcccgggttcaagcaattctcctgtctcagcctccctagtagctgggattacaggtgagcaccaccacgcctggctaatttttgtatttttagtagagacggggtttcaccatattggccagactggtctcgaactcctgacctcaggtgatctgcccgtctcggcctcccaaagtgctaggattacagatgtgagccactggggctggttgccctcactatttaatgggttatttgcaacctgtgaatcatgtctcctatttccttgttaatgatgcttattgattatagacttaggaatatcagcacctcctttgtagctcttcattcttacatgatataataattaatttttttttttgagacagagtctcactctgttgcccaggctggagtgcagtgtcacaatgttggctcactgcaacctccacctcctgggttcaagcgattctcctgcctcagcctcctgagtagctgggactacaggtgcgtgccactacacctgactaatttttgtatttttagtagagacagggtttcgccatgttggctaggctggtcttgaactcctgacctcaggtaatctgcccgcctcagcctcccaaagtgctgggattacaggtgagccactgcgcccagccaataattcattgtttaatccttagttgtgggccaagcaaaggagaaaagtaagaagccttttccttttaccgataggaaaggtcaaaggacttacctggtgaattatttacctaaaaatgtatacaaatcactccaaaatttagtggctaaaaacaacagtactaatttaattatatcttcacagttactaatttaattatatcctcacctgtgggtgaggaatttaggagcagcttagctgggctgttctggcccagagtctagtgaagttgtggtcagttgtcagctgggtcatctgaatgcttgattgggattggaggctccacttctatggtggtcactcacatgactgagaagttggtgctagctgttggcaggaagcctgttcttcatgtgggcctctctgagggactgcttgagtactttcatgatgtggtggtgggcttctcccagagtgagccactcagaagagagaaagattgtgaggtctggacttcaataagaagattgttgaagaaaaaaaggttttgtccccccttggtttgattggactagagtgggctcagtctgtgcctgtggctggcatcaggcaggaacagtggtatagcagggtatagaccatatttagggacctaaaatcacatctttcatgattcatgtggttcttgttccaactgcccaggactcaggcacatcaaaatatgacacaaaagcagaagcttttcataatggagattagaccatgtctaggattcctacccagtcctcttgagctctcctcactccagtgttgttttccgtgtttgttttttgttttccccagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaaggtgagcccccaggaggtggtcagttccggaccacctgcttattttcgtgccaccaggatgggaattaccactgtgccacatttgctgcccatctcttccgggaggaaaagagattttccctcctgcattgggcttgccctaggactacagtatagacccggcatgatttataaatactttgtagttagttagtttgtagtttgaatacttttctttaaaattaagaaattttcagcctgggcaacaaagtgagaacttgctctataaacatttttaaaattagttgggtgtggtggtgtgcgcttatagtcccaactgcttgggaggctaaggtaggaggattgcttgagcccaggagtttgaggctgcagtgagtcgtgattgcactactgcactgcagcctgagcaacagagggagaccttgtctccaataaacaaataaataaatacaaataacaaatttatttatttttatttatttttttttttgagatggagtcttgctctgttgcccaggctggagtgcattggcgcaatcttggctcactgcaacctccacctcccaggttcaagcagttgtcctgcctcaccctcccaagtagctgggattacaggcatgtgccaccacgccctggctaatttttgtatttttagtagagactgggtttcaccatgttgaccaggccagtcttgaactcctgacctcaggtgatctgcctgcctcagcctcccaaagtgctaggattacaagcgtgagccactgcgcctggccacaaatttttatttttaatttttctttttttttttttttttttttttttgagacagagtttcactcttgttgcccaggctggagtacagtggcatgatcttggctcgctgcaacctccgcctgctgggttccagtgattctcctgcctcagcttcccgagtagctgggattacaggcgtccgccatcacacctggctaatttttgtatttttagtggagacagggtttccaccatgttggccaggctggtctgcaactcctggcctcaagtgatccacgtacctcggcctgccaaagtgctgggattacaggcatgagccaccatgctcagccaccttccagatctttttttatttgatacccacacagtcatgtagaagtatatcttttttgtttgtttgttttttgagatgacatctcactctgttgtccaggctggagtgcagtggcacacctcggcttactgcaacatccacctcccgggttcaggcaattctcctgcctcagtctcctgagtagctgggactacaggcgcacaccactacggctttgctaatttttgtatttttagtagagatggggtttcaccatgttggccaggctggtcccgaactcctgacctcaagtgatcctcctgccttggcctcccaaaagtgagccactgcgcccagcctggaagtatgtttgtaagcccagatggaatcatcatctattgtttcttttttttaattaaaaaaattttaatacagttcaaatccccatgtctggctcatttcagctcctttactgccaaagcaggggacaaggactgcttcagtttctctgccttctctttctctgaaggtatctgctgcattgaacttgaaagttcacattatccttatttttcttgatcttgacagatttggcatcctttcacctggctgtgagcagaaagtccttgatttcctcaattttgcaaggcatggcgatgaggcacacagggagaggacaaggacaggcacccctctatcccatgtatcacccaaaagacactcacagcctgccatcactttataacctgcttttagtttgtttaacagtagatcacaaacatttttgcatgtcagtagtcacatttctacagcatcagtttaatgtatgcacaatagcccataatatggccatagcttaatttacttgatcaatcttcagttgttgcacagtgtttgctttcatacgaagtaagtattaaacatccttgtaacttagtatttgttcttatccttaattgttttctagggggacaattcccggaagtggaattacagagtcaaaggacatgcatttttcaagcctcggatgcatcttactagatgtcctataggatggtcatatcagctttataggagagtagctgtgtccctgaattctccctgacactgcatgctcttatatttcctcaagttttgacaatttgataggtgaaaagtggtatctgactgttcagatctggaaggctttgttatataaacatttttttaatgtttattggcaagaatacttttctaagagaaacatcagtgagctggtttccatttaagctgaatgaagccacaatgtacctcaagtataagattaactggcctttttcagttgcactctaattacaatttagaatgatgtttctgagccacctgtcaaatgcattctgggctgtacctctgcgtaccccaggaataaatctcatggccttctttacctggcctccttagtggtggcccagcaggaagcgggggttagagcaggagccactcagccttccaagatagatactccatgggccggtggtattactggccttttgagcccatccccatttgcatagatgatccacgtgggttatcatctggctggtatgttcccagagtgaaactcagcagccccttgagggaggggatggtggccatcaggccagagtattgcaagttagtttggatcatttgctaagcagcttgtggtgccttcagaaaggaacagtttcaaagaactttcacatctgttggctcatttcgccctaatgacagtcttctctttgatatttgcatggcattaaattttgcctttcttgttttctccagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacagctagtcaagtatatctttctctgatttgatagtgtgacctaaaaggggaccattgtttgaaatatcattagagttgcttattattattattattattattattattattattattattattattgagacagagtttcattctgctgcccaggctggagtgcagtggcatcatcttggctcattgcaacctctgccttctgggttcaagcgattctcctgcctcagcctcccgagtagctgggattacaggctcctgccaccacacccggctaatttttgtatttttagtggagacagggtttccaccatgttggccagcgtggtcttgaactcctgacctcaggtgattcaccagcctcggcctcccaaagtgctgggattacaggtgtgagccactgcacctggcctattattatttttaaattttttttttttaattgatcattcttgggtgtttctcacagagggtgatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcactgcccttaatccatttaaccctgagtggacacagcacatgtttcagagagcacagggttgggggtaaggtcatagatcaacagcatcctaaggcagaagaatttttcttagtacagaacaaaatgaagtctcccatgtctacttctttctacacagacacagcaacaatctgatttctctatcttttccccacctttcccccttttctattccacaaaaccgccatcgtcatcatggcctgttctcaatgagctgttgggtacacctcccagacggggtggcggctgggcagaggggctcctcacttcccagatggggcggccaggcggacgcgccccccacctccctcccggacgggatagctggccgggcgggggctgaccccccacctccctccccgacggggcggctggccgggcgggggctgacccccacgcctccctcccggacggggcggctgccaggcggaggggctcctcacttctcagacggggtggctgctgggcggagacgctcctcacttcccagacagggtggctgtcgggcggaggggctcctcacttctcagacggggcagctgcgggcggaggggctcctcacttctcagacggggtggccgggcagagaagctcctcacatcccagacgggggggcggggcagaggcgctccccacatctcagacgatgggcggccgggcagagacgctcctcacttcatcccagacggggtggcggccgggcagaagctgtaatctcggcaccctggggggccaaggcaggcggctgggaggcggaggccgtagccagctgagatcacaccactgcactccagcctgggcaacattgagcactgagtggacgagactctgcccgcaatcccggcacctcgggaggccgaggctggcagatcactcgcagtcaggagctggagaccagcccggccaacacagtgaaaccctgtctccaccaaaaaaatacgaaaaccagtcaggcgtggcggcgcccgcaatggcaggcacgcggcaggccgaggcgggagaatcaggcagggaggctgcagtgagccgagatggcagcagtacagtccagcttcggctcggcatcagagggagaccgtggggagagggagaagagagggagggggagagggctatttttaaaattttttaaaattgctgaacaggggtacctctgggcagtgtgtcagaataccactttttaaatattttatgatttatttatttttctatttcttgaggttttaactgatgtgtatctgtatgtctatttgtgtatattttgtcatgatcatgtaacagagtctgaaaagtgtcgaagagacagttttcaggaacaacaagcaattattcctactttccaagttattttgatgccatggtggctcatacctataatctgagtactttgggaggctgaggtggactgatcacttgagcccaggagtttgagaccagcctgggcaacatagcaagactccatctctacaaaaaaagacaaaatttagctgagcgtggtggcgtgttcctgtagtcccagctacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagagatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcggtggctcacgcctataatcccagccctttgggaggccaaggcgggcggatcacgaggtcaggagatcaagaccatcctggctaacatgtaaaaccccgtctctactaaaaatacaaaaaattagccaggcgttgtggcggtcgcctgtagtccctgctatttgggaggccgaggcaagagaacggcatgaacctgggaggtggagcttgcagcgagctgagatcttgccactgcactccagcctgggcgacagtgcgagactctgtctcaaaaataaataaataaataaataataaataaaatgtttggaatgttggcttcatccctgggatgcaaggctggttcaacatacgcaaatcaagaaacataattcatcacataaacagaactaaagacaaaaaccacatgattatctcaatagatacagaaaaggccttcaataaaattcaacgttgcttcatgttaaaaactctcaataaactaggtattgatggaaaatatctcaaaataataaccatttatgacaaacccacagccattatcatactgaatgggcaaaagctggaagcattccccttgaaaactggcacaagacagggatgccgtctcaccactcctatttaacatagtattggaagttctggccaagaaaatcaggcaagagaaacaaataaggggtattcaaataggaaaagaggaagtaaaactgtgtttgcagatgacatgatactatatctagaaaaccccattatctccacccaaaagttccttaagctgataagcaacttcagcaaagtctcaggatacaaaatcaatgtgcagaaatcacaagcattctatacaccaacaatacacaagcagagagccaaatcatgaatgaactcccattcacagttgctagaaagagaataaaatacctaggaatacagctaataagatgtgaaggatctcttcaaggagaactacaaaccactgctcaaggaaataagagaggacacaaatgaaaaaacattccattctcgtggataggaagaatcaatatcatgaaaatggccatactacccaaagtaatttataggttcattgctattcccattaaactactattgacattcttcacagaattagaaaaaaactactttaaaattcaaatggaaccaaaaaagagcccgtataaccaagacaacaataagcaaaaagaacaaagctggaagcatcacactacccaacttcaaagtatactgcaaggctacagtagccaaaatggcatggtactggtacaaaaacagacacatagaccaatggaacagaatagagaccagagaaagaagaccacacatctacagccatctgatcatcgacaaacctgacaaaaacaagcaatggggaaaagattccctatttaataaatggtgctgggaaaactggctagccatatgcagaaaattgaaactgaccccttccttacaccttatacaaaaattaactcaagattaaagacttaatgtaaaacctaaaactataaaaaccctagaagaaaatctatttaataccattcaagacataggcacaagcaaaggtttcatgacaaaaacatcaaaagcaattgcaacaaaagcaaaaattacaaatgggatctaattaaactaaagagctcctgcacagcaaaagaaactatcattagagtgaacaggcaacctacagaatgggagaacatttttgcaatctatccatctgacaaaggtctaatatccagaacctacaaggaacttaaaacaaatttacaaggaaaaaaacaaccccatcaaaaagtggacaaaggacatgaacagacacttctcaaaagaagacatttatgtggccaacaaacatataaaaaaaagctcaaccttactgatcattagagaaatgcaaaggagaaccacaatgagataccatctcatgccggtcagaatggtgattattaaaaagtcaaaaaacaacagatgctggcgaggctgtggagaagtaggaacacttttacattgttggtgggaatgtaaattagttcaaccgttgtggaagtgtgtgtggctattcctcaaagatctagaactagaaatactatttgtcccagcaatcccattactgggtatatacccaaaggaatataaaccattttattataaagatacatgcacatttttgttcattgcagcactcttcacaatagcaaagacacaatagcaaatgcccatcaaagatagactggataaagaaaatgtggtacatatacaccatggaatactgtgcagtgcagccattacagcttttggtgatacagtgaatcagatttttcattaattcttttaattggttattactgaacgtgaaaaagtaatgtttgtattgaaatcttgagtctggccatgtttctattttaaattcataaagaattctaacaagaggaattccaagaatgtcataaatggatgtttctccatggatgaaggaactgttttattcacttgctgataattcagcctaatccagtttgacatcatatagataagtagttgaattatggatttaaaatacatatcattttctaactccaaaggtaatacttatttaaatggttttgaaaatatagaaaggcacaatttctttttaaatctgttattctccaccaccactcaatctgtctatcatctatctctccattcattcttccatttgtttatatctgttaatctttgtatgtgttcatgtatagcttttacatgattggaatcataatgcatattccattttgaagtctgcttttttttacacaaaaatatgttgtgaatattttcctatattatgaaatatcattagctgagcttttagaattgactgcatgttttggtaccatttagatatagtttaagatacttagaagttatgtggctttgccactatggatgaatcttatttactcaatattaattacttacaaataacctcacctaaacactactcagccataaaaaggaatgaattaatgacattcacagcaacctggagactattactctaaaggaagtaactgaggaatggaaaaccaaacattgtatgttctcactcataagtgggagataagctatgaggatgcaaaggcataagaaggatacaatggactttggggacttaggggaaagggtgggaggggggtgaaggataaaagaatacaaattgggttcagtgtatactgctcaggtgatgggtgcaccagaatctcacaagtaaccacttaattacttacgcatgtaaccagataccacctgttccccaaacacctatggaaataattttgtttttttttttaaaaaaggaatgagatcatgtcctttgcagggacatggatgaagctggaagccattatcctcagcaaactaacagaggagcaggaaaccaaacaccacatgttctcacttgtaagcggaagctgaacaatgagaacacacggacacagggatgagatcaacacacactggggcctgatgcaggggccgtagcggggagagcatcaggataactagctaatgcatgtggggcttaatacctaggtgataggttgataggtgcagcaaaccaccatgggacacgtttacctatgtaacaaacccgcacatcctgcacttgtatccagaacttaaaatattttaaaaatctttagagaatacaaaaaaaaaaaaaaagattcttcaatgcatacacaataaaattgcagttcagtcaaacattggaagtctttctctgactgtctagttggtatcttcattttcagcttcttcaagatcccactccaaacactgttagctcagccaaattgaacagctcatatctcctacctctggatctttggttctggtgattgtatatttctggaccatctggaaccccagcatatcaccctaccccacatctccacatccccaaaatataaccatacttcaagggcagttcaaataccatctccttctatcctccatgaagtcagttatctcttccattggaattatcgccccctctcctgaacagtactatttcgtgtgaatctcctccaagccttcttttcattttatatctcatgctgtaattcttggaaagtatgctgtagctcaagtgcagaattctcatcagttttatctttatatctctcctaaacactttacctgatgaagagcctggcatacacataaatatatattgaatgaatcagtgatggattgaaaagagaaatgatggatctcctaaattttaacttttataaaatattttgatacattcatgaccttactttagcaagcaatgaacgtgatgtaaactattgttgatatagtttttatattggaagtgtaagtagtttgtggcatgggattgtgacatatcctaggtttcctcatcttctttttattgaaatgtaattcacaagccataaaatttgcccctttaaagtaaatgatgcagtggattttagtatatttacagagttgtgcaatcatcaccactatctaattccagaacatttccatctacctagaaactccataccagtgagctgccactctaatcctcctcttcccccagcctctagaaacaataatccattttctgtctctatgatttgcctgttctagatattttataaaaataaacatgtggcctttcgtgtctgacttccttcactta

SEQ ID NO: 1216 - DNA, 56536 bp, Homo sapiens
catactcagtcacacaagccatagcaggaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacggtacgtgccccgcgctcgacccccgcgctggcggcgccggagctgtcccagaccccaagccccgacgcccggccctgagtcagcattgcagcaggccctgcgccgccgcgccccgcgtcccaccccgcgccgctcctcacagccctgcgctccgggaaactgcaggtggccggcagtggccaggggatggcgggggcgcttctggaacctgactcagttttgtaggttccttatctcggttgtttaccgcgggctttgcggaatgcccccgcttccgtttccgcccggctccgaacccccgaaccccttctacccgcaactccgccccggattcccagaaaggggcgacctgggccacagcggtacaagctgcaccccgatggacctgagagaccggaagtaacccttggccaactctggccgccccctgcagccgcagccccagaggcccacccgcgagcttcagtggcgggccctcagcgtcgtgtaaactttgcttaaaatgatcttgagagttcaattcttggggtgaactgttgagaagatctggcatttttcctttcgaaagttgttgggaacgtggactttcccaacaattgtgtatgcgctcgatctcactcagtgggagccgccgccctggagggaatttcacaatagcctggtcagggcggttattttccagagcagtttaatgtctattttgcccaagtgcaaggaaagcttgccttgggaaagctgggaatgcttggctaatgaaaagtttttagagccttttaaaatgaacctgtttctgccacttttccaccgcctcaaaacgactgggaaatgtaaactggcttcaagatgttcttgcttgagggtgtctggatttggacagaaggccatgttcttttaatattaacagtggcacgcagtagaacaaaggccactgaaattcagaatcagtttttggctccacgggcaggaagtaaattcaaggacgccagaggtcttgcgaatattttaattggttgacatttgaaatttgttcttaagcaatgaggggtgaaaccagtagggggatagcgtatagcataagtaaagctttttggacatcaacaaactgcgataatctacaacagacagcgggctctggaaggtttgacctgctttagagagagatttccgataagaggaacggagtttttggcacttttcggtttggtgattcccctaaataaccttacaaaagtttcgttgaacaaaaaacctggctggagctccaagatcttttttttttttttttttttttgagacagcatttcactcttgttgcccaggctggaatgcaatggcactatctctgctcaccgcaacctccgcctgtcgggttcaagcgattctcgtgcctcagcctctcaagtagctgagattacaggcatgcaccaccatgcccggctagttttgtatttttaatagagacggggtttctccatgttggtcagtctggtctcgaactcctgaccttaggtgatccgcccgcctcggcatcccaaagtgctgggattacaggcgtgagccaccatgcccggcccaactccaagatctaaacaaaaaagactgggttgaaagggagtttttaatgtttactgtttgctttacatccattttcttgttttgttaatacttgctttacttaagcttttgggtcaaatgtcctcgttaaaatggctttctctagcgactttatgttttacgtttctgtttgtaactgacatttgaccttcttttaacacggtattacttgcttccttataccggtttccaaggtgaagccatttgcagggtcgctgggtttccccctccccccgaaagtcttgcgcgacccggggtgggccggatagtgtgcagttttttgagccttgggctggggacctccaggaagctgaagcggaaattgcctaggcccctggggcattggaggtcctaccgcagctcctagtaggtggtgggggcgcagcggctgtccccactcagtcctggtggggtcgcacgtaacggtcctgagctatgcataagccgtttgaccacgcatggagaattttaccacccagagacacgcgagtggccctgtgcaagtttcaactgcgcggggggcggggaattccgcagacaggattctagaatttatgtcttgtgtggtaacatttcagccggtgggtggcggggattaggcgtgaagcggttcagcaggcagaggttctcggacgccctccggcgaagccacctgttgatgcttttgactttctgtccttgttcctcgtcccatctggagcatttccaattctggttttgcggagcagcaggtctgagcttgtccggcgagggtgggagttggtcccggcggagatccagtgggaagagccggcggctgcccgggcgtgagtagaccgagaatcctgcccgatccccgcccctgggctggtgtcgccctgggctcctgggacgtcggggcactgtcccccgatactggcagaaaaggattgagtcctcgcttttggccctaggtctccttgagcctccagaggactcacaacactccggggcatgttgctctttcaaataccaggaatggactctggggaatggggcacccttgaagtctgattatttcttccctgtagagccccaggggctaattaaactcgtgtttatggactccaatgcctccttgcctttaattcagtataatcctaccaacatttattgagcttctctgggccaggcagagttctgggtgccgaggacatagaaatggatctaaacttggttcttgtccccataacctcacaatgtggttgaggaagactcagcagttacctacacaggtaacttcgagtcaaggcagtttagacaagatccactgacagcctgactggaggaagcctgtgggccatggtggggcagttatgacaccatgggttctttttgtttatttgtttgtttgttttgtcttttcttttagtatgcccaggtaacttgcagaacccggtcgttctttcttactatagatcagtgaggtgaaaagcactatcattattggaatgccctgtctctcccttatactctcttcctgtcatctcccctcagaagacttgacaccccaccctggtgccctttctctgtactttcatatgctcagcggctgtctttgcacttgcttcaggattgtacctaacattctgtactgtaatgcattttcttcagacactcttcagtcaagttgtattataattatgagttaaaatacatgcaaagtaaatagagaaaacctccaggggttcattccgtagagataaccaaaggtttcagtttaatgttttttttttttttttcacacatgtgcgctctcaaatacagtcttttacatatttttaaaaataaacactcaatttttttggtttattttctagtttgcaagatatttcattttttaaaattgtgtttatttacaacctgcttttttctaaaaaagattcaaggtggggccttcttttcttttctttttttttttttttttttgagatgaggtcttgcttgttgcccaggctggagtgcagtggtgatcatatctcacttcagcctctaactctaggctcaagcagtcatctcacatcagcctctggagtagctggaactacaggtgtgtgccaccacacccagctacatttttttttttttttgagacagagtctcactctgtcacccaggctggagtgcagtggtgctatctctgctcactgcagcctctgcctcctgggttcaagtgattctcctgtgaaaattgcttccttttctacacttgttctgtatttatgttcctctgatggtctccacttctagccactttctttttttggcgatttaagtttttggcccaaatagataaacatcttctacattatttttctcttattctcgatactgggttgccatctttggtgatttagtacttattatgaaagagagaagctacaccacttgataccactttcatctgcatactcatgataatttgtatcttctgcagtgaactcttaagttgaagaaatgaataatttatatgtatatttgtatacttttaaaaatgtaattgaaaaatcctctcatagttacttaactccaaggtttaaaaatgcttcccagggtaatgagtttctttagtcatgtgactttagaaatgggaaccaaagcttccttatctacttgtgaaattcttgagttttttccttgaacttcctttttatcttccctttggcttatatatctgtgttttttgtttgtttttacttgcagctttcaaaagtagttttcaaagtcaatgagattgtttaaaagagtaggtacctgacagtctcttgcttgaatactatctagtgagtgaaccaaattccctgcaacaataaccacaactttgaatcaagagttaaatgaaaaaagtaactccttcagcatttactgagcacctgctggggctgaggaatgggggcatgtagatctccctctgctgtctggagctccctttctggttggaaaacatagaagcagcgcaaaagtttcacccaaaaccttggccatggtatgctattgaaaccccatagttcagattttatacttgagttcttttctaagccatggctggattatgttaatctggcaaataattataaagctggattattttaatctggtaagtaattataaggttgtgctccgtgatgtagctattaataaaatatgtggtagcacagacaagttgtatatagcacaaagctatacccccagaggagacactatatcagttgctgtctgcctaggctttctgtaaacgtgctggctatcattcagcctaaatgtagaatgagtctatccctttaacctgggccatcaccaggaatgtaaaggaacctagaacgaggacccaggcaagagatgagaaactaggggacagatgagtaggtaccagggatggtgatgagactgaagcaagtggggaatttttattttcttctctacttttctctattttccagattttcttagagcaaaaagcaggtagtgctttttacagaaaatgaatgctatataaaagtaattttaagaactttatatatccctagtgttatgtacaatttctgactttgaatagagatatctcccaaagggccaagtttggccctttagttacaatggagaatctgttgtgtaaactgagcaaatacacctgccaagttgaaatttaatttaagccaatcttgtctagatgaacttaagagaacgtctcctaaatattttattgcagtagtgtagcatgattgatagtatgctattctcttgaatagatggggttgtttcttgagccactttttattcctttgatcaaaaccttgaggagaaggaatgcctgttttcctgactgctgttgcatgaagttagacatccagttcctctaaaggtgacatcagatggtttagatacctaaaaagaagtgaggctaagccataggtcttcttcgtactacctgaagttgagacctggtctctgaactcagttattgctgaagcattaaaatcttacatcttgcttaaactcaggcagcttgacctgttctcatttttctctatcaaataaattgaagcctggtaataaattgatgatgagttccaaacatccccttggttggagacattgtattctccccactcacaatgaggtcctgccagtttccagaaaattttgcatgggggcttacccatccttttagaatcacattgcaagtcactctaaagcattagcattgttatctcatgtagctgcaaaagcttcctttcacaagctcttctggatccaacaaccagattccaagtatggtatcttaactacaccaccagctccatcttgcttcattgtatgttatgaagggatgagtaagcgttacacatgggctgcaatggtccaatgatgaccagtctgttcaagacccaagagggctgagattggcagccctggccattgtttaccacagcctaatgaagatgagtaaaagcctatctatccccaaggacctccacatatgacagtactcaactgagtctcacataggatagaataagataaaatgctggaagagaacacaaatagtgctacaaagcaggaagagagacttgatttggggatcaagacaagcttatagaagagacatcttgagagagaagatataatttcaggtacagactgagaggagggaaggggctttccaaatggaggcaaatgcttgagtgaagttgctgggacagaaaaatactgtccagggaacattgagatatttttggttcggagttagattatgggttgggctgaagtggggatgatactcttagtgcttgagctatgtatcagaagtttgtctatagtattatgcacaatttctgattttgaacagagctatctcctgcaggaccactcttggcccgttagttacagtgggcaatccgttgtgtaagctgagcaagtatacctgccaaagtgaaaatttaaatttagttaagggcactacatcaactgatttagctcccttgctcctggtgactttgcccatgtttctatatccaattagatgatgatttatgatcttttgatttagatgctttctcatttctgattcattctcattttctgcagcctacacataagtgttaggaaccaaggaagttattggcgataatgtctggttggaatttgtgggagcttccttgagagtcatgaaaagtctgttcttagtctgttttgtgctgctataacaaaatacccacaaccaggtaatttataaaaaacaaatttatttctcacagtctggaggctgggaagtccaagatcaaggtgctgacatctggtgagggctgctccccgcttccaatctggtgccttgaacactgcattctacggaggggaggaatgctgtgtcttaacatggcaaaaggtggaagggcaaaaagagaaataaactccctttatcagccccctttataagggcatctaatcccattcaggagggaggcgcctccagggaatgatcacctcttaaaggccccacttcttaatcctatcatattggcaatacctgaactttggaggggacacattcaaaccatagcagcctcatcaaataattttataaaatatgacttctaattttatgtcattttataactgggatcatctgttgttctgcacgccaatggagggggaaggtgaattttgttatgttcaagatgaatgcacaaaacttctgtgagatggccacattctactttacccagaattgtgcaacctcttctgcttttagaaacttctggatgacactttgtttcatgttcatatctccactggggcttcccagacacctgaaagttcaggtttgcatgctgctttctgcagctggcaagacaggtttctccattgccgcccagtttgtggggttgcaagaaattacatttgcattcacgctgtggctcactggacatgacattgctttcatgccatacgatgaccttgcttcactagagaagcagtagaaagaagggaatgttaagtacgtctttggatggcttagctggtcatgctgcatgctttgctactgattacagggaacaatatgtgcctttgttaccagatagtttgggggcagcgttggtgttctgtgagaaaggttgagaggcctgactaaacttaaccacatttgctgacacctggttagggctaatgtgggtaccagggaagtgtgttaagtgcttcaatagaggtgttttgttttgttttgttttgtttttcgagacggagtttcactcttgttgcccaggctggagtgcagtggcgcaatcttagctcactggcaacctccacctcccaggctcaagagacttttgtgcctcaacccctcgagtagctgggattacagacatgcagcaccacggccagctagtttttgtatttttagtagagacagggttttgccatgttggccaggctggtcttgaactccttgcctcaagtgatccgcccgccttggcctcccaaagtgctgggattacaggtgtgagccaccgcgcctggccagttcaggcatgaactttagaaatttcacttagatggaaggtagatttggagagggtgaggtctaaagcagggggaacagaatggctaggggaatgagtttggatgagagacggatggtaggcaccagcatttaagggacaggtgcagaaagagtatgctgaggagtagaagaaagttagagaagggtctgtgtagaatatagtggtgtgagctcagccaagggagaagagtttcaaggagggatgaattagcagtgtcagctggagttgagcagtcagatgaaagaggacttccaagtttttggatgtggcaaccaggaggtcaccagggcctcaacaagagctgtgtcatcagggctgggatactagcaggggcaaacgaggcactggcttcaggacaacatgtgagggggtgctcaaaaagtcagtcatcaagatagataatattttaatgcaatattttaaaaaacagacataaatgcaaaaaatctatgatgaacaaaataccaacattttaaataaagacagcgtcagtattgctgattgtcccttttgcctcagattccagtatggctcaggactgagtgtggctgtgtagaggagatggtggtgaggggatccaggtggaggcatgttgagaagtgaattgtggttgaagaaactgaagcactgagtacagactattccttcatgaggtcccagctttatgtgaaagggaataaagtgaaaggatggtaggtctaggggaccctcaggcttttttgagggtttggctttattttttaagatggaagagacttgcacatgtttacaagctgggaggagccgtctctggaggtagagaggatgaagagagtagacataggggattagtagagacaggagggcacacagggaggcttagccctaggcaagcagagggacaggagggaccagctggggcagtggaaaggtggaaggtggcaggagtttgtgcctgatacatggatgagaaatggcactgggggtggtgttgggatggaagagagttgtggagtgttggaggtttcccacactccttgaagggtgtgggaaaggagctgaacagagtcttcctgtaaatgaaactgttgagcagccgtaggggcccagctcaggaaaccaccagggtgtggtggtgagtagttttcagattgtgttatctcttctcccttccttcggaacttgctactggaggtgtaggagtggtagaggcttcctcattaaggcaggggtgctggagcgatcaaccatccctgtttgcctgggactgaggggtttcctgggactcggtcaccctagatgttgcagggctggcagtcaggagggaaaaaggccagataattgaaaatgctggccagagtttgtagcatgcgctgtctgattgttgtacctgagcgagttagagaaaacgccacactttgagatgaattaagagtccgtttatttagccggcggccaagagacagctaacgctcaaagttctctcagcctcgaagaaggggctagattttcttttatactttggtttagaaaggggaggggggggtctagttaaaacaattttacagaagtaaagtaggcaaaaaagttaaaaggataaatggttacaggaaagtaaacagttccaggtgcaggggctttaagactattacaaggtgatagacgcggggctttgggcgttatcaatctgacgaattcctgagaactgcggatattgctggccacagtatcttatcagttaattgcattcttggatgtgctgggagtcagcttgcacaagttaagtccttgcggaagggctgccagtgaaacagccaagatggagtctgtctggctctcttagctaagggagagtcaattcaggtgaaaacaaggctaagtgattaaaggaaagggagagtctaaaaacagcgttagtaaaaacaaggttgggcattacatgatcactgggtctccactgtcagagggtctttgagctcagttctagtggcagcctcctgatcctcacttccctggctgaggcaaggttgttgcagcagccccaggagtctttgttagaatcccaccccagagctccttcctccagtcctctcagcagttttgttagttccagtattaagtgtaatttctacaaaaaatgcctggaatatttctgtttccagaaccggatgctcctgttagctagtgtgtgaaagataactctgacttgcctaagctttgttgatgttttgaataataattggcgatagtctcttgacttctgcaagagaaatgaaacagaaattggtctcaagttttagttgctcttgtgaaggtcagggacagtttgtaccagggtgtgggtgtggaaaagaaggggagatatagtcattaaattagaatatgcctgtgaggggagttaaggggaattcctttaaaattctagaaaacacacacaggtgccaattttgtctggctagggaaaagtaaactgctgaaaacacttggggggagaaatgaagctaatggtatcttgatcagtcaggaggattgggtatttgaaagcagggaagaaaaataattggacttggatattcctttgccccttcatctgagtaaggtgaaagcaagtgactcttcagaagaggcgaatgggacactgagtccagcagctcaggcagggtggagttggtaactgatgggcacaagtcttttactgggctctaaagaactcattcatctgggtgtggtggcttacacctgtaatctcagcatttcggaaggctgaggtaggagaatcacttgagcccaggagtttgagaccagcctgagaaacacagtgggaccctttccctacaaaaaactgaagaccttatgagcttccctagtctaagagtaatttttatgttaatttcttggcttgggcttaaaccccaacaaagtggtgattattcggaccccagccctacctctccctagtatgctctcctttctcaagtactcaccacctctagccacagtgaactgcctccagcatacacacacgctgctattttgttgcatctgagtgggctggctccacacgggatctgtagtttccttttgatattttctttcaatgtgccagatgctaccactgagtaatctagattttgctgccaaactctacccccgttagcacagagggaagacagtatgccagtgctcttgctgagtgtgcgtgactggcagaaagcagtcatgggtgtgatggttggaagaaacaaactgagcagataatgttttttaaaatgattatctcattttgttaactcttggtggcattgttatattgttgatacttatgaattacaaaagttagatgactgtaaaaaaatagagaattaagcatttcatttctagtagttctgtttggttctttttcaaatatgtcagtgaatttgtataatatctcatttcttagtcttgtgtttaatgattttatttttgtgtttttataattccttctactgcatatattttatactttaatttataataacaactgttgacaaaattgtgactattcattaatacagtagaaaagaacttggcctccttttcatggaagctgatgatgagattaaagcactgttggcctgcgagtggagtatagatttgggctgtccagaacacataaaatttgtatttatctttctgataaaaaaaagtaaaatagtctgagtgccaatttttccactttcattgagcacatttaattttagtaaatttaacttagcaaatttaatttctccagttatttacaaataatcatatttaagtgaagttgggatgaatgggcaagcccatttcaaatttctaacctaatttttcctcttgttttcatataaaatttttctatttatgtgtttttattttaagatagctcaaatcttttgtggactgatactgtatgtatataaataaatggattcagtgcttctttcactaaatacagctagataaatatataaatatacttgaacacaaatacaaagcaaccattggcaatttagagttgggttgtgtttccacttattttttgttaataaatttgattttaacctgaaatattgtcttgtaggaacagataaagaacacaagaggtgatttaacataagttttagctgtgaaacttagagtagataggttagcaacttaaattttgaaagaaaataggatgagtttcaatggaagaaattaagaacacacccattgcatgagctccttacccctcctacccagccccctcccaggagtgagatctttccccagatcctctgtaacttccagatgttccactgagaacatcagaagcactaatggcaattgctgccatgtagcagtgcattgagagtcagggcctctggcacctccatggggctcagggtctgaagacgtgatccaaacctgacaacttggtggcaggttctgtgagcattcatgatgttgtgaaaagggcttggggtctaggaggatggcagcagaggtttctgccctcaggtgtgagtgaggggcttttgaagtaggagagcaactagaaaaaaggagtggcacagggacagaaacttcttttctccattgtttgttcaaggccacgtgggtggagtcattgaggtggaggtttaactctgtgacataagtttccctgatttagtcaggctgtctgtcgttgggcttttcccacttccttctactacgtacttcttccctattcctcctactgaggccattaaacccttagttgtaattttccctgaacatgctttacattctgatgaattctgaaaaagaatgtggggtttccttgcagatgagttcatctgttgtttcatttcctttacaatgtaggttttcttctctgtctttttggattagtctgtttttggttctgtctaccaaggatccctttctttagacttctatagatccctttctatagaacttaatctacttaagtcagggagaccacccagaaggaaagagcccatactttcaatcttaggcataagttagcttgataagattttcagaaaaattcccttttaaccacagaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactataggtaattcatcaactcttcctgaggctgggtgggtgggagggagtgaagtgtctcagactctactgaatggcagaaacgaggataataagaagtgcagccactttactgtctctgcccacttatccaactgccagatgatgtcacttcattcctgtgagccctttaaattcttgaaacttgttttcttgctttctttttctttctttcttttttttttttttttttttttttttgagacagagtctcaccctgttgcccaggctggagtgcagtggcgtgatcttggctcactgcaacctccgccttctgggttcaagcgattctcctgcctcagcctcccaagtacttgggactacaggcgtgcgccaccatgcctggctaatttttttttgtatttttagtggagacggggtttcaccatgttggccaggctggtcttgaactcctgacctcaagtgatccacctgccttggcttcccaaaatgctgggataacaggcatgagccattgcctccagctgaaacatgctttctcaaaggaattgggatcatatgcaggtagaagggcagctggtatgtgtttgcctgaaggatagaatgacaagacgtgaagaaagataggaatgactaagagctagtcattcttgccagcctctgacagtgtgagatctgcagcagtgtttactagttcattttctgtgaagtcagtccttgataatttgtggtacaaagaaaggaaataacaagtctgacagtaatcttcctacctttgtagagactccatcatcccttctgaatccctgttggccctaccctgctgaggaagtttatcagggtgggctcccttcctgcacttcctgcgcttggagacattggagagcccacattgaaaatctcttcagttaaccacatttaagtcccttcagtccaaagaggaaatggccactggagtctgctttagttcccacaagctttgggttgctccttcctcctgttcacatgttaatgtctttagaggttcagaggggcatggaagctactgagagactgacttcctggggaaaggaagataacttgtaaccttaagttggtgttttctttttttttttgagacaaagtctcgctctgcagcccaggctggagtgcagtggtgcgatcttggctcactgtaacctctgcttctgggttcaagtgattctcctgccttagcctcctgagtagctgggattacaggcacgcaccactatgtctggctaattattgtatttttactagaaacagggttttgccatgttggccaggctggtcttgaactcttagcctcaagtgatctgccctccttggcctcttaaagtgctgggattataggtgtgagccaccatgcccagccggtgttttttctctcgaccaccagccttttattatgttgataatgtgtatttggagatgataattattatcaagaactatactaaagagagctgaaagcagtgtgggctttggaaagtatatgagatttgaacttggaaagcctgtttttttggtttttgtttttttgtttgtttgtttgtttttgagacagggtcttgctctgtcatccaggctggagtgcagtggcatgatcatagctcattgtagctggaagacctgtttcaagcctcagatctaccaattatgggccaggcaggctgggccaatcactaaccttgttgggcctctgttttcctacttgtaaagcgaaaaataataatacctgactttacaaggttgttgtgagcatcagttgtaataatttactatgtgaagtactttttaaactgtgaagcactctacagatagaagggattattatcattgttattattattatttttttaatcttccacctattcagccatcagttttaatgtcagtaatcttcagactttccgggaggcaccaactgagtttcagtgaatagggcaatctctccatttcccatttccttgctatgatgagtggagattcttcaggccctctgggaagggttgcgggggcagttgaagaggagtgctagatttatttattcatctggtgagtgggcttcattgtgtattggtgctaagtgttttggtaagctctaggacaaaatgaaaagtctgccatcctcaagaatctgagagcctaactgggaaaatggccttgatgacaatgtcatggtaacaatactaaccacagggtgtccttaggagccccagaaaagtgtggttgttggttctcaaagtctatttcctagggggggaaaaatatatatatatatatatatatatagtgttagctccagccaccagtgagtcaggagaggctttctaggcaaagacatctaagttcagaatccttgtgatccagatgcctgtaccctttgagttcagaggtgggccagggtatctcaggtatttctttcctttagcatcttgcaattcaaaatatggtccttgaatcaacatcacctgagagcttgttaaacagagaaggctacttcaaattctatttctgtcttttatgttagtcatttgggttcttaagtcatttcactgtaacctctgggggagctaggggattctttaaggaagtttccattctctgagttgttttcagaaactgttagttggcaaaggatgtaccatctcctattaaacgggcaaggacaagttcccttttctgaggtcccttaagatctcttcctggggtgatctaggcttgctgttttatgagggagggacatatttacacaggggcaagaactagtcttttaatccattgttgcataggggaggcgtgggcacttggagttgtcttaggactgatgtctgaattaactaaatgaacttgtctggtttgcagagtgctgatggcagagattggtgaggatttggataaatctgatgtgtcctcattaattttcctcatgaaggattacatgggccgaggcaagataagcaaggagaaggtgagttttcttcttttggttcatggccccaggagcctatcagaagtgggagctactcttgttgatacagagagagggaagcaggcagtctgccgccactatagtgggagtcagacatctcaggtggcttttaaacaacatgaatgggaagagaattggtttatgaattgaagaaataggattataacatcttctggtgtggtcttggatgtttctttcatccttggattttatccttgtttctgtaaaattcataggtctggctcatatgtgtttccctccctggtttgatggggttgtggggaagacatcccatctgcttgtgctgggggaaaacaggaaggaggtgctagtccactatagtatcactctcctactgccatctatttctcctcagctgactcaaggtcattgtggggtctaggctgcatgtaggagtggggtggggggaggttcttgtgactggtgtatctgggaaatggtaaaagtagagatttagagttgaaaaccaggaggccgggcgcagtggctcatgcctgtaatcccagcactttggggggccaaggtgggtggatcacgaggtcaggagatcgagaccaacctggctaacacggtgaaaccctatctctactaaaaatacaaaaaaagtagccgggtgtggtggcgggcgcctgtagtcccagttactcgggaggctgaggcaagagaatggtgtgaagctgggaggcagagcttgcggtgagctgagatggcgccactgcactccagcctgggtgacagcaagactccatctcaaaaaaaaaaaaaaaaaaaaaaaatgaagaaaagaagaccaggtagtggtgaagatctcggggatgtcatgattgctagaaaaatatttaaaatccatggccaggcacggtggctcacgcctgtaatcctagcactttgggagactgaggtgggcagatcacctgaggtcaagagtttgagaccaacctggccaacctggtgaaactccgtctctactaaaaatacaaaaaattagccgggcgtggtggtaggcacctataatcccagctacaggaggtgaaggcaggagaatcacttgaacccaggaggcggaggttgcagtgagtcgagattgcaccattgcactccagcctgggcgacggagcaagactctgtctcaaaaaaaaaaattttttttaactccagttggcctagcacaatggctcatgggcacagtggctcatgcttgtaatcccagcactttgggaggctgagccgggcagatcacttgaggtcaggagttcaagaccagcctggccaacatggcaaaaccccatctctactaaaagtacaaaaattagctgggcgtagtggtgggcgcctgtaatcccagctacttgggaggctgaggcaggagaattgctagaacccaggaggcagaggttgcagtaagccaagattgtgctattgcactccagcctgggctatagagccagactccatctcaaaaattaaaataaaataaaataaaataaaataaaataaaataaaataaaaaaatataaaataaaataacattctagttggccctacatggtactgttgacctaaggataggccaggaaatgtttgagaacctattgtttctaaaatatgacaataggtcctcaaaataggcaggccagtgcctgcctgtaacgattcagataagtcattgcttgagaatttcctcatgttcctaatgattatagttttgtttcttaagtcccatcaaatgcaaaatgggaaggaaaatgaaactagaactccctttttggtttctcctagtaattgtctctcccagccatttatatatatctaaattatgattattattttcaaaaataaagatagcacttcagtaactaaatgttaaatgcaaaggaaatagatcccaaagcaatgcctgtttctgaaatatcgttcgttcataatcactgtggcccaaggtaaacgaatagcagaatactcaaaccttgttgtaatttcacttttttataatcccctgagtcagaacgtcagaatgagttggaaggcccaatattgattcaaatattttggaaactttaaaactataacatgtgatttttctcataaagtctttccccagctacctttcttctcctttttcagagaagcccttagagtttttcactatgacaccagcctggccttttggaaaataataaacttaggaggattgtcttttcagccctgctctttcacggtccttctcaatgacacaacatggcacacgtgtctctctgcaaccaaggagcagattgatgaccaaaagacttaccaccacctctgttctgagtaaaaatcaggagtctaagttgctcatgacagagatgtctggtttaagatcactgaaggtcactgaaagggctcatcttgtcacattttcttactgctataaatcacatggactgaggtttgcatttggggcttattagtcagctctattttttttttttgagacagggtctcgctctgctgcccaggctggagtgccgtggtgcaatcactgctcactgccttgacctctgagttcaagtgatcctccacctctgcctcctgagtagctgggaccacaggtgtgtgccaacacactcagcttattttttttattttttgtagagatgggggtctcactattttgctcaggctggtctcaaactcttgggctcaagcagtcttcctgcctcagcctcccaaagtgctgggattacaggtatgaacttctgcacctggcctagctagctctattgacatttgttttttgttggtggttctcttagagtttcttggaccttgtggttgagttggagaaactaaatctggttgccccagatcaactggatttattagaaaaatgcctaaagaacatccacagaatagacctgaagacaaaaatccagaagtacaagcagtctggtaagaattttggcctctcagtggtctaggggaagtactctgtgcatgggggtgggcatcatgactgataaatattcatttgttggataggtggatggaatggaacctggatgaccaaagcctcctttagcttgtggctagaaatcgcgtccctttatattcttcatatcccagatctgccaactccattgccctgtatattcatgatctctgcaaaatgctgccaagcagttcttaacatttcagtcttcaagaaagaatctgggatctgcacaggctggcagagctatggacattcaggggttttgcatgtatgctgaaccctactgccttgctctggtatttggcctcacaaccactgtccaacttcgggtgatgtcacttgggtctcataccttccttgcatgtgtcccaagtttcacaaaacctccttatggaaaagagcacattcgatttcttccttgataaaagggaccagattcacattggccttctgctttacttgcattcctcattgtcttttagactcagcctcagcttgggctttgttagcaagttcactgccaccatagcatcacagcctaaagggcatggctgagactcattgatctatagagcactcttttaccccaacatactctaaatgactgatcaaagatcaaaaacagaagagcatttatactccattcttgttttttgagacctgcttgatttattccgattatttaacacacagggacgcaacagtgatcccaaagtgtgtaaagttaaagccttcaactgcagctgaggagagggcaggaatggggacggtggtgagtcaggaatgacaggcaggcagccatgaccagggcagcctcctccccagggccagggactggggagtggcctaaggagcaggacctaagggtagcccagagctggggaagggggcagagacctccccttggcctaggtctggagctcagaagtgccacatgcctgagggggcagcggcctgggaagggccagaggcagggtcaggagagcaccatttcctggggggctggggacagggaggtgccctataggagaagccaggaggggccgtctgcccctgaggtgggggctgggctggagcaggctgcagcaagaaagacctgaggcaggcacagggcctgagagcccagctgcctgggttcaggggggctcccagggcagcctggcccagggagcagtcctgactctgcaggggatgcccagcaaggggggctgcagacccctcagagcctcccctcctctctccctggaaaggagctggggaacccatagtgcaaatctgtggaccactcagttatggagggaggctgtgcctgaaggtggacactggggtgcactccctccaccatctcgccctgcaccgctgtcctcagtacagccacttctcgtaagagtgcaggccatggatgccaccgtcgatctgggctgacatggtctgcttctcaaacttgagctcccctgagtacatcatggaccgaaggacagacaggctgtgggccccgatatcctggcagccatgctggatgcccactatgaggtagggcacgaacttctgaatggaccctttgtcctggatggagcccaagacatcctgcgtgatcttcgccttatccccgtcgttgaagtattgtttctggctgctgctgctcttctccatggcatccagtgagcccatgccctggtacttcttgagctgcattccgtctgagaagaagcactcgccgggggcctccatggtggcggccagcagggagcccatcatcactgtggaggctcctagggccagggccttgaccacatgccccatggtctggatgccaccatcggctatgatgggcacaccaaagttctgggtatgcttggccaccttgtacacagcagtgccctggggctgactgcaggctatcacttcctggttgatgtagatggagccgcgcagtccatgcccctgcccagcccatccacaccagcgtcaatcaggttgttggcctgggctgctgtcaccacgttccccccaatcacctggaggtggggttacttttgtttgatgtaatgcaccatggcgatctgatacaccgagttcccttgggacgagtccaagcctatgacattgacgcctacctgggtgagcaggtccaggtggtatttgtcatcctcatgggtacccacagctgccccgcccagcagctgctcatgggaatccttggaggccacagggtagtctcggttcttcagcgcggtgcaggtgataatggccaccagctcatcgcgatcattgacgataggcagcttcctttcttactaagctgcaggatctcatttgcctctttcaacctcacactgctggagccaccactagcttgatccttggcatcatcacctcactgaggagggtggtgtggtccttctcagcaagaaagtcgatgtctcgggaggtgacgatgcccaccagcttgctgcccatggtacccgtctcagtgatggggatgccagagaagccatgacgcatcttggcctccaacacatcacccacagtgtgcaaggggctcagcaccacggggtgtgtgataaagcccggttcaaacttcttgaccttctgcacctcactggcctggaactctggggtgcagttgtggtgaatgaaaccagtacctcccatcagagccatcacgatggccaggtcggcctctgtcacagtgtccatgggggaggagatcagcggcgtcttcagagtgaccattgggtcagggctgaggtcaggtccacctcatcagctatgaagtctatgaatcctgggagaatcaagaagtcgttgtaggtgagtccctggtcactggcgaagagctgctgcacggtgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgaccgtcccccagcccgacacccataaagggtctgtgctgaggaggattagtaaaagaggaaggaacgcctgtttgcagttgagagaagaggaaggcatctgtctcctgccagtccctgggcaatggaatgtctcggtgtaaaacctgattgtatgttccatctgctgagataggggaaaaccgccttagggctggaggtgggacatgcgggcagcactactgctctttaagtcattgagatgtttatgtgtatgcatatctgaagcacagcacttaattctttaccttgttcttgatgcagagacctttgttcacgtgtttatctgctgaccttctctccactattattctatgaccctgccacacccccctctccgagaaacacctaaaaatgatcaataaatactaagggaactaagaggccggcgggatcctccgtatgctgaacgccggtcccctgggcccccttttttctttctctatactttgcgtctgtgtctttcttttccaagtctctcgttccacctaacgagaaaaacccacaggtgtggaggggcaacccaccccttcagcgcagtgaacccgtcctcgaccacgtagccggtgctgctgctgataggtagtccctcatgctgccgcgagaccccgcgacccgacataaacgctgcagctgctgcgacgcggaggcgcgccgctgccacgctgcagccaggcgccgggtgggctgggtgggctgggggcgggggctgcggcagcggcggggcgggccagggcgccctatactccattcttcatgatgtttggtcgaagagtcatctgaaattttgaattcagtaaggtggctagaaagtttagggtattttgaaagatggtgattgaccttggactgaaccactattgaagatttatttgataataatttgtaagttttaactcagtacctcccttctgcttttatagttcaaggagcagggacaagttacaggaatgttctccaagcagcaatccaaaagagtctcaaggatccttcaaataacttcagggtgagtctggagaaaacatatggaatcccagcatgaaaccgtttcagagttctaataaaaatatgcatattctcacagcatgtactttatttaatatctgaaaaaattgtgatagaaatgtgtatttgttttaaaaacgtgtaacttcttatatttcaaagctaatacatgttcattgagatatttggagactatagagaaagataaaagaaaataaatcacctatattccactatccaaagacaaccactgttagtattttggtatatttccttctagactcttttttatgtgggtttgcatctgtatctgtatgtatgtatatatatatatatatacatacatacatacatacagttggacaattggacatttttttcactgttcatttattcacttgaaattgtaacttaaaaaaagaaaatgtaactttaaaaataaaaatagatgcaccatgcctatggaaaaaaatttaaatgtactacaagaggttttaaaagtatttttttgcccgggtgcggtggctcatgcgtgtaatcccagcactttgggaggccgagccggaaggatcacctgaggtcaggagttcgagactggcctggccaacatggtgaaactccatctctactaaaaaatacaaaaattagccaggtatggtggcaggtgcctataatcccagctacttgggaggctgaggcaggagaatcatatgaacccaggaagtggaggttgcagtagccaaatcgcgccattgtactccagcctgggtgacaagagcaaaactctgtctcaaaaaaaatgttttcttcctacccctataatactgacctccaattatttttcctaaaggcagctgttgtgaactagttcattctgtaactatccagagatagtctacacatatatttcatttttgcttttttctcttctacagatgataacaccctatgcccattgtcctgatctgaaaattcttggaaattgttccatgtgattaacatggaactgcctctacttaatcattctgaatgattaaatcgtttcattttctaaatgtgttataatgtgtttagccctttcttgttgctgtatgtttagatgctttccaatcttttgttactactaataatgctataaaataaatatccttgtacttctttgtgcatttgtttttttactgagctaattttaatgatttcagcaaaagttattttgttattgagtgatgaaacaaaagatttttgagggtgttcatgagcataagtgtatcatatagtcacttatggttgttgtgttcctagtacttagtacaaggtatcggaattgttctttagttaatcttttatcttgagaagttaaatcttggtgtaatcttatcctcatgttcatataaagatatgtggagtttgtagtgaggacttagagccgggtacaatttcatggttaaattagaaatgcttttggcagtgttaacagctcttttagaatttgtctagcaggcttttcagtttttgccagaaagccctaaaaaaaaagaaggaaaaaaatgcttttggctgagtgtggtggctcacgcctgtaatcccagcactttgggaggccgaggcaagcggatcgcttgagcccaggagttcgagacaaacctggtcaatatgtcaaaaccccatttctacaaaaaatacaaaaattagctgggcatgatggtgtgcctttagtctcagctacttgggaggctgaggtgggagaaattgcttgagcctgggaggttgaggctgcagtgaggtgtgagtgtgccactgcactccagccctggtgacagagtgagaccttgtctctaaaagaaaaaaaaatattatatatatatatataaatgctttccttaaaatatgtaatgaaaacccactcttgtaatataaatggtttcttggagaatatgtctgtaagagacactactgagcaatgcaatttcagagctaaaatggatttacggattatattatccaactcccttaatgaacaaaataaggaaacttagccctaaagaacattaactgattgtctacttctaactactagcagagctgggcccagcccatactcctttcactgcactgtgatgtatataataaactatatacttgtcataccatatcttagagcatactttttgtttttttgagacagagtttcgttcttgttgcccaggctggagtgcaatggcgcgatcttggctcaccgcaacctccgcctcccgggttcaagcgattctcccacctcagcctcccaagtagctgggattacaggaatgtgccaccacgcccgggtaattttatatttttagtagagatggggtttctccatgttggtcaggctggtcttgaactcccgacctcaggtgatctgcccgcctcagcctcgcaaagtgctgagattacagacatgagccactgcacttggcctagcatatattttttaaaagaatgaaatgtgctttgttttgtccttctgagtctctgtaataccaaataatgagaaaaagcagatttaggattcagatccaggttttctgagctttctctgctattgtctgtctaatataaattatattgtcattcttagttaaaaaacctgccatatttttactattgtgtttctattttgtaaatgaagcatattcattgctatgtagcctgttgtgagcccatatgctttgcatattagtttctccttaaactttctatatttaatatgtgaccctaaggccgggtgcagtggctcacacctgtaatctcagcacgttgggaggccgaggcaggtggatcacctgaggtcgagagtttgagaccaacatggagaaaccctgtctctactaaaaatacaaaattttccaggtgtggtggtgcatgcctgtaatcccagctacttgcgaggctgaggcaggagaatcacttgaacctgagaggcggaggttgtcgtgagccgagattgtgccattgcactccagtttgggcaacaagagtggaactccgtctcaaaaaaagaaaaaaaaaagtgaccctgattattcattcattcatttagtaagcaggcactatggcatatgaatgcagtgactttcttaaaaggtttaggagccgaatacctagaagttaattcatatgaggctgcagaagtgcttcaaaaattactgtatgattaaatgccacaggataccacaagatattatagaattaaaaaattatggctgggcatggtggctcacacctgtaatcccagcactttgggaggccgaggcaggtggatcatgaggtcaggagttcaagaccagcctggccaagatggtgaaaccctgtctctactaaaactacaaaaattaaccaggcgcagtggcaggcgcctataatcccagctactctggaggccgaggcaggagaatcacttgaacccaggcggcagaggttgcaggcgccactgcaccccaccctgggtgacagagtgagactctgtctcaaaaaaaaaaaagaatttaaaaattatttggctacaatacaatgcttttaaaatccatctttgatttgatatgttacctctctctaataatatgtaaaagcgaatacacatgcatgcggccaatttctatctgatatgatcagcctctggctaagttactaattattagtgaaaaaggcaacttacatgtttttaatttagacacacagacttagctactgacacagcttaacagatagtgtatttcactcttttggctaggttagcttcagagaagaactgtcatttgaaagctgagtgtctcagatgggttgacagcatgtggtatgtgtatcttacataggacctgtcatctgagaagagaaagggtcggtttaatctttcattctctgattactcttactctagccctcagaagtggtttatcaagaatatttgattatcaagaatcaggaccatatgttgcttatgtgtagctaggcaatgatagaaaagcaataactggacatttattatgtacttccatgtgcttggcactgtgctgagtgctttgtgtgcatttaatcttcatacaaaatctgtaaggtatctattattatcctcatttagcatatgaagaaacacacatacagaagttaaataacttgctcgaggttacatagctaataagtggcagaattaggattcctagccaggtctgtctggcctagaaatccgactcttaaccatgctgtactttgcccctgtgttgaaggaacaggtggaatgtcaatctcatgttccaacagcttatcctaacctggagctatgctagcaactatactatactgtaacatcagattttattgggctgttttgaaacattctaatatgctagcttagcatatttttcttttctttttttttaatttttgtgacagagtttcacttttcactcttgtcgcccaggctggagtgcaatggcaccatctcagctcactgcaacctctgcctctcaggttcaagcaattctcctgcctcagcctcctgagaagctgggattacaggggcacgccaccatgcccagcaaatttttgtatttttagtagagatggggttttaccatgttggccaggccggtctggaactcctggcctcagatgatccacccaccttggcatcccaaggtgttgggattacaggtgtcagccatcgctcccggcctattttcatcttttaaaagcagaatttccctgttctttggtaatatgatacgggatttatggagttaacagctcttgctattctttagataatttaactgttgggacgatatttttatttttttcctgagttaagaatcctattgagacatttaaagaggtgtaatgtatagtgtacctctgaaataactaacaggaagtatgaccttattctttgtatttgaagctccataatgggagaagtaaagaacaaagacttaaggaacagcttggcgctcaacgtaagaccacctttttttaatattcattatttataaatgcttgataattctagtacaaatattgcatttttagagttggtcatttcctttatctacataatctaagtaagctctcaaaataaaaactggttaaactcttacgatagactcattggcatttctagttgtctattgaattagcttatctaagtttgaacaccatcgtactccatcagcttcatcatcttggccgtatgttaagagatgtgatgtttataactgaaatggaatggagctctaatcaggccatgttaaacattgatccaaccatgataatgaaccatgttaaaccaaatatctagcagcaggaagaggaatggtaaataagttcttgtcttacagcctatttaataaatctggatactctacagatgatatcccccctttcctaagaaagaaaacgtgcaatttaaagatgggtcatttcaacccgcatgagctgttttctctcttaaaacattagcacttgatcccatagatcattttttaaaagattactcttttttttttttggagacggggtctcactctgtcacccaggccggagtgcagtggtacacttttggctcactacagcctccacctcctgaattcaagtaattctcatgcctcagcctcctgagtagctgggattaaaggcacgcaccaccacacccagctaatttttttcttatcttttcttttcttttttttgagacagagtcttgctctgtcacccaggctggcgtgcagtggtgcaatctcggctcactgcaacctccgcctcctgggttcaggtgattcttatgcctcagcctcctgagtagctgggattacaggcttgtgccaccacacccagtttatttttgtatttttagtagagatggggtttcattctgttgcccaggctggtctcaaacttctgacctcaggtgatccacccacctcggtctcccaaagtgctgggattacagggatgagccatggcgcccagcctaatttttgtatttttagtacagataacgtttcatcatgttggtcaggctggtctcaaactgctgacctcaagtaatccaccaccttggcctcccaaagtgccgggattacaggcgtgagccactgcacccagcaaaagtttacttcttttgcttgtcttgagtcctccttgaagtgagagctgagactcagtcttacactgatgaggcacatggctgtggttccgaactccaggaaacggattgatgggctgtgatggagggcttcagtcttatccaagaggcttggaatctgtcctgtgtgtggtgggacatcatgaatgttttgagtagggcagtggcctaatagaagccctctttgtgtggcagtccccttacagatatcttacgactcagtctttgtgctatctgcacctggaaacttattttgcccggattagtcagctggtgtagctcatgtctgtcattctctacctaatattgtgctctccagcaaaaactactgagaagcgaattaattcctgaaatgatagcatgtttcttaaaacactggtgaggtgatgagaattagtattccgaagcctgtttaaagggaaaataggagacctagtagatttgcataggaattaaaaacaattggtgttctttccatttgctccctgatggcaattttatccttggtcataattgtacagatgaggtaagtgagaatccaaatatccctatgatcctgttaggagagctgcttacttgctcttgcttggacttggtttatttgctaataaaagaaaaaggtttctgggctgggcatggtagctcatgcctgtagtcccagcactttgggaggtcgaggtgggtgcatcacctgaggtcaggagttcaagaccaacctgggcaacatggtgaaaccccgtctctactaaaaatacaaaaattacctggtcatggtggtgcatgcctgtagtcccagatactcgggaggctgaggcaggagaattgcttgaacctgggaggtggaggttgcagtgagccgagatcttgccactgcattctagcctgggcaacagagcaagaccctgccccccaccccagaaaagctttctaataacttgggcttaatttaatagaagtttaaaatactcggccaggcatggtggctaacgcctgtaatcccagcactttgggaggccgagacaggcggatcacgaggtcaggagttggagaccagcctgaccaacacggtgaaaccctgtctctactgaaaatataaaaattagccaggtgtggtggcacacacctgtaatcccagctactcaggaggctgaggcaggagaatcgcttcaacctgggaggcggaggttgcagtgagctgagatcgtgccattgcactccagcctgggtgacagagcgagactccatctaaataaataaataaataataataatcaaaccaaatatttatattaatttggacttccaaatagatttgaactgttcagccatcattgaatttgatgaggatggtgataacttcaatttagtaatttcttgctaaatgccttaaactgagatagatatatcacatagattattttgtggcttttctttgtttgtttgtttgttctgttaatatataattgctaaaatacaaaaaatataaaatgaaatttcctctttcaagtatcagagatagctgctattaatgtttgatttttatgcctccagattcttttatatttaagcatatattaatacatgtgtaagtatatgtacacaaatatacatttttaagttcacagaatcaatattatacatatttttaataatccatttttcacttaatatatcctgtgtatctttttttaatttttttctttttttttggagacagagtctcgctctgttgcccactttggagtgcagtggcacaatctctgctcaaaactggttgttcttccacctccctgacctaatcaagtcatttttttctagcaaattagctttaggctcatctccatttgccaggctcactgcccccattgtcactgtcttgccattgacattttattttatgatctcccagtatcactggactatgaaaacagtgccatctgttttataactagcaaacacatataaactttccctgctctgcactctctaaggctgttccctttaggtattgtcaacagtttcagcacatataggaaagctatcagtattgttgggtggtgaggttattagattctcctatcaagttaaaaactcaccagccacctgttcctcacctagaacggggtaggggagagccttctttcacttgctgtttaagcagcttttccagatagcccctgatagcactgggacttgtgttttcttatgtcactttcttcagtgtgaggttgaaaccttggggccaagtatagctggggaaagaagagataattgaagaaaataggaagggagaacagttgttatacaaagaaactcagccagtgtaggggtggacttagctctccttcagctttgtaaatggtttctctctctcatcccccagaagaaccagtgaagaaatccattcaggaatcagaagcttttttgcctcaggtacagaataaatgatctgatttggtattatatgtacatagctgtggataaccctgacttctttaaaaatacctgtccattaagaattctttgagacagtgggactctgagagtgttgttctcctgagaacttccatacaagggaaccctgaataacaaagagaaagatgttaaagtggattgcattagtgaactttggaatgcagggaagttccaaagtagcactcctcatctcaactcagtgactgctgaacatattagtcagcagtgatacttccctgaactttggcttgttctggctttttcttaggttgacacctctttgtaagcagaagcaatagaagggctccctttgtacttgggaacatgccacttatataacttcaggttactgtggagacaaatcactcatgttttctctctttttcaaattatctttattccacaaagccaataaagagagtgggattttcattaaaattaaataaaaatgaaaataatttgtcttaagcacattaccctaatagaggaaaaatttgatattaatgggaaacatttgccgtaatgggaaacttcaggctgtgtctgttgagtgactcacctgccaaaggaaatccaaaagaagagatggtatatgggtgggaccttatagaaacagagcaatatccagagtctttagcatttcttgtcttcctttccagagcatacctgaagagagatacaagatgaagagcaagcccctaggaatctgcctgataatcgattgcattggcaatgagacaggtaggtgtggaagctgcagattaactggtgcccccagattgagatcatggcacaggcaagctgtattcattggagtgatcagcaccaactgccgtgacaaaccagttcaagaatctgtgcttcatcctgggtgcggtggctcatgcctggaattccagcactttgtgaggctgagatgggaggatcacttgagcccagttaaaaattagctggtgtgggctcgggcacggtggcttacacctgtaatcccagcactttgggaggcggaggcgggcggatcatgaggtcaggagttcaagaccagcctggccaatatggtgaaaccccgtctctactaaaaatacaaaaattagctgggcatggtggtgggttcctgtagtcccagctacttgggaggctgaggcagaagaattgcttgaacctgggaggcagagcttgcagtgagccgagatcgcaccaccgcactgtagcctgggtgacagagcaagattctgtctcaaaaaaaaaaaaaattagctggtgtggtggtgcacacctgtagtcccagctacatggtaggctgaagcaggaggatcacttgagcccaaggaggtcaaggctgcagtgagccaagatggtggcattgcactccagtgtgggtgacagagcaagaccctgtctcaaaaaaagaaaaaaaaaatgaatatgtgttacaacacaatagagacttgtttctcattcatgtcacaggctagtgtggatcgggctgggggagctttgttcatgtggctattcagtggctccattatcttctgaggtcttggagttttctacagagtcccttgcatctggctagcagataagggaagagagaatgtgtgaaggatctcacaagagattttagggaccaggcctaaaagtgataatgtgcatcatttccaccccattagattggtcagaactcagtcatgtggctccatctaactgtagtggacatggagaaattagtctcgctgtgtgtcaggaggaaatgaaatggatttgggggacacataacagtgtctctggcacaaagacatcatttacggtagttggtgagccttagtcttgccttttcttttggatgctgaagcagggaggagtcctggaacccagaggggcattaatattaatggaaggcattctggcttcacatattatcacatgccccatcatttcacctagatagacgacaaaagctttcctgggaacattaaagacataataaatgtgtgttcacttacagagctttggatattttctgagctgtgtcagtcagttctgctgtcctttgctttggtcgttggcctcagtctcttctatctgcgcgtcaccattgcttggatctgagatgattcttttgctcagttgttgttggatgtctgactcaaactgaatcactggtgctgcatcaaaagagaatgagaagagcctagataagtggaatgacattctgtttaattatttagctcttccttaagaggatcgatcattgtatttccagttttagagcttctcaacattctcttaaaatgagtcagaactatctttcaggctcacttaaaatgttaccatggggagttttatgggaagaaaggctaagagaaggtcaaattagcaaatataatactaaattttccaggatttcagatacgatcctgcttggtcgtgtcctatttttggttagatgtgagaaagataagtgtcttcttttcagccattagtacccatataagaatgagaaaatattttcttaatgagtcacttcctgttttaagagattatgtaattgtcctgtacttctggttttggtcagttttgtttcattcatcagtagatgttgtacgtatatctgttgtatgagagaatcataaaaaaaaaaaagccatgacctgctgtgaattgaaaaactaagttttttggctaaaactcaatgtctgtgcttgcttctgttgctgggttatgggcctcttgggggcgggggctgaatgtatatttgaatttttctgcattataggagcatgatcagagttgagaaatggaatatgacagtgtgggtttgaatcatggctatgccatgttctagcttgtgaccttgggcaatgtccctggcctctttattttttttaatgtttttttttttctttcttgagagagaatctcactcttgttgcccatgctggagggccatggtgcgatcttggctcactgcaacctcttcctcctgggttcaagcaattctcctgcctcagcctcccgagtacatccctgccgggaatacaggcgcccgccaccatgcctggctaattttttgtatttttagtagagacggggtttcaccatgttggccaggctggtctcgaacttgctgacctcaagtgatccacccacctcggcctcccaaagtgctgggattacaggcatgagccaccacgctcggcttctaattttttttaatttaaattttatttttatttttcctgtagtgctgagttctcggccttcttaagtcccagtttctcttctgtaaagtgggttaataacaggacctacctcatagggaggttgggcagaatgagagttcatacttggaaagggcttagaataatgcctggcacagtgtgagcatgtactagatgccaactagcattatttcctcatttgcttgttcaattctagccataaaccacctaagcaagagctcaccatggctttgcacttggtacatagagtctgatctcagacaagtgagagaccagggcactgaggcctgccctaggcccaagggtgagtggaatgcatccccatagactgaggcgcactggaatggaggccataacttgagagggttatccaacttcttggataaacactcaagtggaaagctgagcacagcactcctaccagtcacagtctgaatgggcttggcagaggagaatctaagtacaaagtacaggagggcagagacctgataaaagagaaagatggaagaagatggtagaattggaggcagagcctggggcatcatgcttttggccacaggtatgagcaggtattggtcttgactgcactggtacatctgtttcctgccccatggttgcggatgtatctgtatacgagctccaagaatcagaatggcagctctagacagcaggtccttcctggtcagacatagtcctttaaagttcaacatcttggtggtacattgctggacaagagtaggcctgggccattagagggtaccctggatgctcggtgctgcctttcccctgagaatcagggtgatttgactcaagccttctctgcctctgggaacaaaatcagtaattgggcttgaggccacttataaacccccctgggctcaggtggctaattagcaagtaagaaacaaggcagcacacttttactcttcttgtgctatggttttcatcagctgagaggtcacaaatccacttacatgcagactcagagcagcaggagaacattaattattaagaagtggaaaggcacagtctcctctcctcacaccatctccctaggcctccagctcttcatttccctcctcctctcctggtaatttgtcactgaagattctaggcccagaatcctgccttggttgaaaatggttgttattattagtgcagcacccttcatctcttttccttctaatccgcagttagggggcttcatctagagtaattatgtggatttcctctgtctggttaactttgccatctggttaacattgaacacttgggaggagtgcaggagtcagataatgaacaagcgggtaaggtaattgccagccgaaataaggtctctgaaagaaagaaacaagaacatgataggactaacctaggcatagctgtgctcagagtatataatttattaaaaatctactacgtgccaggtactttgctaattgctttacacggattcttgcttaatcctcatgaataataccataatataggtactattctctccattaaattttttttgttctacttagaactaatttgctaggaatattctattttcttttctttcttttttttttttttttttttttgacagagtcttgctctgtcgccaggctggagtgcagtggtgcaatcttggctcactgcaacctctccctcccaagttcaagcgattcttctgcctcagcctcctgagtagctgggattacaggcatgcgccaccacgcccagctaatttttcttttttctttttatatttttaatttatttttaagacggagtttcccttttgttgcccaggttggagtgcaatggcgcaatctcagctcaccgcaatctccacctcccaggttcaagcgattctcctgcctcagcctcctgagtaactgggattacaggcatgtgccaccatgcccagctaattttgtatttttagtagagacaaggtttcaccatgtcggccaggctggtctcgatctcctgaccttgtgatctgcccacctcagcctcccaaagtgctacgattacaggcgtcagccatcatgcctggcttattctctccattttcaaggtgaggaagctgagcagtgaactacactcctaccttctctagtactgattgagctgggattcaaaagctggactccaaaacctatgcttttaactactttgcctcaatataatttccatgaaggtgagggagtttatctatctcctactatgggtctccagtacctggaagaatacctgctatgtaggtgttcaataaataattgttgggtgaatgaatgaaggaataagctctcccagtgtcagtgtgtttctaaaagccattcctttttatctttagagtttagcagactctcttctacctatcttcccttctctcctcaaaaaaccagacttttatccaaaaagcatgcaagtcccccaagtatttaaagctttatttctttgtttgtccagtaaatgttcgttgagggcctactatgtgcaaagcaccatgcttggccctgtgtgaagcaaatattaaggcaatgaggtggagtctgatctcagagctgtgttgtgcatgaaataaggttattctttggtagttctttcttgagaagaattcttatggagttcagtaacctcttcttgaggcagaagtaaatgctcagggatttgggaactaattatctcagtttggtagaattgaaaaataagtctttggtgttgtgtcatctgtgtcagtgacagcaaagctggacctgtgctaggccctggtgggtcatctttaagcactggacttttatcttgttaggaatatagaagcaagcgtctcacatctctgacagatgggctttacggcttggcctaaagctctggttgtttttaaggcccttgaataaaaataaaagacgatgtttgcagattttaagaggaagttttttttttttttgagacagagtctcgctctgtcacccaggctactggagtgcaatggcgttatcttggctcactgcaacctctgtctcccgggttcaagcgattctccgcctcagcctcctgagtagctgggattacaggcacccgccatcatgcccggctaatttttgtatttttgtagagatggggtttcaccatgttggccaggctagtcttgaactcctgacctcaggtgatccgcccgcctcggcctcccaaagtgctgggatcacggggatgagccatcgcacctggccaagaggaagtattttttttttctatcctgctctttctgaaaagcttgaacatttttctgtactttccttttcttttttgagacagggtcttgctctatcacccagaatggagcacaggggtacaatcatggctcactgcagccttcacctcccgggctcaagcaatcctctcacctcaccctcccaagtagctggaactacacacaggcgccaccacatccatctaatttttaaaatattctgtagagacagggtctcactatgttgcccaggctggtctcaaacttctgggctgaagcaatcctcccacttcagcctcctgagtggctgggactacaggcacatgctatcatgtctggctaactttgttttttatagagacagggtcttttgctgtatttcccagggcggtcttgaactcctggcttcaagtgatcttcctgccttggcctcccaaagcactgggattatggccatgagccaccacgtaatctttgttttatgcgtatttataagctttgcttccccaacaagattataagctctttgattgaagtacatcatatatttgatatgtattctcttgtccaagtgtttctgtaggcaataaggggaactttgtaaaacaagagttttccggtcaagtaaatttgagaagcgctgcctaatctcttccccctcagagatttgcaatgcatattgacctattaaaggctctgagaattcttcctgcgaagaaacctattttagccttgtccaccttgcatttcccaaacacgtttgacctcagaactccctttttcactaagaatgttttgcccatcttatgttttacccatgtgctctatagcagttaacactgggcttattaaaggtactcaatatgtgattgtaaattaactggtgaagcattccctcattcttgtttattttatacatttatttaatgaagcccttttcatagaaattgtcaagataaatgtatcctcatttagatcaaaacaaattctaaattaatgaagtcatgacattttactgtattttggtttttttggtttatctgtgaagtcctcaaacctgtgagtagtgctgaccctagccttgaatgaacagccctgtactaactgcaaggccagaagaacccctgcccttcccctccccacccccccacatcatttccagaagttctaaagaacagttgaaatttacggagatcagactgggttgagtgtgggatttccagggtgggttctagaaggagaagtgggtcttctgtagtttgttgaaattttattttccaaacccagcccccaagtttttcttcctctatttatgtgcaaggacaaaacagttactgtcctacctacataggatatggactctgtctgctctgagcccattttagtttagaatatagagacctccctccaggtcctaagagagagattccatgagagatgtgcaacaccataaggttggtgatttgtactttgaaatggctgcctttatttcctttaaagtcaatatcttatatttgaataaacacagtttgcaaagcatctttacagaaatctcattggatcctcacggtcaccttttttctgagacagagtctcactctttcacccaggctggagtgcagtggagcgatcttggctcctccacttcctgggctcgagtgatcctccttccttagcctcccaagtagctgggaccacagatgcgtgccaccatgcccagccaatttttgtatttttggtagagatggggtttcgccatgttgcccaggctggtctcaaactctgcagctcaagcaatccacccgccttggcctcccaaagtgctgggattacaggtatgagccactgtaccctgccctcacagtcaccttttgaagaacctcctgctcaagagatcctcctgcctcagcctcctgagtagctgtgatgactacaggcttgtactaccatgcctggctagtttttttattttttgtagagacggggttccctgtgatgcccagggtggtctcaaactcctgagctcaagccatcctcccacctcagcctcccaaagtgctgggattgtaggtgtgagccactgcacctggccaagcattagttttaatcttgttttatagatgaataaactggggctgactcaaactgactcaaagtcacactgtcattacctttttgatcctgtacgttagactgggctgtatgcatgttcttgctggcgcaataaagttgcaagtgccagctaacagcccttcccactccacctcaccacctcatagaggaaaattgtgacgttaatgggaaatgtcagcggtaatgtcttcaggctgggcctgtggagtgactcccttgccacaggatatttaagcaatgctgtgtcttgtctgaggctcagacctgctattcttattggcacttgggacctgcatggtttttggcttcacctccagctttagccatttttcttctgttcttttaggtaaggattttctgccccagacctcagattcccatttccttcctagcttctctgctgttatagctcagtctcttccaagaccatgcaagattcagaccctagtaggaggagatggaggaactaggacttaaacccacatcttgtgattccaaggctggttcctcttttgccctgcaccacacagctgtctgctcacagtcatgtgacaggggcttccccagccagaacctccagggagcacaaataaaggaaagagctggaaggcacagtacagcatttgttctgtccaagccttacatatcagcatgggcagggagaatgtggtgaagttttctttcaaggactttgtttgataaggaaggacatttatcagtgaagagaggttttgagggaagtgaaccaatcttgagataagtacacaaaagagctttgagtctggtgtttccctgtttgcttctgccccctggaggagcaaatactccatgattagagacgtgtgagtcctttggaatagaatagcagtgatggaactggagtcctagtccaggttctctccttgttcagcctggattcagcactgggtatcgaaacaagcctgcaccctcagaggagatggctaggggacagtgcgtccaggcctcttctaccacacagagttttcttttttttataaagggtatacacatttaaaatttaatgatactcccaaattgctcttcaaaaaggctgtgcaaaattacagtcctgataacagctacccagagatcctgtaacggcatttgccctcatcattattattattattattattattattattattatttgaatttgagacggagttctgctctgttgcccaggctggagtgcagtggcgcaatcttggctcactgcaacctctgcctcccgggttcaagcaattctcctgtctcagcctccctagtagctgggattacaggtgagcaccaccacgcctggctaatttttgtatttttagtagagacggggtttcaccatattggccagactggtctcgaactcctgacctcaggtgatctgcccgtctcggcctcccaaagtgctaggattacagatgtgagccactggggctggttgccctcactatttaatgggttatttgcaacctgtgaatcatgtctcctatttccttgttaatgatgcttattgattatagacttaggaatatcagcacctcctttgtagctcttcattcttacatgatataataattaatttttttttttgagacagagtctcactctgttgcccaggctggagtgcagtgtcacaatgttggctcactgcaacctccacctcctgggttcaagcgattctcctgcctcagcctcctgagtagctgggactacaggtgcgtgccactacacctgactaatttttgtatttttagtagagacagggtttcgccatgttggctaggctggtcttgaactcctgacctcaggtaatctgcccgcctcagcctcccaaagtgctgggattacaggtgagccactgcgcccagccaataattcattgtttaatccttagttgtgggccaagcaaaggagaaaagtaagaagccttttccttttaccgataggaaaggtcaaaggacttacctggtgaattatttacctaaaaatgtatacaaatcactccaaaatttagtggctaaaaacaacagtactaatttaattatatcttcacagttactaatttaattatatcctcacctgtgggtgaggaatttaggagcagcttagctgggctgttctggcccagagtctagtgaagttgtggtcagttgtcagctgggtcatctgaatgcttgattgggattggaggctccacttctatggtggtcactcacatgactgagaagttggtgctagctgttggcaggaagcctgttcttcatgtgggcctctctgagggactgcttgagtactttcatgatgtggtggtgggcttctcccagagtgagccactcagaagagagaaagattgtgaggtctggacttcaataagaagattgttgaagaaaaaaaggttttgtccccccttggtttgattggactagagtgggctcagtctgtgcctgtggctggcatcaggcaggaacagtggtatagcagggtatagaccatatttagggacctaaaatcacatctttcatgattcatgtggttcttgttccaactgcccaggactcaggcacatcaaaatatgacacaaaagcagaagcttttcataatggagattagaccatgtctaggattcctacccagtcctcttgagctctcctcactccagtgttgttttccgtgtttgttttttgttttccccagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaaggtgagcccccaggaggtggtcagttccggaccacctgcttattttcgtgccaccaggatgggaattaccactgtgccacatttgctgcccatctcttccgggaggaaaagagattttccctcctgcattgggcttgccctaggactacagtatagacccggcatgatttataaatactttgtagttagttagtttgtagtttgaatacttttctttaaaattaagaaattttcagcctgggcaacaaagtgagaacttgctctataaacatttttaaaattagttgggtgtggtggtgtgcgcttatagtcccaactgcttgggaggctaaggtaggaggattgcttgagcccaggagtttgaggctgcagtgagtcgtgattgcactactgcactgcagcctgagcaacagagggagaccttgtctccaataaacaaataaataaatacaaataacaaatttatttatttttatttatttttttttttgagatggagtcttgctctgttgcccaggctggagtgcattggcgcaatcttggctcactgcaacctccacctcccaggttcaagcagttgtcctgcctcaccctcccaagtagctgggattacaggcatgtgccaccacgccctggctaatttttgtatttttagtagagactgggtttcaccatgttgaccaggccagtcttgaactcctgacctcaggtgatctgcctgcctcagcctcccaaagtgctaggattacaagcgtgagccactgcgcctggccacaaatttttatttttaatttttctttttttttttttttttttttttttgagacagagtttcactcttgttgcccaggctggagtacagtggcatgatcttggctcgctgcaacctccgcctgctgggttccagtgattctcctgcctcagcttcccgagtagctgggattacaggcgtccgccatcacacctggctaatttttgtatttttagtggagacagggtttccaccatgttggccaggctggtctgcaactcctggcctcaagtgatccacgtacctcggcctgccaaagtgctgggattacaggcatgagccaccatgctcagccaccttccagatctttttttatttgatacccacacagtcatgtagaagtatatcttttttgtttgtttgttttttgagatgacatctcactctgttgtccaggctggagtgcagtggcacacctcggcttactgcaacatccacctcccgggttcaggcaattctcctgcctcagtctcctgagtagctgggactacaggcgcacaccactacggctttgctaatttttgtatttttagtagagatggggtttcaccatgttggccaggctggtcccgaactcctgacctcaagtgatcctcctgccttggcctcccaaaagtgagccactgcgcccagcctggaagtatgtttgtaagcccagatggaatcatcatctattgtttcttttttttaattaaaaaaattttaatacagttcaaatccccatgtctggctcatttcagctcctttactgccaaagcaggggacaaggactgcttcagtttctctgccttctctttctctgaaggtatctgctgcattgaacttgaaagttcacattatccttatttttcttgatcttgacagatttggcatcctttcacctggctgtgagcagaaagtccttgatttcctcaattttgcaaggcatggcgatgaggcacacagggagaggacaaggacaggcacccctctatcccatgtatcacccaaaagacactcacagcctgccatcactttataacctgcttttagtttgtttaacagtagatcacaaacatttttgcatgtcagtagtcacatttctacagcatcagtttaatgtatgcacaatagcccataatatggccatagcttaatttacttgatcaatcttcagttgttgcacagtgtttgctttcatacgaagtaagtattaaacatccttgtaacttagtatttgttcttatccttaattgttttctagggggacaattcccggaagtggaattacagagtcaaaggacatgcatttttcaagcctcggatgcatcttactagatgtcctataggatggtcatatcagctttataggagagtagctgtgtccctgaattctccctgacactgcatgctcttatatttcctcaagttttgacaatttgataggtgaaaagtggtatctgactgttcagatctggaaggctttgttatataaacatttttttaatgtttattggcaagaatacttttctaagagaaacatcagtgagctggtttccatttaagctgaatgaagccacaatgtacctcaagtataagattaactggcctttttcagttgcactctaattacaatttagaatgatgtttctgagccacctgtcaaatgcattctgggctgtacctctgcgtaccccaggaataaatctcatggccttctttacctggcctccttagtggtggcccagcaggaagcgggggttagagcaggagccactcagccttccaagatagatactccatgggccggtggtattactggccttttgagcccatccccatttgcatagatgatccacgtgggttatcatctggctggtatgttcccagagtgaaactcagcagccccttgagggaggggatggtggccatcaggccagagtattgcaagttagtttggatcatttgctaagcagcttgtggtgccttcagaaaggaacagtttcaaagaactttcacatctgttggctcatttcgccctaatgacagtcttctctttgatatttgcatggcattaaattttgcctttcttgttttctccagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacagctagtcaagtatatctttctctgatttgatagtgtgacctaaaaggggaccattgtttgaaatatcattagagttgcttattattattattattattattattattattattattattattattgagacagagtttcattctgctgcccaggctggagtgcagtggcatcatcttggctcattgcaacctctgccttctgggttcaagcgattctcctgcctcagcctcccgagtagctgggattacaggctcctgccaccacacccggctaatttttgtatttttagtggagacagggtttccaccatgttggccagcgtggtcttgaactcctgacctcaggtgattcaccagcctcggcctcccaaagtgctgggattacaggtgtgagccactgcacctggcctattattatttttaaattttttttttttaattgatcattcttgggtgtttctcacagagggtgatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcactgcccttaatccatttaaccctgagtggacacagcacatgtttcagagagcacagggttgggggtaaggtcatagatcaacagcatcctaaggcagaagaatttttcttagtacagaacaaaatgaagtctcccatgtctacttctttctacacagacacagcaacaatctgatttctctatcttttccccacctttcccccttttctattccacaaaaccgccatcgtcatcatggcctgttctcaatgagctgttgggtacacctcccagacggggtggcggctgggcagaggggctcctcacttcccagatggggcggccaggcggacgcgccccccacctccctcccggacgggatagctggccgggcgggggctgaccccccacctccctccccgacggggcggctggccgggcgggggctgacccccacgcctccctcccggacggggcggctgccaggcggaggggctcctcacttctcagacggggtggctgctgggcggagacgctcctcacttcccagacagggtggctgtcgggcggaggggctcctcacttctcagacggggcagctgcgggcggaggggctcctcacttctcagacggggtggccgggcagagaagctcctcacatcccagacgggggggcggggcagaggcgctccccacatctcagacgatgggcggccgggcagagacgctcctcacttcatcccagacggggtggcggccgggcagaagctgtaatctcggcaccctggggggccaaggcaggcggctgggaggcggaggccgtagccagctgagatcacaccactgcactccagcctgggcaacattgagcactgagtggacgagactctgcccgcaatcccggcacctcgggaggccgaggctggcagatcactcgcagtcaggagctggagaccagcccggccaacacagtgaaaccctgtctccaccaaaaaaatacgaaaaccagtcaggcgtggcggcgcccgcaatggcaggcacgcggcaggccgaggcgggagaatcaggcagggaggctgcagtgagccgagatggcagcagtacagtccagcttcggctcggcatcagagggagaccgtggggagagggagaagagagggagggggagagggctatttttaaaattttttaaaattgctgaacaggggtacctctgggcagtgtgtcagaataccactttttaaatattttatgatttatttatttttctatttcttgaggttttaactgatgtgtatctgtatgtctatttgtgtatattttgtcatgatcatgtaacagagtctgaaaagtgtcgaagagacagttttcaggaacaacaagcaattattcctactttccaagttattttgatgccatggtggctcatacctataatctgagtactttgggaggctgaggtggactgatcacttgagcccaggagtttgagaccagcctgggcaacatagcaagactccatctctacaaaaaaagacaaaatttagctgagcgtggtggcgtgttcctgtagtcccagctacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagagatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcggtggctcacgcctataatcccagccctttgggaggccaaggcgggcggatcacgaggtcaggagatcaagaccatcctggctaacatgtaaaaccccgtctctactaaaaatacaaaaaattagccaggcgttgtggcggtcgcctgtagtccctgctatttgggaggccgaggcaagagaacggcatgaacctgggaggtggagcttgcagcgagctgagatcttgccactgcactccagcctgggcgacagtgcgagactctgtctcaaaaataaataaataaataaataataaataaaatgtttggaatgttggcttcatccctgggatgcaaggctggttcaacatacgcaaatcaagaaacataattcatcacataaacagaactaaagacaaaaaccacatgattatctcaatagatacagaaaaggccttcaataaaattcaacgttgcttcatgttaaaaactctcaataaactaggtattgatggaaaatatctcaaaataataaccatttatgacaaacccacagccattatcatactgaatgggcaaaagctggaagcattccccttgaaaactggcacaagacagggatgccgtctcaccactcctatttaacatagtattggaagttctggccaagaaaatcaggcaagagaaacaaataaggggtattcaaataggaaaagaggaagtaaaactgtgtttgcagatgacatgatactatatctagaaaaccccattatctccacccaaaagttccttaagctgataagcaacttcagcaaagtctcaggatacaaaatcaatgtgcagaaatcacaagcattctatacaccaacaatacacaagcagagagccaaatcatgaatgaactcccattcacagttgctagaaagagaataaaatacctaggaatacagctaataagatgtgaaggatctcttcaaggagaactacaaaccactgctcaaggaaataagagaggacacaaatgaaaaaacattccattctcgtggataggaagaatcaatatcatgaaaatggccatactacccaaagtaatttataggttcattgctattcccattaaactactattgacattcttcacagaattagaaaaaaactactttaaaattcaaatggaaccaaaaaagagcccgtataaccaagacaacaataagcaaaaagaacaaagctggaagcatcacactacccaacttcaaagtatactgcaaggctacagtagccaaaatggcatggtactggtacaaaaacagacacatagaccaatggaacagaatagagaccagagaaagaagaccacacatctacagccatctgatcatcgacaaacctgacaaaaacaagcaatggggaaaagattccctatttaataaatggtgctgggaaaactggctagccatatgcagaaaattgaaactgaccccttccttacaccttatacaaaaattaactcaagattaaagacttaatgtaaaacctaaaactataaaaaccctagaagaaaatctatttaataccattcaagacataggcacaagcaaaggtttcatgacaaaaacatcaaaagcaattgcaacaaaagcaaaaattacaaatgggatctaattaaactaaagagctcctgcacagcaaaagaaactatcattagagtgaacaggcaacctacagaatgggagaacatttttgcaatctatccatctgacaaaggtctaatatccagaacctacaaggaacttaaaacaaatttacaaggaaaaaaacaaccccatcaaaaagtggacaaaggacatgaacagacacttctcaaaagaagacatttatgtggccaacaaacatataaaaaaaagctcaaccttactgatcattagagaaatgcaaaggagaaccacaatgagataccatctcatgccggtcagaatggtgattattaaaaagtcaaaaaacaacagatgctggcgaggctgtggagaagtaggaacacttttacattgttggtgggaatgtaaattagttcaaccgttgtggaagtgtgtgtggctattcctcaaagatctagaactagaaatactatttgtcccagcaatcccattactgggtatatacccaaaggaatataaaccattttattataaagatacatgcacatttttgttcattgcagcactcttcacaatagcaaagacacaatagcaaatgcccatcaaagatagactggataaagaaaatgtggtacatatacaccatggaatactgtgcagtgcagccattacagcttttggtgatacagtgaatcagatttttcattaattcttttaattggttattactgaacgtgaaaaagtaatgtttgtattgaaatcttgagtctggccatgtttctattttaaattcataaagaattctaacaagaggaattccaagaatgtcataaatggatgtttctccatggatgaaggaactgttttattcacttgctgataattcagcctaatccagtttgacatcatatagataagtagttgaattatggatttaaaatacatatcattttctaactccaaaggtaatacttatttaaatggttttgaaaatatagaaaggcacaatttctttttaaatctgttattctccaccaccactcaatctgtctatcatctatctctccattcattcttccatttgtttatatctgttaatctttgtatgtgttcatgtatagcttttacatgattggaatcataatgcatattccattttgaagtctgcttttttttacacaaaaatatgttgtgaatattttcctatattatgaaatatcattagctgagcttttagaattgactgcatgttttggtaccatttagatatagtttaagatacttagaagttatgtggctttgccactatggatgaatcttatttactcaatattaattacttacaaataacctcacctaaacactactcagccataaaaaggaatgaattaatgacattcacagcaacctggagactattactctaaaggaagtaactgaggaatggaaaaccaaacattgtatgttctcactcataagtgggagataagctatgaggatgcaaaggcataagaaggatacaatggactttggggacttaggggaaagggtgggaggggggtgaaggataaaagaatacaaattgggttcagtgtatactgctcaggtgatgggtgcaccagaatctcacaagtaaccacttaattacttacgcatgtaaccagataccacctgttccccaaacacctatggaaataattttgtttttttttttaaaaaaggaatgagatcatgtcctttgcagggacatggatgaagctggaagccattatcctcagcaaactaacagaggagcaggaaaccaaacaccacatgttctcacttgtaagcggaagctgaacaatgagaacacacggacacagggatgagatcaacacacactggggcctgatgcaggggccgtagcggggagagcatcaggataactagctaatgcatgtggggcttaatacctaggtgataggttgataggtgcagcaaaccaccatgggacacgtttacctatgtaacaaacccgcacatcctgcacttgtatccagaacttaaaatattttaaaaatctttagagaatacaaaaaaaaaaaaaaagattcttcaatgcatacacaataaaattgcagttcagtcaaacattggaagtctttctctgactgtctagttggtatcttcattttcagcttcttcaagatcccactccaaacactgttagctcagccaaattgaacagctcatatctcctacctctggatctttggttctggtgattgtatatttctggaccatctggaaccccagcatatcaccctaccccacatctccacatccccaaaatataaccatacttcaagggcagttcaaataccatctccttctatcctccatgaagtcagttatctcttccattggaattatcgccccctctcctgaacagtactatttcgtgtgaatctcctccaagccttcttttcattttatatctcatgctgtaattcttggaaagtatgctgtagctcaagtgcagaattctcatcagttttatctttatatctctcctaaacactttacctgatgaagagcctggcatacacataaatatatattgaatgaatcagtgatggattgaaaagagaaatgatggatctcctaaattttaacttttataaaatattttgatacattcatgaccttactttagcaagcaatgaacgtgatgtaaactattgttgatatagtttttatattggaagtgtaagtagtttgtggcatgggattgtgacatatcctaggtttcctcatcttctttttattgaaatgtaattcacaagccataaaatttgcccctttaaagtaaatgatgcagtggattttagtatatttacagagttgtgcaatcatcaccactatctaattccagaacatttccatctacctagaaactccataccagtgagctgccactctaatcctcctcttcccccagcctctagaaacaataatccattttctgtctctatgatttgcctgttctagatattttataaaaataaacatgtggcctttcgtgtctgacttccttcactta

SEQ ID NO: 1217 - DNA, 39725 bp, Homo sapiens
tgggcacttggagttgtcttaggactgatgtctgaattaactaaatgaacttgtctggtttgcagagtgctgatggcagagattggtgaggatttggataaatctgatgtgtcctcattaattttcctcatgaaggattacatgggccgaggcaagataagcaaggagaaggtgagttttcttcttttggttcatggccccaggagcctatcagaagtgggagctactcttgttgatacagagagagggaagcaggcagtctgccgccactatagtgggagtcagacatctcaggtggcttttaaacaacatgaatgggaagagaattggtttatgaattgaagaaataggattataacatcttctggtgtggtcttggatgtttctttcatccttggattttatccttgtttctgtaaaattcataggtctggctcatatgtgtttccctccctggtttgatggggttgtggggaagacatcccatctgcttgtgctgggggaaaacaggaaggaggtgctagtccactatagtatcactctcctactgccatctatttctcctcagctgactcaaggtcattgtggggtctaggctgcatgtaggagtggggtggggggaggttcttgtgactggtgtatctgggaaatggtaaaagtagagatttagagttgaaaaccaggaggccgggcgcagtggctcatgcctgtaatcccagcactttggggggccaaggtgggtggatcacgaggtcaggagatcgagaccaacctggctaacacggtgaaaccctatctctactaaaaatacaaaaaaagtagccgggtgtggtggcgggcgcctgtagtcccagttactcgggaggctgaggcaagagaatggtgtgaagctgggaggcagagcttgcggtgagctgagatggcgccactgcactccagcctgggtgacagcaagactccatctcaaaaaaaaaaaaaaaaaaaaaaaatgaagaaaagaagaccaggtagtggtgaagatctcggggatgtcatgattgctagaaaaatatttaaaatccatggccaggcacggtggctcacgcctgtaatcctagcactttgggagactgaggtgggcagatcacctgaggtcaagagtttgagaccaacctggccaacctggtgaaactccgtctctactaaaaatacaaaaaattagccgggcgtggtggtaggcacctataatcccagctacaggaggtgaaggcaggagaatcacttgaacccaggaggcggaggttgcagtgagtcgagattgcaccattgcactccagcctgggcgacggagcaagactctgtctcaaaaaaaaaaattttttttaactccagttggcctagcacaatggctcatgggcacagtggctcatgcttgtaatcccagcactttgggaggctgagccgggcagatcacttgaggtcaggagttcaagaccagcctggccaacatggcaaaaccccatctctactaaaagtacaaaaattagctgggcgtagtggtgggcgcctgtaatcccagctacttgggaggctgaggcaggagaattgctagaacccaggaggcagaggttgcagtaagccaagattgtgctattgcactccagcctgggctatagagccagactccatctcaaaaattaaaataaaataaaataaaataaaataaaataaaataaaataaaaaaatataaaataaaataacattctagttggccctacatggtactgttgacctaaggataggccaggaaatgtttgagaacctattgtttctaaaatatgacaataggtcctcaaaataggcaggccagtgcctgcctgtaacgattcagataagtcattgcttgagaatttcctcatgttcctaatgattatagttttgtttcttaagtcccatcaaatgcaaaatgggaaggaaaatgaaactagaactccctttttggtttctcctagtaattgtctctcccagccatttatatatatctaaattatgattattattttcaaaaataaagatagcacttcagtaactaaatgttaaatgcaaaggaaatagatcccaaagcaatgcctgtttctgaaatatcgttcgttcataatcactgtggcccaaggtaaacgaatagcagaatactcaaaccttgttgtaatttcacttttttataatcccctgagtcagaacgtcagaatgagttggaaggcccaatattgattcaaatattttggaaactttaaaactataacatgtgatttttctcataaagtctttccccagctacctttcttctcctttttcagagaagcccttagagtttttcactatgacaccagcctggccttttggaaaataataaacttaggaggattgtcttttcagccctgctctttcacggtccttctcaatgacacaacatggcacacgtgtctctctgcaaccaaggagcagattgatgaccaaaagacttaccaccacctctgttctgagtaaaaatcaggagtctaagttgctcatgacagagatgtctggtttaagatcactgaaggtcactgaaagggctcatcttgtcacattttcttactgctataaatcacatggactgaggtttgcatttggggcttattagtcagctctattttttttttttgagacagggtctcgctctgctgcccaggctggagtgccgtggtgcaatcactgctcactgccttgacctctgagttcaagtgatcctccacctctgcctcctgagtagctgggaccacaggtgtgtgccaacacactcagcttattttttttattttttgtagagatgggggtctcactattttgctcaggctggtctcaaactcttgggctcaagcagtcttcctgcctcagcctcccaaagtgctgggattacaggtatgaacttctgcacctggcctagctagctctattgacatttgttttttgttggtggttctcttagagtttcttggaccttgtggttgagttggagaaactaaatctggttgccccagatcaactggatttattagaaaaatgcctaaagaacatccacagaatagacctgaagacaaaaatccagaagtacaagcagtctggtaagaattttggcctctcagtggtctaggggaagtactctgtgcatgggggtgggcatcatgactgataaatattcatttgttggataggtggatggaatggaacctggatgaccaaagcctcctttagcttgtggctagaaatcgcgtccctttatattcttcatatcccagatctgccaactccattgccctgtatattcatgatctctgcaaaatgctgccaagcagttcttaacatttcagtcttcaagaaagaatctgggatctgcacaggctggcagagctatggacattcaggggttttgcatgtatgctgaaccctactgccttgctctggtatttggcctcacaaccactgtccaacttcgggtgatgtcacttgggtctcataccttccttgcatgtgtcccaagtttcacaaaacctccttatggaaaagagcacattcgatttcttccttgataaaagggaccagattcacattggccttctgctttacttgcattcctcattgtcttttagactcagcctcagcttgggctttgttagcaagttcactgccaccatagcatcacagcctaaagggcatggctgagactcattgatctatagagcactcttttaccccaacatactctaaatgactgatcaaagatcaaaaacagaagagcatttatactccattcttgttttttgagacctgcttgatttattccgattatttaacacacagggacgcaacagtgatcccaaagtgtgtaaagttaaagccttcaactgcagctgaggagagggcaggaatggggacggtggtgagtcaggaatgacaggcaggcagccatgaccagggcagcctcctccccagggccagggactggggagtggcctaaggagcaggacctaagggtagcccagagctggggaagggggcagagacctccccttggcctaggtctggagctcagaagtgccacatgcctgagggggcagcggcctgggaagggccagaggcagggtcaggagagcaccatttcctggggggctggggacagggaggtgccctataggagaagccaggaggggccgtctgcccctgaggtgggggctgggctggagcaggctgcagcaagaaagacctgaggcaggcacagggcctgagagcccagctgcctgggttcaggggggctcccagggcagcctggcccagggagcagtcctgactctgcaggggatgcccagcaaggggggctgcagacccctcagagcctcccctcctctctccctggaaaggagctggggaacccatagtgcaaatctgtggaccactcagttatggagggaggctgtgcctgaaggtggacactggggtgcactccctccaccatctcgccctgcaccgctgtcctcagtacagccacttctcgtaagagtgcaggccatggatgccaccgtcgatctgggctgacatggtctgcttctcaaacttgagctcccctgagtacatcatggaccgaaggacagacaggctgtgggccccgatatcctggcagccatgctggatgcccactatgaggtagggcacgaacttctgaatggaccctttgtcctggatggagcccaagacatcctgcgtgatcttcgccttatccccgtcgttgaagtattgtttctggctgctgctgctcttctccatggcatccagtgagcccatgccctggtacttcttgagctgcattccgtctgagaagaagcactcgccgggggcctccatggtggcggccagcagggagcccatcatcactgtggaggctcctagggccagggccttgaccacatgccccatggtctggatgccaccatcggctatgatgggcacaccaaagttctgggtatgcttggccaccttgtacacagcagtgccctggggctgactgcaggctatcacttcctggttgatgtagatggagccgcgcagtccatgcccctgcccagcccatccacaccagcgtcaatcaggttgttggcctgggctgctgtcaccacgttccccccaatcacctggaggtggggttacttttgtttgatgtaatgcaccatggcgatctgatacaccgagttcccttgggacgagtccaagcctatgacattgacgcctacctgggtgagcaggtccaggtggtatttgtcatcctcatgggtacccacagctgccccgcccagcagctgctcatgggaatccttggaggccacagggtagtctcggttcttcagcgcggtgcaggtgataatggccaccagctcatcgcgatcattgacgataggcagcttcctttcttactaagctgcaggatctcatttgcctctttcaacctcacactgctggagccaccactagcttgatccttggcatcatcacctcactgaggagggtggtgtggtccttctcagcaagaaagtcgatgtctcgggaggtgacgatgcccaccagcttgctgcccatggtacccgtctcagtgatggggatgccagagaagccatgacgcatcttggcctccaacacatcacccacagtgtgcaaggggctcagcaccacggggtgtgtgataaagcccggttcaaacttcttgaccttctgcacctcactggcctggaactctggggtgcagttgtggtgaatgaaaccagtacctcccatcagagccatcacgatggccaggtcggcctctgtcacagtgtccatgggggaggagatcagcggcgtcttcagagtgaccattgggtcagggctgaggtcaggtccacctcatcagctatgaagtctatgaatcctgggagaatcaagaagtcgttgtaggtgagtccctggtcactggcgaagagctgctgcacggtgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgaccgtcccccagcccgacacccataaagggtctgtgctgaggaggattagtaaaagaggaaggaacgcctgtttgcagttgagagaagaggaaggcatctgtctcctgccagtccctgggcaatggaatgtctcggtgtaaaacctgattgtatgttccatctgctgagataggggaaaaccgccttagggctggaggtgggacatgcgggcagcactactgctctttaagtcattgagatgtttatgtgtatgcatatctgaagcacagcacttaattctttaccttgttcttgatgcagagacctttgttcacgtgtttatctgctgaccttctctccactattattctatgaccctgccacacccccctctccgagaaacacctaaaaatgatcaataaatactaagggaactaagaggccggcgggatcctccgtatgctgaacgccggtcccctgggcccccttttttctttctctatactttgcgtctgtgtctttcttttccaagtctctcgttccacctaacgagaaaaacccacaggtgtggaggggcaacccaccccttcagcgcagtgaacccgtcctcgaccacgtagccggtgctgctgctgataggtagtccctcatgctgccgcgagaccccgcgacccgacataaacgctgcagctgctgcgacgcggaggcgcgccgctgccacgctgcagccaggcgccgggtgggctgggtgggctgggggcgggggctgcggcagcggcggggcgggccagggcgccctatactccattcttcatgatgtttggtcgaagagtcatctgaaattttgaattcagtaaggtggctagaaagtttagggtattttgaaagatggtgattgaccttggactgaaccactattgaagatttatttgataataatttgtaagttttaactcagtacctcccttctgcttttatagttcaaggagcagggacaagttacaggaatgttctccaagcagcaatccaaaagagtctcaaggatccttcaaataacttcagggtgagtctggagaaaacatatggaatcccagcatgaaaccgtttcagagttctaataaaaatatgcatattctcacagcatgtactttatttaatatctgaaaaaattgtgatagaaatgtgtatttgttttaaaaacgtgtaacttcttatatttcaaagctaatacatgttcattgagatatttggagactatagagaaagataaaagaaaataaatcacctatattccactatccaaagacaaccactgttagtattttggtatatttccttctagactcttttttatgtgggtttgcatctgtatctgtatgtatgtatatatatatatatatacatacatacatacatacagttggacaattggacatttttttcactgttcatttattcacttgaaattgtaacttaaaaaaagaaaatgtaactttaaaaataaaaatagatgcaccatgcctatggaaaaaaatttaaatgtactacaagaggttttaaaagtatttttttgcccgggtgcggtggctcatgcgtgtaatcccagcactttgggaggccgagccggaaggatcacctgaggtcaggagttcgagactggcctggccaacatggtgaaactccatctctactaaaaaatacaaaaattagccaggtatggtggcaggtgcctataatcccagctacttgggaggctgaggcaggagaatcatatgaacccaggaagtggaggttgcagtagccaaatcgcgccattgtactccagcctgggtgacaagagcaaaactctgtctcaaaaaaaatgttttcttcctacccctataatactgacctccaattatttttcctaaaggcagctgttgtgaactagttcattctgtaactatccagagatagtctacacatatatttcatttttgcttttttctcttctacagatgataacaccctatgcccattgtcctgatctgaaaattcttggaaattgttccatgtgattaacatggaactgcctctacttaatcattctgaatgattaaatcgtttcattttctaaatgtgttataatgtgtttagccctttcttgttgctgtatgtttagatgctttccaatcttttgttactactaataatgctataaaataaatatccttgtacttctttgtgcatttgtttttttactgagctaattttaatgatttcagcaaaagttattttgttattgagtgatgaaacaaaagatttttgagggtgttcatgagcataagtgtatcatatagtcacttatggttgttgtgttcctagtacttagtacaaggtatcggaattgttctttagttaatcttttatcttgagaagttaaatcttggtgtaatcttatcctcatgttcatataaagatatgtggagtttgtagtgaggacttagagccgggtacaatttcatggttaaattagaaatgcttttggcagtgttaacagctcttttagaatttgtctagcaggcttttcagtttttgccagaaagccctaaaaaaaaagaaggaaaaaaatgcttttggctgagtgtggtggctcacgcctgtaatcccagcactttgggaggccgaggcaagcggatcgcttgagcccaggagttcgagacaaacctggtcaatatgtcaaaaccccatttctacaaaaaatacaaaaattagctgggcatgatggtgtgcctttagtctcagctacttgggaggctgaggtgggagaaattgcttgagcctgggaggttgaggctgcagtgaggtgtgagtgtgccactgcactccagccctggtgacagagtgagaccttgtctctaaaagaaaaaaaaatattatatatatatatataaatgctttccttaaaatatgtaatgaaaacccactcttgtaatataaatggtttcttggagaatatgtctgtaagagacactactgagcaatgcaatttcagagctaaaatggatttacggattatattatccaactcccttaatgaacaaaataaggaaacttagccctaaagaacattaactgattgtctacttctaactactagcagagctgggcccagcccatactcctttcactgcactgtgatgtatataataaactatatacttgtcataccatatcttagagcatactttttgtttttttgagacagagtttcgttcttgttgcccaggctggagtgcaatggcgcgatcttggctcaccgcaacctccgcctcccgggttcaagcgattctcccacctcagcctcccaagtagctgggattacaggaatgtgccaccacgcccgggtaattttatatttttagtagagatggggtttctccatgttggtcaggctggtcttgaactcccgacctcaggtgatctgcccgcctcagcctcgcaaagtgctgagattacagacatgagccactgcacttggcctagcatatattttttaaaagaatgaaatgtgctttgttttgtccttctgagtctctgtaataccaaataatgagaaaaagcagatttaggattcagatccaggttttctgagctttctctgctattgtctgtctaatataaattatattgtcattcttagttaaaaaacctgccatatttttactattgtgtttctattttgtaaatgaagcatattcattgctatgtagcctgttgtgagcccatatgctttgcatattagtttctccttaaactttctatatttaatatgtgaccctaaggccgggtgcagtggctcacacctgtaatctcagcacgttgggaggccgaggcaggtggatcacctgaggtcgagagtttgagaccaacatggagaaaccctgtctctactaaaaatacaaaattttccaggtgtggtggtgcatgcctgtaatcccagctacttgcgaggctgaggcaggagaatcacttgaacctgagaggcggaggttgtcgtgagccgagattgtgccattgcactccagtttgggcaacaagagtggaactccgtctcaaaaaaagaaaaaaaaaagtgaccctgattattcattcattcatttagtaagcaggcactatggcatatgaatgcagtgactttcttaaaaggtttaggagccgaatacctagaagttaattcatatgaggctgcagaagtgcttcaaaaattactgtatgattaaatgccacaggataccacaagatattatagaattaaaaaattatggctgggcatggtggctcacacctgtaatcccagcactttgggaggccgaggcaggtggatcatgaggtcaggagttcaagaccagcctggccaagatggtgaaaccctgtctctactaaaactacaaaaattaaccaggcgcagtggcaggcgcctataatcccagctactctggaggccgaggcaggagaatcacttgaacccaggcggcagaggttgcaggcgccactgcaccccaccctgggtgacagagtgagactctgtctcaaaaaaaaaaaagaatttaaaaattatttggctacaatacaatgcttttaaaatccatctttgatttgatatgttacctctctctaataatatgtaaaagcgaatacacatgcatgcggccaatttctatctgatatgatcagcctctggctaagttactaattattagtgaaaaaggcaacttacatgtttttaatttagacacacagacttagctactgacacagcttaacagatagtgtatttcactcttttggctaggttagcttcagagaagaactgtcatttgaaagctgagtgtctcagatgggttgacagcatgtggtatgtgtatcttacataggacctgtcatctgagaagagaaagggtcggtttaatctttcattctctgattactcttactctagccctcagaagtggtttatcaagaatatttgattatcaagaatcaggaccatatgttgcttatgtgtagctaggcaatgatagaaaagcaataactggacatttattatgtacttccatgtgcttggcactgtgctgagtgctttgtgtgcatttaatcttcatacaaaatctgtaaggtatctattattatcctcatttagcatatgaagaaacacacatacagaagttaaataacttgctcgaggttacatagctaataagtggcagaattaggattcctagccaggtctgtctggcctagaaatccgactcttaaccatgctgtactttgcccctgtgttgaaggaacaggtggaatgtcaatctcatgttccaacagcttatcctaacctggagctatgctagcaactatactatactgtaacatcagattttattgggctgttttgaaacattctaatatgctagcttagcatatttttcttttctttttttttaatttttgtgacagagtttcacttttcactcttgtcgcccaggctggagtgcaatggcaccatctcagctcactgcaacctctgcctctcaggttcaagcaattctcctgcctcagcctcctgagaagctgggattacaggggcacgccaccatgcccagcaaatttttgtatttttagtagagatggggttttaccatgttggccaggccggtctggaactcctggcctcagatgatccacccaccttggcatcccaaggtgttgggattacaggtgtcagccatcgctcccggcctattttcatcttttaaaagcagaatttccctgttctttggtaatatgatacgggatttatggagttaacagctcttgctattctttagataatttaactgttgggacgatatttttatttttttcctgagttaagaatcctattgagacatttaaagaggtgtaatgtatagtgtacctctgaaataactaacaggaagtatgaccttattctttgtatttgaagctccataatgggagaagtaaagaacaaagacttaaggaacagcttggcgctcaacgtaagaccacctttttttaatattcattatttataaatgcttgataattctagtacaaatattgcatttttagagttggtcatttcctttatctacataatctaagtaagctctcaaaataaaaactggttaaactcttacgatagactcattggcatttctagttgtctattgaattagcttatctaagtttgaacaccatcgtactccatcagcttcatcatcttggccgtatgttaagagatgtgatgtttataactgaaatggaatggagctctaatcaggccatgttaaacattgatccaaccatgataatgaaccatgttaaaccaaatatctagcagcaggaagaggaatggtaaataagttcttgtcttacagcctatttaataaatctggatactctacagatgatatcccccctttcctaagaaagaaaacgtgcaatttaaagatgggtcatttcaacccgcatgagctgttttctctcttaaaacattagcacttgatcccatagatcattttttaaaagattactcttttttttttttggagacggggtctcactctgtcacccaggccggagtgcagtggtacacttttggctcactacagcctccacctcctgaattcaagtaattctcatgcctcagcctcctgagtagctgggattaaaggcacgcaccaccacacccagctaatttttttcttatcttttcttttcttttttttgagacagagtcttgctctgtcacccaggctggcgtgcagtggtgcaatctcggctcactgcaacctccgcctcctgggttcaggtgattcttatgcctcagcctcctgagtagctgggattacaggcttgtgccaccacacccagtttatttttgtatttttagtagagatggggtttcattctgttgcccaggctggtctcaaacttctgacctcaggtgatccacccacctcggtctcccaaagtgctgggattacagggatgagccatggcgcccagcctaatttttgtatttttagtacagataacgtttcatcatgttggtcaggctggtctcaaactgctgacctcaagtaatccaccaccttggcctcccaaagtgccgggattacaggcgtgagccactgcacccagcaaaagtttacttcttttgcttgtcttgagtcctccttgaagtgagagctgagactcagtcttacactgatgaggcacatggctgtggttccgaactccaggaaacggattgatgggctgtgatggagggcttcagtcttatccaagaggcttggaatctgtcctgtgtgtggtgggacatcatgaatgttttgagtagggcagtggcctaatagaagccctctttgtgtggcagtccccttacagatatcttacgactcagtctttgtgctatctgcacctggaaacttattttgcccggattagtcagctggtgtagctcatgtctgtcattctctacctaatattgtgctctccagcaaaaactactgagaagcgaattaattcctgaaatgatagcatgtttcttaaaacactggtgaggtgatgagaattagtattccgaagcctgtttaaagggaaaataggagacctagtagatttgcataggaattaaaaacaattggtgttctttccatttgctccctgatggcaattttatccttggtcataattgtacagatgaggtaagtgagaatccaaatatccctatgatcctgttaggagagctgcttacttgctcttgcttggacttggtttatttgctaataaaagaaaaaggtttctgggctgggcatggtagctcatgcctgtagtcccagcactttgggaggtcgaggtgggtgcatcacctgaggtcaggagttcaagaccaacctgggcaacatggtgaaaccccgtctctactaaaaatacaaaaattacctggtcatggtggtgcatgcctgtagtcccagatactcgggaggctgaggcaggagaattgcttgaacctgggaggtggaggttgcagtgagccgagatcttgccactgcattctagcctgggcaacagagcaagaccctgccccccaccccagaaaagctttctaataacttgggcttaatttaatagaagtttaaaatactcggccaggcatggtggctaacgcctgtaatcccagcactttgggaggccgagacaggcggatcacgaggtcaggagttggagaccagcctgaccaacacggtgaaaccctgtctctactgaaaatataaaaattagccaggtgtggtggcacacacctgtaatcccagctactcaggaggctgaggcaggagaatcgcttcaacctgggaggcggaggttgcagtgagctgagatcgtgccattgcactccagcctgggtgacagagcgagactccatctaaataaataaataaataataataatcaaaccaaatatttatattaatttggacttccaaatagatttgaactgttcagccatcattgaatttgatgaggatggtgataacttcaatttagtaatttcttgctaaatgccttaaactgagatagatatatcacatagattattttgtggcttttctttgtttgtttgtttgttctgttaatatataattgctaaaatacaaaaaatataaaatgaaatttcctctttcaagtatcagagatagctgctattaatgtttgatttttatgcctccagattcttttatatttaagcatatattaatacatgtgtaagtatatgtacacaaatatacatttttaagttcacagaatcaatattatacatatttttaataatccatttttcacttaatatatcctgtgtatctttttttaatttttttctttttttttggagacagagtctcgctctgttgcccactttggagtgcagtggcacaatctctgctcaaaactggttgttcttccacctccctgacctaatcaagtcatttttttctagcaaattagctttaggctcatctccatttgccaggctcactgcccccattgtcactgtcttgccattgacattttattttatgatctcccagtatcactggactatgaaaacagtgccatctgttttataactagcaaacacatataaactttccctgctctgcactctctaaggctgttccctttaggtattgtcaacagtttcagcacatataggaaagctatcagtattgttgggtggtgaggttattagattctcctatcaagttaaaaactcaccagccacctgttcctcacctagaacggggtaggggagagccttctttcacttgctgtttaagcagcttttccagatagcccctgatagcactgggacttgtgttttcttatgtcactttcttcagtgtgaggttgaaaccttggggccaagtatagctggggaaagaagagataattgaagaaaataggaagggagaacagttgttatacaaagaaactcagccagtgtaggggtggacttagctctccttcagctttgtaaatggtttctctctctcatcccccagaagaaccagtgaagaaatccattcaggaatcagaagcttttttgcctcaggtacagaataaatgatctgatttggtattatatgtacatagctgtggataaccctgacttctttaaaaatacctgtccattaagaattctttgagacagtgggactctgagagtgttgttctcctgagaacttccatacaagggaaccctgaataacaaagagaaagatgttaaagtggattgcattagtgaactttggaatgcagggaagttccaaagtagcactcctcatctcaactcagtgactgctgaacatattagtcagcagtgatacttccctgaactttggcttgttctggctttttcttaggttgacacctctttgtaagcagaagcaatagaagggctccctttgtacttgggaacatgccacttatataacttcaggttactgtggagacaaatcactcatgttttctctctttttcaaattatctttattccacaaagccaataaagagagtgggattttcattaaaattaaataaaaatgaaaataatttgtcttaagcacattaccctaatagaggaaaaatttgatattaatgggaaacatttgccgtaatgggaaacttcaggctgtgtctgttgagtgactcacctgccaaaggaaatccaaaagaagagatggtatatgggtgggaccttatagaaacagagcaatatccagagtctttagcatttcttgtcttcctttccagagcatacctgaagagagatacaagatgaagagcaagcccctaggaatctgcctgataatcgattgcattggcaatgagacaggtaggtgtggaagctgcagattaactggtgcccccagattgagatcatggcacaggcaagctgtattcattggagtgatcagcaccaactgccgtgacaaaccagttcaagaatctgtgcttcatcctgggtgcggtggctcatgcctggaattccagcactttgtgaggctgagatgggaggatcacttgagcccagttaaaaattagctggtgtgggctcgggcacggtggcttacacctgtaatcccagcactttgggaggcggaggcgggcggatcatgaggtcaggagttcaagaccagcctggccaatatggtgaaaccccgtctctactaaaaatacaaaaattagctgggcatggtggtgggttcctgtagtcccagctacttgggaggctgaggcagaagaattgcttgaacctgggaggcagagcttgcagtgagccgagatcgcaccaccgcactgtagcctgggtgacagagcaagattctgtctcaaaaaaaaaaaaaattagctggtgtggtggtgcacacctgtagtcccagctacatggtaggctgaagcaggaggatcacttgagcccaaggaggtcaaggctgcagtgagccaagatggtggcattgcactccagtgtgggtgacagagcaagaccctgtctcaaaaaaagaaaaaaaaaatgaatatgtgttacaacacaatagagacttgtttctcattcatgtcacaggctagtgtggatcgggctgggggagctttgttcatgtggctattcagtggctccattatcttctgaggtcttggagttttctacagagtcccttgcatctggctagcagataagggaagagagaatgtgtgaaggatctcacaagagattttagggaccaggcctaaaagtgataatgtgcatcatttccaccccattagattggtcagaactcagtcatgtggctccatctaactgtagtggacatggagaaattagtctcgctgtgtgtcaggaggaaatgaaatggatttgggggacacataacagtgtctctggcacaaagacatcatttacggtagttggtgagccttagtcttgccttttcttttggatgctgaagcagggaggagtcctggaacccagaggggcattaatattaatggaaggcattctggcttcacatattatcacatgccccatcatttcacctagatagacgacaaaagctttcctgggaacattaaagacataataaatgtgtgttcacttacagagctttggatattttctgagctgtgtcagtcagttctgctgtcctttgctttggtcgttggcctcagtctcttctatctgcgcgtcaccattgcttggatctgagatgattcttttgctcagttgttgttggatgtctgactcaaactgaatcactggtgctgcatcaaaagagaatgagaagagcctagataagtggaatgacattctgtttaattatttagctcttccttaagaggatcgatcattgtatttccagttttagagcttctcaacattctcttaaaatgagtcagaactatctttcaggctcacttaaaatgttaccatggggagttttatgggaagaaaggctaagagaaggtcaaattagcaaatataatactaaattttccaggatttcagatacgatcctgcttggtcgtgtcctatttttggttagatgtgagaaagataagtgtcttcttttcagccattagtacccatataagaatgagaaaatattttcttaatgagtcacttcctgttttaagagattatgtaattgtcctgtacttctggttttggtcagttttgtttcattcatcagtagatgttgtacgtatatctgttgtatgagagaatcataaaaaaaaaaaagccatgacctgctgtgaattgaaaaactaagttttttggctaaaactcaatgtctgtgcttgcttctgttgctgggttatgggcctcttgggggcgggggctgaatgtatatttgaatttttctgcattataggagcatgatcagagttgagaaatggaatatgacagtgtgggtttgaatcatggctatgccatgttctagcttgtgaccttgggcaatgtccctggcctctttattttttttaatgtttttttttttctttcttgagagagaatctcactcttgttgcccatgctggagggccatggtgcgatcttggctcactgcaacctcttcctcctgggttcaagcaattctcctgcctcagcctcccgagtacatccctgccgggaatacaggcgcccgccaccatgcctggctaattttttgtatttttagtagagacggggtttcaccatgttggccaggctggtctcgaacttgctgacctcaagtgatccacccacctcggcctcccaaagtgctgggattacaggcatgagccaccacgctcggcttctaattttttttaatttaaattttatttttatttttcctgtagtgctgagttctcggccttcttaagtcccagtttctcttctgtaaagtgggttaataacaggacctacctcatagggaggttgggcagaatgagagttcatacttggaaagggcttagaataatgcctggcacagtgtgagcatgtactagatgccaactagcattatttcctcatttgcttgttcaattctagccataaaccacctaagcaagagctcaccatggctttgcacttggtacatagagtctgatctcagacaagtgagagaccagggcactgaggcctgccctaggcccaagggtgagtggaatgcatccccatagactgaggcgcactggaatggaggccataacttgagagggttatccaacttcttggataaacactcaagtggaaagctgagcacagcactcctaccagtcacagtctgaatgggcttggcagaggagaatctaagtacaaagtacaggagggcagagacctgataaaagagaaagatggaagaagatggtagaattggaggcagagcctggggcatcatgcttttggccacaggtatgagcaggtattggtcttgactgcactggtacatctgtttcctgccccatggttgcggatgtatctgtatacgagctccaagaatcagaatggcagctctagacagcaggtccttcctggtcagacatagtcctttaaagttcaacatcttggtggtacattgctggacaagagtaggcctgggccattagagggtaccctggatgctcggtgctgcctttcccctgagaatcagggtgatttgactcaagccttctctgcctctgggaacaaaatcagtaattgggcttgaggccacttataaacccccctgggctcaggtggctaattagcaagtaagaaacaaggcagcacacttttactcttcttgtgctatggttttcatcagctgagaggtcacaaatccacttacatgcagactcagagcagcaggagaacattaattattaagaagtggaaaggcacagtctcctctcctcacaccatctccctaggcctccagctcttcatttccctcctcctctcctggtaatttgtcactgaagattctaggcccagaatcctgccttggttgaaaatggttgttattattagtgcagcacccttcatctcttttccttctaatccgcagttagggggcttcatctagagtaattatgtggatttcctctgtctggttaactttgccatctggttaacattgaacacttgggaggagtgcaggagtcagataatgaacaagcgggtaaggtaattgccagccgaaataaggtctctgaaagaaagaaacaagaacatgataggactaacctaggcatagctgtgctcagagtatataatttattaaaaatctactacgtgccaggtactttgctaattgctttacacggattcttgcttaatcctcatgaataataccataatataggtactattctctccattaaattttttttgttctacttagaactaatttgctaggaatattctattttcttttctttcttttttttttttttttttttttgacagagtcttgctctgtcgccaggctggagtgcagtggtgcaatcttggctcactgcaacctctccctcccaagttcaagcgattcttctgcctcagcctcctgagtagctgggattacaggcatgcgccaccacgcccagctaatttttcttttttctttttatatttttaatttatttttaagacggagtttcccttttgttgcccaggttggagtgcaatggcgcaatctcagctcaccgcaatctccacctcccaggttcaagcgattctcctgcctcagcctcctgagtaactgggattacaggcatgtgccaccatgcccagctaattttgtatttttagtagagacaaggtttcaccatgtcggccaggctggtctcgatctcctgaccttgtgatctgcccacctcagcctcccaaagtgctacgattacaggcgtcagccatcatgcctggcttattctctccattttcaaggtgaggaagctgagcagtgaactacactcctaccttctctagtactgattgagctgggattcaaaagctggactccaaaacctatgcttttaactactttgcctcaatataatttccatgaaggtgagggagtttatctatctcctactatgggtctccagtacctggaagaatacctgctatgtaggtgttcaataaataattgttgggtgaatgaatgaaggaataagctctcccagtgtcagtgtgtttctaaaagccattcctttttatctttagagtttagcagactctcttctacctatcttcccttctctcctcaaaaaaccagacttttatccaaaaagcatgcaagtcccccaagtatttaaagctttatttctttgtttgtccagtaaatgttcgttgagggcctactatgtgcaaagcaccatgcttggccctgtgtgaagcaaatattaaggcaatgaggtggagtctgatctcagagctgtgttgtgcatgaaataaggttattctttggtagttctttcttgagaagaattcttatggagttcagtaacctcttcttgaggcagaagtaaatgctcagggatttgggaactaattatctcagtttggtagaattgaaaaataagtctttggtgttgtgtcatctgtgtcagtgacagcaaagctggacctgtgctaggccctggtgggtcatctttaagcactggacttttatcttgttaggaatatagaagcaagcgtctcacatctctgacagatgggctttacggcttggcctaaagctctggttgtttttaaggcccttgaataaaaataaaagacgatgtttgcagattttaagaggaagttttttttttttttgagacagagtctcgctctgtcacccaggctactggagtgcaatggcgttatcttggctcactgcaacctctgtctcccgggttcaagcgattctccgcctcagcctcctgagtagctgggattacaggcacccgccatcatgcccggctaatttttgtatttttgtagagatggggtttcaccatgttggccaggctagtcttgaactcctgacctcaggtgatccgcccgcctcggcctcccaaagtgctgggatcacggggatgagccatcgcacctggccaagaggaagtattttttttttctatcctgctctttctgaaaagcttgaacatttttctgtactttccttttcttttttgagacagggtcttgctctatcacccagaatggagcacaggggtacaatcatggctcactgcagccttcacctcccgggctcaagcaatcctctcacctcaccctcccaagtagctggaactacacacaggcgccaccacatccatctaatttttaaaatattctgtagagacagggtctcactatgttgcccaggctggtctcaaacttctgggctgaagcaatcctcccacttcagcctcctgagtggctgggactacaggcacatgctatcatgtctggctaactttgttttttatagagacagggtcttttgctgtatttcccagggcggtcttgaactcctggcttcaagtgatcttcctgccttggcctcccaaagcactgggattatggccatgagccaccacgtaatctttgttttatgcgtatttataagctttgcttccccaacaagattataagctctttgattgaagtacatcatatatttgatatgtattctcttgtccaagtgtttctgtaggcaataaggggaactttgtaaaacaagagttttccggtcaagtaaatttgagaagcgctgcctaatctcttccccctcagagatttgcaatgcatattgacctattaaaggctctgagaattcttcctgcgaagaaacctattttagccttgtccaccttgcatttcccaaacacgtttgacctcagaactccctttttcactaagaatgttttgcccatcttatgttttacccatgtgctctatagcagttaacactgggcttattaaaggtactcaatatgtgattgtaaattaactggtgaagcattccctcattcttgtttattttatacatttatttaatgaagcccttttcatagaaattgtcaagataaatgtatcctcatttagatcaaaacaaattctaaattaatgaagtcatgacattttactgtattttggtttttttggtttatctgtgaagtcctcaaacctgtgagtagtgctgaccctagccttgaatgaacagccctgtactaactgcaaggccagaagaacccctgcccttcccctccccacccccccacatcatttccagaagttctaaagaacagttgaaatttacggagatcagactgggttgagtgtgggatttccagggtgggttctagaaggagaagtgggtcttctgtagtttgttgaaattttattttccaaacccagcccccaagtttttcttcctctatttatgtgcaaggacaaaacagttactgtcctacctacataggatatggactctgtctgctctgagcccattttagtttagaatatagagacctccctccaggtcctaagagagagattccatgagagatgtgcaacaccataaggttggtgatttgtactttgaaatggctgcctttatttcctttaaagtcaatatcttatatttgaataaacacagtttgcaaagcatctttacagaaatctcattggatcctcacggtcaccttttttctgagacagagtctcactctttcacccaggctggagtgcagtggagcgatcttggctcctccacttcctgggctcgagtgatcctccttccttagcctcccaagtagctgggaccacagatgcgtgccaccatgcccagccaatttttgtatttttggtagagatggggtttcgccatgttgcccaggctggtctcaaactctgcagctcaagcaatccacccgccttggcctcccaaagtgctgggattacaggtatgagccactgtaccctgccctcacagtcaccttttgaagaacctcctgctcaagagatcctcctgcctcagcctcctgagtagctgtgatgactacaggcttgtactaccatgcctggctagtttttttattttttgtagagacggggttccctgtgatgcccagggtggtctcaaactcctgagctcaagccatcctcccacctcagcctcccaaagtgctgggattgtaggtgtgagccactgcacctggccaagcattagttttaatcttgttttatagatgaataaactggggctgactcaaactgactcaaagtcacactgtcattacctttttgatcctgtacgttagactgggctgtatgcatgttcttgctggcgcaataaagttgcaagtgccagctaacagcccttcccactccacctcaccacctcatagaggaaaattgtgacgttaatgggaaatgtcagcggtaatgtcttcaggctgggcctgtggagtgactcccttgccacaggatatttaagcaatgctgtgtcttgtctgaggctcagacctgctattcttattggcacttgggacctgcatggtttttggcttcacctccagctttagccatttttcttctgttcttttaggtaaggattttctgccccagacctcagattcccatttccttcctagcttctctgctgttatagctcagtctcttccaagaccatgcaagattcagaccctagtaggaggagatggaggaactaggacttaaacccacatcttgtgattccaaggctggttcctcttttgccctgcaccacacagctgtctgctcacagtcatgtgacaggggcttccccagccagaacctccagggagcacaaataaaggaaagagctggaaggcacagtacagcatttgttctgtccaagccttacatatcagcatgggcagggagaatgtggtgaagttttctttcaaggactttgtttgataaggaaggacatttatcagtgaagagaggttttgagggaagtgaaccaatcttgagataagtacacaaaagagctttgagtctggtgtttccctgtttgcttctgccccctggaggagcaaatactccatgattagagacgtgtgagtcctttggaatagaatagcagtgatggaactggagtcctagtccaggttctctccttgttcagcctggattcagcactgggtatcgaaacaagcctgcaccctcagaggagatggctaggggacagtgcgtccaggcctcttctaccacacagagttttcttttttttataaagggtatacacatttaaaatttaatgatactcccaaattgctcttcaaaaaggctgtgcaaaattacagtcctgataacagctacccagagatcctgtaacggcatttgccctcatcattattattattattattattattattattattatttgaatttgagacggagttctgctctgttgcccaggctggagtgcagtggcgcaatcttggctcactgcaacctctgcctcccgggttcaagcaattctcctgtctcagcctccctagtagctgggattacaggtgagcaccaccacgcctggctaatttttgtatttttagtagagacggggtttcaccatattggccagactggtctcgaactcctgacctcaggtgatctgcccgtctcggcctcccaaagtgctaggattacagatgtgagccactggggctggttgccctcactatttaatgggttatttgcaacctgtgaatcatgtctcctatttccttgttaatgatgcttattgattatagacttaggaatatcagcacctcctttgtagctcttcattcttacatgatataataattaatttttttttttgagacagagtctcactctgttgcccaggctggagtgcagtgtcacaatgttggctcactgcaacctccacctcctgggttcaagcgattctcctgcctcagcctcctgagtagctgggactacaggtgcgtgccactacacctgactaatttttgtatttttagtagagacagggtttcgccatgttggctaggctggtcttgaactcctgacctcaggtaatctgcccgcctcagcctcccaaagtgctgggattacaggtgagccactgcgcccagccaataattcattgtttaatccttagttgtgggccaagcaaaggagaaaagtaagaagccttttccttttaccgataggaaaggtcaaaggacttacctggtgaattatttacctaaaaatgtatacaaatcactccaaaatttagtggctaaaaacaacagtactaatttaattatatcttcacagttactaatttaattatatcctcacctgtgggtgaggaatttaggagcagcttagctgggctgttctggcccagagtctagtgaagttgtggtcagttgtcagctgggtcatctgaatgcttgattgggattggaggctccacttctatggtggtcactcacatgactgagaagttggtgctagctgttggcaggaagcctgttcttcatgtgggcctctctgagggactgcttgagtactttcatgatgtggtggtgggcttctcccagagtgagccactcagaagagagaaagattgtgaggtctggacttcaataagaagattgttgaagaaaaaaaggttttgtccccccttggtttgattggactagagtgggctcagtctgtgcctgtggctggcatcaggcaggaacagtggtatagcagggtatagaccatatttagggacctaaaatcacatctttcatgattcatgtggttcttgttccaactgcccaggactcaggcacatcaaaatatgacacaaaagcagaagcttttcataatggagattagaccatgtctaggattcctacccagtcctcttgagctctcctcactccagtgttgttttccgtgtttgttttttgttttccccagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaaggtgagcccccaggaggtggtcagttccggaccacctgcttattttcgtgccaccaggatgggaattaccactgtgccacatttgctgcccatctcttccgggaggaaaagagattttccctcctgcattgggcttgccctaggactacagtatagacccggcatgatttataaatactttgtagttagttagtttgtagtttgaatacttttctttaaaattaagaaattttcagcctgggcaacaaagtgagaacttgctctataaacatttttaaaattagttgggtgtggtggtgtgcgcttatagtcccaactgcttgggaggctaaggtaggaggattgcttgagcccaggagtttgaggctgcagtgagtcgtgattgcactactgcactgcagcctgagcaacagagggagaccttgtctccaataaacaaataaataaatacaaataacaaatttatttatttttatttatttttttttttgagatggagtcttgctctgttgcccaggctggagtgcattggcgcaatcttggctcactgcaacctccacctcccaggttcaagcagttgtcctgcctcaccctcccaagtagctgggattacaggcatgtgccaccacgccctggctaatttttgtatttttagtagagactgggtttcaccatgttgaccaggccagtcttgaactcctgacctcaggtgatctgcctgcctcagcctcccaaagtgctaggattacaagcgtgagccactgcgcctggccacaaatttttatttttaatttttctttttttttttttttttttttttttgagacagagtttcactcttgttgcccaggctggagtacagtggcatgatcttggctcgctgcaacctccgcctgctgggttccagtgattctcctgcctcagcttcccgagtagctgggattacaggcgtccgccatcacacctggctaatttttgtatttttagtggagacagggtttccaccatgttggccaggctggtctgcaactcctggcctcaagtgatccacgtacctcggcctgccaaagtgctgggattacaggcatgagccaccatgctcagccaccttccagatctttttttatttgatacccacacagtcatgtagaagtatatcttttttgtttgtttgttttttgagatgacatctcactctgttgtccaggctggagtgcagtggcacacctcggcttactgcaacatccacctcccgggttcaggcaattctcctgcctcagtctcctgagtagctgggactacaggcgcacaccactacggctttgctaatttttgtatttttagtagagatggggtttcaccatgttggccaggctggtcccgaactcctgacctcaagtgatcctcctgccttggcctcccaaaagtgagccactgcgcccagcctggaagtatgtttgtaagcccagatggaatcatcatctattgtttcttttttttaattaaaaaaattttaatacagttcaaatccccatgtctggctcatttcagctcctttactgccaaagcaggggacaaggactgcttcagtttctctgccttctctttctctgaaggtatctgctgcattgaacttgaaagttcacattatccttatttttcttgatcttgacagatttggcatcctttcacctggctgtgagcagaaagtccttgatttcctcaattttgcaaggcatggcgatgaggcacacagggagaggacaaggacaggcacccctctatcccatgtatcacccaaaagacactcacagcctgccatcactttataacctgcttttagtttgtttaacagtagatcacaaacatttttgcatgtcagtagtcacatttctacagcatcagtttaatgtatgcacaatagcccataatatggccatagcttaatttacttgatcaatcttcagttgttgcacagtgtttgctttcatacgaagtaagtattaaacatccttgtaacttagtatttgttcttatccttaattgttttctagggggacaattcccggaagtggaattacagagtcaaaggacatgcatttttcaagcctcggatgcatcttactagatgtcctataggatggtcatatcagctttataggagagtagctgtgtccctgaattctccctgacactgcatgctcttatatttcctcaagttttgacaatttgataggtgaaaagtggtatctgactgttcagatctggaaggctttgttatataaacatttttttaatgtttattggcaagaatacttttctaagagaaacatcagtgagctggtttccatttaagctgaatgaagccacaatgtacctcaagtataagattaactggcctttttcagttgcactctaattacaatttagaatgatgtttctgagccacctgtcaaatgcattctgggctgtacctctgcgtaccccaggaataaatctcatggccttctttacctggcctccttagtggtggcccagcaggaagcgggggttagagcaggagccactcagccttccaagatagatactccatgggccggtggtattactggccttttgagcccatccccatttgcatagatgatccacgtgggttatcatctggctggtatgttcccagagtgaaactcagcagccccttgagggaggggatggtggccatcaggccagagtattgcaagttagtttggatcatttgctaagcagcttgtggtgccttcagaaaggaacagtttcaaagaactttcacatctgttggctcatttcgccctaatgacagtcttctctttgatatttgcatggcattaaattttgcctttcttgttttctccagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacagctagtcaagtatatctttctctgatttgatagtgtgacctaaaaggggaccattgtttgaaatatcattagagttgcttattattattattattattattattattattattattattattattgagacagagtttcattctgctgcccaggctggagtgcagtggcatcatcttggctcattgcaacctctgccttctgggttcaagcgattctcctgcctcagcctcccgagtagctgggattacaggctcctgccaccacacccggctaatttttgtatttttagtggagacagggtttccaccatgttggccagcgtggtcttgaactcctgacctcaggtgattcaccagcctcggcctcccaaagtgctgggattacaggtgtgagccactgcacctggcctattattatttttaaattttttttttttaattgatcattcttgggtgtttctcacagagggtgatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcactgcccttaatccatttaaccctgagtggacacagcacatgtttcagagagcacagggttgggggtaaggtcatagatcaacagcatcctaaggcagaagaatttttcttagtacagaacaaaatgaagtctcccatgtctacttctttctacacagacacagcaacaatctgatttctctatcttttccccacctttcccccttttctattccacaaaaccgccatcgtcatcatggcctgttctcaatgagctgttgggtacacctcccagacggggtggcggctgggcagaggggctcctcacttcccagatggggcggccaggcggacgcgccccccacctccctcccggacgggatagctggccgggcgggggctgaccccccacctccctccccgacggggcggctggccgggcgggggctgacccccacgcctccctcccggacggggcggctgccaggcggaggggctcctcacttctcagacggggtggctgctgggcggagacgctcctcacttcccagacagggtggctgtcgggcggaggggctcctcacttctcagacggggcagctgcgggcggaggggctcctcacttctcagacggggtggccgggcagagaagctcctcacatcccagacgggggggcggggcagaggcgctccccacatctcagacgatgggcggccgggcagagacgctcctcacttcatcccagacggggtggcggccgggcagaagctgtaatctcggcaccctggggggccaaggcaggcggctgggaggcggaggccgtagccagctgagatcacaccactgcactccagcctgggcaacattgagcactgagtggacgagactctgcccgcaatcccggcacctcgggaggccgaggctggcagatcactcgcagtcaggagctggagaccagcccggccaacacagtgaaaccctgtctccaccaaaaaaatacgaaaaccagtcaggcgtggcggcgcccgcaatggcaggcacgcggcaggccgaggcgggagaatcaggcagggaggctgcagtgagccgagatggcagcagtacagtccagcttcggctcggcatcagagggagaccgtggggagagggagaagagagggagggggagagggctatttttaaaattttttaaaattgctgaacaggggtacctctgggcagtgtgtcagaataccactttttaaatattttatgatttatttatttttctatttcttgaggttttaactgatgtgtatctgtatgtctatttgtgtatattttgtcatgatcatgtaacagagtctgaaaagtgtcgaagagacagttttcaggaacaacaagcaattattcctactttccaagttattttgatgccatggtggctcatacctataatctgagtactttgggaggctgaggtggactgatcacttgagcccaggagtttgagaccagcctgggcaacatagcaagactccatctctacaaaaaaagacaaaatttagctgagcgtggtggcgtgttcctgtagtcccagctacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagagatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcggtggctcacgcctataatcccagccctttgggaggccaaggcgggcggatcacgaggtcaggagatcaagaccatcctggctaacatgtaaaaccccgtctctactaaaaatacaaaaaattagccaggcgttgtggcggtcgcctgtagtccctgctatttgggaggccgaggcaagagaacggcatgaacctgggaggtggagcttgcagcgagctgagatcttgccactgcactccagcctgggcgacagtgcgagactctgtctcaaaaataaataaataaataaataataaataaaatgtttggaatgttggcttcatccctgggatgcaaggctggttcaacatacgcaaatcaagaaacataattcatcacataaacagaactaaagacaaaaaccacatgattatctcaatagatacagaaaaggccttcaataaaattcaacgttgcttcatgttaaaaactctcaataaactaggtattgatggaaaatatctcaaaataataaccatttatgacaaacccacagccattatcatactgaatgggcaaaagctggaagcattccccttgaaaactggcacaagacagggatgccgtctcaccactcctatttaacatagtattggaagttctggccaagaaaatcaggcaagagaaacaaataaggggtattcaaataggaaaagaggaagtaaaactgtgtttgcagatgacatgatactatatctagaaaaccccattatctccacccaaaagttccttaagctgataagcaacttcagcaaagtctcaggatacaaaatcaatgtgcagaaatcacaagcattctatacaccaacaatacacaagcagagagccaaatcatgaatgaactcccattcacagttgctagaaagagaataaaatacctaggaatacagctaataagatgtgaaggatctcttcaaggagaactacaaaccactgctcaaggaaataagagaggacacaaatgaaaaaacattccattctcgtggataggaagaatcaatatcatgaaaatggccatactacccaaagtaatttataggttcattgctattcccattaaactactattgacattcttcacagaattagaaaaaaactactttaaaattcaaatggaaccaaaaaagagcccgtataaccaagacaacaataagcaaaaagaacaaagctggaagcatcacactacccaacttcaaagtatactgcaaggctacagtagccaaaatggcatggtactggtacaaaaacagacacatagaccaatggaacagaatagagaccagagaaagaagaccacacatctacagccatctgatcatcgacaaacctgacaaaaacaagcaatggggaaaagattccctatttaataaatggtgctgggaaaactggctagccatatgcagaaaattgaaactgaccccttccttacaccttatacaaaaattaactcaagattaaagacttaatgtaaaacctaaaactataaaaaccctagaagaaaatctatttaataccattcaagacataggcacaagcaaaggtttcatgacaaaaacatcaaaagcaattgcaacaaaagcaaaaattacaaatgggatctaattaaactaaagagctcctgcacagcaaaagaaactatcattagagtgaacaggcaacctacagaatgggagaacatttttgcaatctatccatctgacaaaggtctaatatccagaacctacaaggaacttaaaacaaatttacaaggaaaaaaacaaccccatcaaaaagtggacaaaggacatgaacagacacttctcaaaagaagacatttatgtggccaacaaacatataaaaaaaagctcaaccttactgatcattagagaaatgcaaaggagaaccacaatgagataccatctcatgccggtcagaatggtgattattaaaaagtcaaaaaacaacagatgctggcgaggctgtggagaagtaggaacacttttacattgttggtgggaatgtaaattagttcaaccgttgtggaagtgtgtgtggctattcctcaaagatctagaactagaaatactatttgtcccagcaatcccattactgggtatatacccaaaggaatataaaccattttattataaagatacatgcacatttttgttcattgcagcactcttcacaatagcaaagacacaatagcaaatgcccatcaaagatagactggataaagaaaatgtggtacatatacaccatggaatactgtgcagtgcagccattacagcttttggtgatacagtgaatcagatttttcattaattcttttaattggttattactgaacgtgaaaaagtaatgtttgtattgaaatcttgagtctggccatgtttctattttaaattcataaagaattctaacaagaggaattccaagaatgtcataaatggatgtttctccatggatgaaggaactgttttattcacttgctgataattcagcctaatccagtttgacatcatatagataagtagttgaattatggatttaaaatacatatcattttctaactccaaaggtaatacttatttaaatggttttgaaaatatagaaaggcacaatttctttttaaatctgttattctccaccaccactcaatctgtctatcatctatctctccattcattcttccatttgtttatatctgttaatctttgtatgtgttcatgtatagcttttacatgattggaatcataatgcatattccattttgaagtctgcttttttttacacaaaaatatgttgtgaatattttcctatattatgaaatatcattagctgagcttttagaattgactgcatgttttggtaccatttagatatagtttaagatacttagaagttatgtggctttgccactatggatgaatcttatttactcaatattaattacttacaaataacctcacctaaacactactcagccataaaaaggaatgaattaatgacattcacagcaacctggagactattactctaaaggaagtaactgaggaatggaaaaccaaacattgtatgttctcactcataagtgggagataagctatgaggatgcaaaggcataagaaggatacaatggactttggggacttaggggaaagggtgggaggggggtgaaggataaaagaatacaaattgggttcagtgtatactgctcaggtgatgggtgcaccagaatctcacaagtaaccacttaattacttacgcatgtaaccagataccacctgttccccaaacacctatggaaataattttgtttttttttttaaaaaaggaatgagatcatgtcctttgcagggacatggatgaagctggaagccattatcctcagcaaactaacagaggagcaggaaaccaaacaccacatgttctcacttgtaagcggaagctgaacaatgagaacacacggacacagggatgagatcaacacacactggggcctgatgcaggggccgtagcggggagagcatcaggataactagctaatgcatgtggggcttaatacctaggtgataggttgataggtgcagcaaaccaccatgggacacgtttacctatgtaacaaacccgcacatcctgcacttgtatccagaacttaaaatattttaaaaatctttagagaatacaaaaaaaaaaaaaaagattcttcaatgcatacacaataaaattgcagttcagtcaaacattggaagtctttctctgactgtctagttggtatcttcattttcagcttcttcaagatcccactccaaacactgttagctcagccaaattgaacagctcatatctcctacctctggatctttggttctggtgattgtatatttctggaccatctggaaccccagcatatcaccctaccccacatctccacatccccaaaatataaccatacttcaagggcagttcaaataccatctccttctatcctccatgaagtcagttatctcttccattggaattatcgccccctctcctgaacagtactatttcgtgtgaatctcctccaagccttcttttcattttatatctcatgctgtaattcttggaaagtatgctgtagctcaagtgcagaattctcatcagttttatctttatatctctcctaaacactttacctgatgaagagcctggcatacacataaatatatattgaatgaatcagtgatggattgaaaagagaaatgatggatctcctaaattttaacttttataaaatattttgatacattcatgaccttactttagcaagcaatgaacgtgatgtaaactattgttgatatagtttttatattggaagtgtaagtagtttgtggcatgggattgtgacatatcctaggtttcctcatcttctttttattgaaatgtaattcacaagccataaaatttgcccctttaaagtaaatgatgcagtggattttagtatatttacagagttgtgcaatcatcaccactatctaattccagaacatttccatctacctagaaactccataccagtgagctgccactctaatcctcctcttcccccagcctctagaaacaataatccattttctgtctctatgatttgcctgttctagatattttataaaaataaacatgtggcctttcgtgtctgacttccttcactta

SEQ ID NO: 1218 - DNA, 56536 bp, Homo sapiens; identical to SEQ ID NO: 1216

SEQ ID NO: 1219 - DNA, 56536 bp, Homo sapiens; identical to SEQ ID NO: 1216

SEQ ID NO: 1220 - DNA, 56536 bp, Homo sapiens; identical to SEQ ID NO: 1216

SEQ ID NO: 1221 - DNA, 17505 bp, Homo sapiens
ccactattgaagatttatttgataataatttgtaagttttaactcagtacctcccttctgcttttatagttcaaggagcagggacaagttacaggaatgttctccaagcagcaatccaaaagagtctcaaggatccttcaaataacttcagggtgagtctggagaaaacatatggaatcccagcatgaaaccgtttcagagttctaataaaaatatgcatattctcacagcatgtactttatttaatatctgaaaaaattgtgatagaaatgtgtatttgttttaaaaacgtgtaacttcttatatttcaaagctaatacatgttcattgagatatttggagactatagagaaagataaaagaaaataaatcacctatattccactatccaaagacaaccactgttagtattttggtatatttccttctagactcttttttatgtgggtttgcatctgtatctgtatgtatgtatatatatatatatatacatacatacatacatacagttggacaattggacatttttttcactgttcatttattcacttgaaattgtaacttaaaaaaagaaaatgtaactttaaaaataaaaatagatgcaccatgcctatggaaaaaaatttaaatgtactacaagaggttttaaaagtatttttttgcccgggtgcggtggctcatgcgtgtaatcccagcactttgggaggccgagccggaaggatcacctgaggtcaggagttcgagactggcctggccaacatggtgaaactccatctctactaaaaaatacaaaaattagccaggtatggtggcaggtgcctataatcccagctacttgggaggctgaggcaggagaatcatatgaacccaggaagtggaggttgcagtagccaaatcgcgccattgtactccagcctgggtgacaagagcaaaactctgtctcaaaaaaaatgttttcttcctacccctataatactgacctccaattatttttcctaaaggcagctgttgtgaactagttcattctgtaactatccagagatagtctacacatatatttcatttttgcttttttctcttctacagatgataacaccctatgcccattgtcctgatctgaaaattcttggaaattgttccatgtgattaacatggaactgcctctacttaatcattctgaatgattaaatcgtttcattttctaaatgtgttataatgtgtttagccctttcttgttgctgtatgtttagatgctttccaatcttttgttactactaataatgctataaaataaatatccttgtacttctttgtgcatttgtttttttactgagctaattttaatgatttcagcaaaagttattttgttattgagtgatgaaacaaaagatttttgagggtgttcatgagcataagtgtatcatatagtcacttatggttgttgtgttcctagtacttagtacaaggtatcggaattgttctttagttaatcttttatcttgagaagttaaatcttggtgtaatcttatcctcatgttcatataaagatatgtggagtttgtagtgaggacttagagccgggtacaatttcatggttaaattagaaatgcttttggcagtgttaacagctcttttagaatttgtctagcaggcttttcagtttttgccagaaagccctaaaaaaaaagaaggaaaaaaatgcttttggctgagtgtggtggctcacgcctgtaatcccagcactttgggaggccgaggcaagcggatcgcttgagcccaggagttcgagacaaacctggtcaatatgtcaaaaccccatttctacaaaaaatacaaaaattagctgggcatgatggtgtgcctttagtctcagctacttgggaggctgaggtgggagaaattgcttgagcctgggaggttgaggctgcagtgaggtgtgagtgtgccactgcactccagccctggtgacagagtgagaccttgtctctaaaagaaaaaaaaatattatatatatatatataaatgctttccttaaaatatgtaatgaaaacccactcttgtaatataaatggtttcttggagaatatgtctgtaagagacactactgagcaatgcaatttcagagctaaaatggatttacggattatattatccaactcccttaatgaacaaaataaggaaacttagccctaaagaacattaactgattgtctacttctaactactagcagagctgggcccagcccatactcctttcactgcactgtgatgtatataataaactatatacttgtcataccatatcttagagcatactttttgtttttttgagacagagtttcgttcttgttgcccaggctggagtgcaatggcgcgatcttggctcaccgcaacctccgcctcccgggttcaagcgattctcccacctcagcctcccaagtagctgggattacaggaatgtgccaccacgcccgggtaattttatatttttagtagagatggggtttctccatgttggtcaggctggtcttgaactcccgacctcaggtgatctgcccgcctcagcctcgcaaagtgctgagattacagacatgagccactgcacttggcctagcatatattttttaaaagaatgaaatgtgctttgttttgtccttctgagtctctgtaataccaaataatgagaaaaagcagatttaggattcagatccaggttttctgagctttctctgctattgtctgtctaatataaattatattgtcattcttagttaaaaaacctgccatatttttactattgtgtttctattttgtaaatgaagcatattcattgctatgtagcctgttgtgagcccatatgctttgcatattagtttctccttaaactttctatatttaatatgtgaccctaaggccgggtgcagtggctcacacctgtaatctcagcacgttgggaggccgaggcaggtggatcacctgaggtcgagagtttgagaccaacatggagaaaccctgtctctactaaaaatacaaaattttccaggtgtggtggtgcatgcctgtaatcccagctacttgcgaggctgaggcaggagaatcacttgaacctgagaggcggaggttgtcgtgagccgagattgtgccattgcactccagtttgggcaacaagagtggaactccgtctcaaaaaaagaaaaaaaaaagtgaccctgattattcattcattcatttagtaagcaggcactatggcatatgaatgcagtgactttcttaaaaggtttaggagccgaatacctagaagttaattcatatgaggctgcagaagtgcttcaaaaattactgtatgattaaatgccacaggataccacaagatattatagaattaaaaaattatggctgggcatggtggctcacacctgtaatcccagcactttgggaggccgaggcaggtggatcatgaggtcaggagttcaagaccagcctggccaagatggtgaaaccctgtctctactaaaactacaaaaattaaccaggcgcagtggcaggcgcctataatcccagctactctggaggccgaggcaggagaatcacttgaacccaggcggcagaggttgcaggcgccactgcaccccaccctgggtgacagagtgagactctgtctcaaaaaaaaaaaagaatttaaaaattatttggctacaatacaatgcttttaaaatccatctttgatttgatatgttacctctctctaataatatgtaaaagcgaatacacatgcatgcggccaatttctatctgatatgatcagcctctggctaagttactaattattagtgaaaaaggcaacttacatgtttttaatttagacacacagacttagctactgacacagcttaacagatagtgtatttcactcttttggctaggttagcttcagagaagaactgtcatttgaaagctgagtgtctcagatgggttgacagcatgtggtatgtgtatcttacataggacctgtcatctgagaagagaaagggtcggtttaatctttcattctctgattactcttactctagccctcagaagtggtttatcaagaatatttgattatcaagaatcaggaccatatgttgcttatgtgtagctaggcaatgatagaaaagcaataactggacatttattatgtacttccatgtgcttggcactgtgctgagtgctttgtgtgcatttaatcttcatacaaaatctgtaaggtatctattattatcctcatttagcatatgaagaaacacacatacagaagttaaataacttgctcgaggttacatagctaataagtggcagaattaggattcctagccaggtctgtctggcctagaaatccgactcttaaccatgctgtactttgcccctgtgttgaaggaacaggtggaatgtcaatctcatgttccaacagcttatcctaacctggagctatgctagcaactatactatactgtaacatcagattttattgggctgttttgaaacattctaatatgctagcttagcatatttttcttttctttttttttaatttttgtgacagagtttcacttttcactcttgtcgcccaggctggagtgcaatggcaccatctcagctcactgcaacctctgcctctcaggttcaagcaattctcctgcctcagcctcctgagaagctgggattacaggggcacgccaccatgcccagcaaatttttgtatttttagtagagatggggttttaccatgttggccaggccggtctggaactcctggcctcagatgatccacccaccttggcatcccaaggtgttgggattacaggtgtcagccatcgctcccggcctattttcatcttttaaaagcagaatttccctgttctttggtaatatgatacgggatttatggagttaacagctcttgctattctttagataatttaactgttgggacgatatttttatttttttcctgagttaagaatcctattgagacatttaaagaggtgtaatgtatagtgtacctctgaaataactaacaggaagtatgaccttattctttgtatttgaagctccataatgggagaagtaaagaacaaagacttaaggaacagcttggcgctcaacgtaagaccacctttttttaatattcattatttataaatgcttgataattctagtacaaatattgcatttttagagttggtcatttcctttatctacataatctaagtaagctctcaaaataaaaactggttaaactcttacgatagactcattggcatttctagttgtctattgaattagcttatctaagtttgaacaccatcgtactccatcagcttcatcatcttggccgtatgttaagagatgtgatgtttataactgaaatggaatggagctctaatcaggccatgttaaacattgatccaaccatgataatgaaccatgttaaaccaaatatctagcagcaggaagaggaatggtaaataagttcttgtcttacagcctatttaataaatctggatactctacagatgatatcccccctttcctaagaaagaaaacgtgcaatttaaagatgggtcatttcaacccgcatgagctgttttctctcttaaaacattagcacttgatcccatagatcattttttaaaagattactcttttttttttttggagacggggtctcactctgtcacccaggccggagtgcagtggtacacttttggctcactacagcctccacctcctgaattcaagtaattctcatgcctcagcctcctgagtagctgggattaaaggcacgcaccaccacacccagctaatttttttcttatcttttcttttcttttttttgagacagagtcttgctctgtcacccaggctggcgtgcagtggtgcaatctcggctcactgcaacctccgcctcctgggttcaggtgattcttatgcctcagcctcctgagtagctgggattacaggcttgtgccaccacacccagtttatttttgtatttttagtagagatggggtttcattctgttgcccaggctggtctcaaacttctgacctcaggtgatccacccacctcggtctcccaaagtgctgggattacagggatgagccatggcgcccagcctaatttttgtatttttagtacagataacgtttcatcatgttggtcaggctggtctcaaactgctgacctcaagtaatccaccaccttggcctcccaaagtgccgggattacaggcgtgagccactgcacccagcaaaagtttacttcttttgcttgtcttgagtcctccttgaagtgagagctgagactcagtcttacactgatgaggcacatggctgtggttccgaactccaggaaacggattgatgggctgtgatggagggcttcagtcttatccaagaggcttggaatctgtcctgtgtgtggtgggacatcatgaatgttttgagtagggcagtggcctaatagaagccctctttgtgtggcagtccccttacagatatcttacgactcagtctttgtgctatctgcacctggaaacttattttgcccggattagtcagctggtgtagctcatgtctgtcattctctacctaatattgtgctctccagcaaaaactactgagaagcgaattaattcctgaaatgatagcatgtttcttaaaacactggtgaggtgatgagaattagtattccgaagcctgtttaaagggaaaataggagacctagtagatttgcataggaattaaaaacaattggtgttctttccatttgctccctgatggcaattttatccttggtcataattgtacagatgaggtaagtgagaatccaaatatccctatgatcctgttaggagagctgcttacttgctcttgcttggacttggtttatttgctaataaaagaaaaaggtttctgggctgggcatggtagctcatgcctgtagtcccagcactttgggaggtcgaggtgggtgcatcacctgaggtcaggagttcaagaccaacctgggcaacatggtgaaaccccgtctctactaaaaatacaaaaattacctggtcatggtggtgcatgcctgtagtcccagatactcgggaggctgaggcaggagaattgcttgaacctgggaggtggaggttgcagtgagccgagatcttgccactgcattctagcctgggcaacagagcaagaccctgccccccaccccagaaaagctttctaataacttgggcttaatttaatagaagtttaaaatactcggccaggcatggtggctaacgcctgtaatcccagcactttgggaggccgagacaggcggatcacgaggtcaggagttggagaccagcctgaccaacacggtgaaaccctgtctctactgaaaatataaaaattagccaggtgtggtggcacacacctgtaatcccagctactcaggaggctgaggcaggagaatcgcttcaacctgggaggcggaggttgcagtgagctgagatcgtgccattgcactccagcctgggtgacagagcgagactccatctaaataaataaataaataataataatcaaaccaaatatttatattaatttggacttccaaatagatttgaactgttcagccatcattgaatttgatgaggatggtgataacttcaatttagtaatttcttgctaaatgccttaaactgagatagatatatcacatagattattttgtggcttttctttgtttgtttgtttgttctgttaatatataattgctaaaatacaaaaaatataaaatgaaatttcctctttcaagtatcagagatagctgctattaatgtttgatttttatgcctccagattcttttatatttaagcatatattaatacatgtgtaagtatatgtacacaaatatacatttttaagttcacagaatcaatattatacatatttttaataatccatttttcacttaatatatcctgtgtatctttttttaatttttttctttttttttggagacagagtctcgctctgttgcccactttggagtgcagtggcacaatctctgctcaaaactggttgttcttccacctccctgacctaatcaagtcatttttttctagcaaattagctttaggctcatctccatttgccaggctcactgcccccattgtcactgtcttgccattgacattttattttatgatctcccagtatcactggactatgaaaacagtgccatctgttttataactagcaaacacatataaactttccctgctctgcactctctaaggctgttccctttaggtattgtcaacagtttcagcacatataggaaagctatcagtattgttgggtggtgaggttattagattctcctatcaagttaaaaactcaccagccacctgttcctcacctagaacggggtaggggagagccttctttcacttgctgtttaagcagcttttccagatagcccctgatagcactgggacttgtgttttcttatgtcactttcttcagtgtgaggttgaaaccttggggccaagtatagctggggaaagaagagataattgaagaaaataggaagggagaacagttgttatacaaagaaactcagccagtgtaggggtggacttagctctccttcagctttgtaaatggtttctctctctcatcccccagaagaaccagtgaagaaatccattcaggaatcagaagcttttttgcctcaggtacagaataaatgatctgatttggtattatatgtacatagctgtggataaccctgacttctttaaaaatacctgtccattaagaattctttgagacagtgggactctgagagtgttgttctcctgagaacttccatacaagggaaccctgaataacaaagagaaagatgttaaagtggattgcattagtgaactttggaatgcagggaagttccaaagtagcactcctcatctcaactcagtgactgctgaacatattagtcagcagtgatacttccctgaactttggcttgttctggctttttcttaggttgacacctctttgtaagcagaagcaatagaagggctccctttgtacttgggaacatgccacttatataacttcaggttactgtggagacaaatcactcatgttttctctctttttcaaattatctttattccacaaagccaataaagagagtgggattttcattaaaattaaataaaaatgaaaataatttgtcttaagcacattaccctaatagaggaaaaatttgatattaatgggaaacatttgccgtaatgggaaacttcaggctgtgtctgttgagtgactcacctgccaaaggaaatccaaaagaagagatggtatatgggtgggaccttatagaaacagagcaatatccagagtctttagcatttcttgtcttcctttccagagcatacctgaagagagatacaagatgaagagcaagcccctaggaatctgcctgataatcgattgcattggcaatgagacaggtaggtgtggaagctgcagattaactggtgcccccagattgagatcatggcacaggcaagctgtattcattggagtgatcagcaccaactgccgtgacaaaccagttcaagaatctgtgcttcatcctgggtgcggtggctcatgcctggaattccagcactttgtgaggctgagatgggaggatcacttgagcccagttaaaaattagctggtgtgggctcgggcacggtggcttacacctgtaatcccagcactttgggaggcggaggcgggcggatcatgaggtcaggagttcaagaccagcctggccaatatggtgaaaccccgtctctactaaaaatacaaaaattagctgggcatggtggtgggttcctgtagtcccagctacttgggaggctgaggcagaagaattgcttgaacctgggaggcagagcttgcagtgagccgagatcgcaccaccgcactgtagcctgggtgacagagcaagattctgtctcaaaaaaaaaaaaaattagctggtgtggtggtgcacacctgtagtcccagctacatggtaggctgaagcaggaggatcacttgagcccaaggaggtcaaggctgcagtgagccaagatggtggcattgcactccagtgtgggtgacagagcaagaccctgtctcaaaaaaagaaaaaaaaaatgaatatgtgttacaacacaatagagacttgtttctcattcatgtcacaggctagtgtggatcgggctgggggagctttgttcatgtggctattcagtggctccattatcttctgaggtcttggagttttctacagagtcccttgcatctggctagcagataagggaagagagaatgtgtgaaggatctcacaagagattttagggaccaggcctaaaagtgataatgtgcatcatttccaccccattagattggtcagaactcagtcatgtggctccatctaactgtagtggacatggagaaattagtctcgctgtgtgtcaggaggaaatgaaatggatttgggggacacataacagtgtctctggcacaaagacatcatttacggtagttggtgagccttagtcttgccttttcttttggatgctgaagcagggaggagtcctggaacccagaggggcattaatattaatggaaggcattctggcttcacatattatcacatgccccatcatttcacctagatagacgacaaaagctttcctgggaacattaaagacataataaatgtgtgttcacttacagagctttggatattttctgagctgtgtcagtcagttctgctgtcctttgctttggtcgttggcctcagtctcttctatctgcgcgtcaccattgcttggatctgagatgattcttttgctcagttgttgttggatgtctgactcaaactgaatcactggtgctgcatcaaaagagaatgagaagagcctagataagtggaatgacattctgtttaattatttagctcttccttaagaggatcgatcattgtatttccagttttagagcttctcaacattctcttaaaatgagtcagaactatctttcaggctcacttaaaatgttaccatggggagttttatgggaagaaaggctaagagaaggtcaaattagcaaatataatactaaattttccaggatttcagatacgatcctgcttggtcgtgtcctatttttggttagatgtgagaaagataagtgtcttcttttcagccattagtacccatataagaatgagaaaatattttcttaatgagtcacttcctgttttaagagattatgtaattgtcctgtacttctggttttggtcagttttgtttcattcatcagtagatgttgtacgtatatctgttgtatgagagaatcataaaaaaaaaaaagccatgacctgctgtgaattgaaaaactaagttttttggctaaaactcaatgtctgtgcttgcttctgttgctgggttatgggcctcttgggggcgggggctgaatgtatatttgaatttttctgcattataggagcatgatcagagttgagaaatggaatatgacagtgtgggtttgaatcatggctatgccatgttctagcttgtgaccttgggcaatgtccctggcctctttattttttttaatgtttttttttttctttcttgagagagaatctcactcttgttgcccatgctggagggccatggtgcgatcttggctcactgcaacctcttcctcctgggttcaagcaattctcctgcctcagcctcccgagtacatccctgccgggaatacaggcgcccgccaccatgcctggctaattttttgtatttttagtagagacggggtttcaccatgttggccaggctggtctcgaacttgctgacctcaagtgatccacccacctcggcctcccaaagtgctgggattacaggcatgagccaccacgctcggcttctaattttttttaatttaaattttatttttatttttcctgtagtgctgagttctcggccttcttaagtcccagtttctcttctgtaaagtgggttaataacaggacctacctcatagggaggttgggcagaatgagagttcatacttggaaagggcttagaataatgcctggcacagtgtgagcatgtactagatgccaactagcattatttcctcatttgcttgttcaattctagccataaaccacctaagcaagagctcaccatggctttgcacttggtacatagagtctgatctcagacaagtgagagaccagggcactgaggcctgccctaggcccaagggtgagtggaatgcatccccatagactgaggcgcactggaatggaggccataacttgagagggttatccaacttcttggataaacactcaagtggaaagctgagcacagcactcctaccagtcacagtctgaatgggcttggcagaggagaatctaagtacaaagtacaggagggcagagacctgataaaagagaaagatggaagaagatggtagaattggaggcagagcctggggcatcatgcttttggccacaggtatgagcaggtattggtcttgactgcactggtacatctgtttcctgccccatggttgcggatgtatctgtatacgagctccaagaatcagaatggcagctctagacagcaggtccttcctggtcagacatagtcctttaaagttcaacatcttggtggtacattgctggacaagagtaggcctgggccattagagggtaccctggatgctcggtgctgcctttcccctgagaatcagggtgatttgactcaagccttctctgcctctgggaacaaaatcagtaattgggcttgaggccacttataaacccccctgggctcaggtggctaattagcaagtaagaaacaaggcagcacacttttactcttcttgtgctatggttttcatcagctgagaggtcacaaatccacttacatgcagactcagagcagcaggagaacattaattattaagaagtggaaaggcacagtctcctctcctcacaccatctccctaggcctccagctcttcatttccctcctcctctcctggtaatttgtcactgaagattctaggcccagaatcctgccttggttgaaaatggttgttattattagtgcagcacccttcatctcttttccttctaatccgcagttagggggcttcatctagagtaattatgtggatttcctctgtctggttaactttgccatctggttaacattgaacacttgggaggagtgcaggagtcagataatgaacaagcgggtaaggtaattgccagccgaaataaggtctctgaaagaaagaaacaagaacatgataggactaacctaggcatagctgtgctcagagtatataatttattaaaaatctactacgtgccaggtactttgctaattgctttacacggattcttgcttaatcctcatgaataataccataatataggtactattctctccattaaattttttttgttctacttagaactaatttgctaggaatattctattttcttttctttcttttttttttttttttttttttgacagagtcttgctctgtcgccaggctggagtgcagtggtgcaatcttggctcactgcaacctctccctcccaagttcaagcgattcttctgcctcagcctcctgagtagctgggattacaggcatgcgccaccacgcccagctaatttttcttttttctttttatatttttaatttatttttaagacggagtttcccttttgttgcccaggttggagtgcaatggcgcaatctcagctcaccgcaatctccacctcccaggttcaagcgattctcctgcctcagcctcctgagtaactgggattacaggcatgtgccaccatgcccagctaattttgtatttttagtagagacaaggtttcaccatgtcggccaggctggtctcgatctcctgaccttgtgatctgcccacctcagcctcccaaagtgctacgattacaggcgtcagccatcatgcctggcttattctctccattttcaaggtgaggaagctgagcagtgaactacactcctaccttctctagtactgattgagctgggattcaaaagctggactccaaaacctatgcttttaactactttgcctcaatataatttccatgaaggtgagggagtttatctatctcctactatgggtctccagtacctggaagaatacctgctatgtaggtgttcaataaataattgttgggtgaatgaatgaaggaataagctctcccagtgtcagtgtgtttctaaaagccattcctttttatctttagagtttagcagactctcttctacctatcttcccttctctcctcaaaaaaccagacttttatccaaaaagcatgcaagtcccccaagtatttaaagctttatttctttgtttgtccagtaaatgttcgttgagggcctactatgtgcaaagcaccatgcttggccctgtgtgaagcaaatattaaggcaatgaggtggagtctgatctcagagctgtgttgtgcatgaaataaggttattctttggtagttctttcttgagaagaattcttatggagttcagtaacctcttcttgaggcagaagtaaatgctcagggatttgggaactaattatctcagtttggtagaattgaaaaataagtctttggtgttgtgtcatctgtgtcagtgacagcaaagctggacctgtgctaggccctggtgggtcatctttaagcactggacttttatcttgttaggaatatagaagcaagcgtctcacatctctgacagatgggctttacggcttggcctaaagctctggttgtttttaaggcccttgaataaaaataaaagacgatgtttgcagattttaagaggaagttttttttttttttgagacagagtctcgctctgtcacccaggctactggagtgcaatggcgttatcttggctcactgcaacctctgtctcccgggttcaagcgattctccgcctcagcctcctgagtagctgggattacaggcacccgccatcatgcccggctaatttttgtatttttgtagagatggggtttcaccatgttggccaggctagtcttgaactcctgacctcaggtgatccgcccgcctcggcctcccaaagtgctgggatcacggggatgagccatcgcacctggccaagaggaagtattttttttttctatcctgctctttctgaaaagcttgaacatttttctgtactttccttttcttttttgagacagggtcttgctctatcacccagaatggagcacaggggtacaatcatggctcactgcagccttcacctcccgggctcaagcaatcctctcacctcaccctcccaagtagctggaactacacacaggcgccaccacatccatctaatttttaaaatattctgtagagacagggtctcactatgttgcccaggctggtctcaaacttctgggctgaagcaatcctcccacttcagcctcctgagtggctgggactacaggcacatgctatcatgtctggctaactttgttttttatagagacagggtcttttgctgtatttcccagggcggtcttgaactcctggcttcaagtgatcttcctgccttggcctcccaaagcactgggattatggccatgagccaccacgtaatctttgttttatgcgtatttataagctttgcttccccaacaagattataagctctttgattgaagtacatcatatatttgatatgtattctcttgtccaagtgtttctgtaggcaataaggggaactttgtaaaacaagagttttccggtcaagtaaatttgagaagcgctgcctaatctcttccccctcagagatttgcaatgcatattgacctattaaaggctctgagaattcttcctgcgaagaaacctattttagccttgtccaccttgcatttcccaaacacgtttgacctcagaactccctttttcactaagaatgttttgcccatcttatgttttacccatgtgctctatagcagttaacactgggcttattaaaggtactcaatatgtgattgtaaattaactggtgaagcattccctcattcttgtttattttatacatttatttaatgaagcccttttcatagaaattgtcaagataaatgtatcctcatttagatcaaaacaaattctaaattaatgaagtcatgacattttactgtattttggtttttttggtttatctgtgaagtcctcaaacctgtgagtagtgctgaccctagccttgaatgaacagccctgtactaactgcaaggccagaagaacccctgcccttcccctccccacccccccacatcatttccagaagttctaaagaacagttgaaatttacggagatcagactgggttgagtgtgggatttccagggtgggttctagaaggagaagtgggtcttctgtagtttgttgaaattttattttccaaacccagcccccaagtttttcttcctctatttatgtgcaaggacaaaacagttactgtcctacctacataggatatggactctgtctgctctgagcccattttagtttagaatatagagacctccctccaggtcctaagagagagattccatgagagatgtgcaacaccataaggttggtgatttgtactttgaaatggctgcctttatttcctttaaagtcaatatcttatatttgaataaacacagtttgcaaagcatctttacagaaatctcattggatcctcacggtcaccttttttctgagacagagtctcactctttcacccaggctggagtgcagtggagcgatcttggctcctccacttcctgggctcgagtgatcctccttccttagcctcccaagtagctgggaccacagatgcgtgccaccatgcccagccaatttttgtatttttggtagagatggggtttcgccatgttgcccaggctggtctcaaactctgcagctcaagcaatccacccgccttggcctcccaaagtgctgggattacaggtatgagccactgtaccctgccctcacagtcaccttttgaagaacctcctgctcaagagatcctcctgcctcagcctcctgagtagctgtgatgactacaggcttgtactaccatgcctggctagtttttttattttttgtagagacggggttccctgtgatgcccagggtggtctcaaactcctgagctcaagccatcctcccacctcagcctcccaaagtgctgggattgtaggtgtgagccactgcacctggccaagcattagttttaatcttgttttatagatgaataaactggggctgactcaaactgactcaaagtcacactgtcattacctttttgatcctgtacgttagactgggctgtatgcatg

SEQ ID NO: 1222 - DNA, 25448 bp, Homo sapiens
catactcagtcacacaagccatagcaggaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacggtacgtgccccgcgctcgacccccgcgctggcggcgccggagctgtcccagaccccaagccccgacgcccggccctgagtcagcattgcagcaggccctgcgccgccgcgccccgcgtcccaccccgcgccgctcctcacagccctgcgctccgggaaactgcaggtggccggcagtggccaggggatggcgggggcgcttctggaacctgactcagttttgtaggttccttatctcggttgtttaccgcgggctttgcggaatgcccccgcttccgtttccgcccggctccgaacccccgaaccccttctacccgcaactccgccccggattcccagaaaggggcgacctgggccacagcggtacaagctgcaccccgatggacctgagagaccggaagtaacccttggccaactctggccgccccctgcagccgcagccccagaggcccacccgcgagcttcagtggcgggccctcagcgtcgtgtaaactttgcttaaaatgatcttgagagttcaattcttggggtgaactgttgagaagatctggcatttttcctttcgaaagttgttgggaacgtggactttcccaacaattgtgtatgcgctcgatctcactcagtgggagccgccgccctggagggaatttcacaatagcctggtcagggcggttattttccagagcagtttaatgtctattttgcccaagtgcaaggaaagcttgccttgggaaagctgggaatgcttggctaatgaaaagtttttagagccttttaaaatgaacctgtttctgccacttttccaccgcctcaaaacgactgggaaatgtaaactggcttcaagatgttcttgcttgagggtgtctggatttggacagaaggccatgttcttttaatattaacagtggcacgcagtagaacaaaggccactgaaattcagaatcagtttttggctccacgggcaggaagtaaattcaaggacgccagaggtcttgcgaatattttaattggttgacatttgaaatttgttcttaagcaatgaggggtgaaaccagtagggggatagcgtatagcataagtaaagctttttggacatcaacaaactgcgataatctacaacagacagcgggctctggaaggtttgacctgctttagagagagatttccgataagaggaacggagtttttggcacttttcggtttggtgattcccctaaataaccttacaaaagtttcgttgaacaaaaaacctggctggagctccaagatcttttttttttttttttttttttgagacagcatttcactcttgttgcccaggctggaatgcaatggcactatctctgctcaccgcaacctccgcctgtcgggttcaagcgattctcgtgcctcagcctctcaagtagctgagattacaggcatgcaccaccatgcccggctagttttgtatttttaatagagacggggtttctccatgttggtcagtctggtctcgaactcctgaccttaggtgatccgcccgcctcggcatcccaaagtgctgggattacaggcgtgagccaccatgcccggcccaactccaagatctaaacaaaaaagactgggttgaaagggagtttttaatgtttactgtttgctttacatccattttcttgttttgttaatacttgctttacttaagcttttgggtcaaatgtcctcgttaaaatggctttctctagcgactttatgttttacgtttctgtttgtaactgacatttgaccttcttttaacacggtattacttgcttccttataccggtttccaaggtgaagccatttgcagggtcgctgggtttccccctccccccgaaagtcttgcgcgacccggggtgggccggatagtgtgcagttttttgagccttgggctggggacctccaggaagctgaagcggaaattgcctaggcccctggggcattggaggtcctaccgcagctcctagtaggtggtgggggcgcagcggctgtccccactcagtcctggtggggtcgcacgtaacggtcctgagctatgcataagccgtttgaccacgcatggagaattttaccacccagagacacgcgagtggccctgtgcaagtttcaactgcgcggggggcggggaattccgcagacaggattctagaatttatgtcttgtgtggtaacatttcagccggtgggtggcggggattaggcgtgaagcggttcagcaggcagaggttctcggacgccctccggcgaagccacctgttgatgcttttgactttctgtccttgttcctcgtcccatctggagcatttccaattctggttttgcggagcagcaggtctgagcttgtccggcgagggtgggagttggtcccggcggagatccagtgggaagagccggcggctgcccgggcgtgagtagaccgagaatcctgcccgatccccgcccctgggctggtgtcgccctgggctcctgggacgtcggggcactgtcccccgatactggcagaaaaggattgagtcctcgcttttggccctaggtctccttgagcctccagaggactcacaacactccggggcatgttgctctttcaaataccaggaatggactctggggaatggggcacccttgaagtctgattatttcttccctgtagagccccaggggctaattaaactcgtgtttatggactccaatgcctccttgcctttaattcagtataatcctaccaacatttattgagcttctctgggccaggcagagttctgggtgccgaggacatagaaatggatctaaacttggttcttgtccccataacctcacaatgtggttgaggaagactcagcagttacctacacaggtaacttcgagtcaaggcagtttagacaagatccactgacagcctgactggaggaagcctgtgggccatggtggggcagttatgacaccatgggttctttttgtttatttgtttgtttgttttgtcttttcttttagtatgcccaggtaacttgcagaacccggtcgttctttcttactatagatcagtgaggtgaaaagcactatcattattggaatgccctgtctctcccttatactctcttcctgtcatctcccctcagaagacttgacaccccaccctggtgccctttctctgtactttcatatgctcagcggctgtctttgcacttgcttcaggattgtacctaacattctgtactgtaatgcattttcttcagacactcttcagtcaagttgtattataattatgagttaaaatacatgcaaagtaaatagagaaaacctccaggggttcattccgtagagataaccaaaggtttcagtttaatgttttttttttttttttcacacatgtgcgctctcaaatacagtcttttacatatttttaaaaataaacactcaatttttttggtttattttctagtttgcaagatatttcattttttaaaattgtgtttatttacaacctgcttttttctaaaaaagattcaaggtggggccttcttttcttttctttttttttttttttttttgagatgaggtcttgcttgttgcccaggctggagtgcagtggtgatcatatctcacttcagcctctaactctaggctcaagcagtcatctcacatcagcctctggagtagctggaactacaggtgtgtgccaccacacccagctacatttttttttttttttgagacagagtctcactctgtcacccaggctggagtgcagtggtgctatctctgctcactgcagcctctgcctcctgggttcaagtgattctcctgtgaaaattgcttccttttctacacttgttctgtatttatgttcctctgatggtctccacttctagccactttctttttttggcgatttaagtttttggcccaaatagataaacatcttctacattatttttctcttattctcgatactgggttgccatctttggtgatttagtacttattatgaaagagagaagctacaccacttgataccactttcatctgcatactcatgataatttgtatcttctgcagtgaactcttaagttgaagaaatgaataatttatatgtatatttgtatacttttaaaaatgtaattgaaaaatcctctcatagttacttaactccaaggtttaaaaatgcttcccagggtaatgagtttctttagtcatgtgactttagaaatgggaaccaaagcttccttatctacttgtgaaattcttgagttttttccttgaacttcctttttatcttccctttggcttatatatctgtgttttttgtttgtttttacttgcagctttcaaaagtagttttcaaagtcaatgagattgtttaaaagagtaggtacctgacagtctcttgcttgaatactatctagtgagtgaaccaaattccctgcaacaataaccacaactttgaatcaagagttaaatgaaaaaagtaactccttcagcatttactgagcacctgctggggctgaggaatgggggcatgtagatctccctctgctgtctggagctccctttctggttggaaaacatagaagcagcgcaaaagtttcacccaaaaccttggccatggtatgctattgaaaccccatagttcagattttatacttgagttcttttctaagccatggctggattatgttaatctggcaaataattataaagctggattattttaatctggtaagtaattataaggttgtgctccgtgatgtagctattaataaaatatgtggtagcacagacaagttgtatatagcacaaagctatacccccagaggagacactatatcagttgctgtctgcctaggctttctgtaaacgtgctggctatcattcagcctaaatgtagaatgagtctatccctttaacctgggccatcaccaggaatgtaaaggaacctagaacgaggacccaggcaagagatgagaaactaggggacagatgagtaggtaccagggatggtgatgagactgaagcaagtggggaatttttattttcttctctacttttctctattttccagattttcttagagcaaaaagcaggtagtgctttttacagaaaatgaatgctatataaaagtaattttaagaactttatatatccctagtgttatgtacaatttctgactttgaatagagatatctcccaaagggccaagtttggccctttagttacaatggagaatctgttgtgtaaactgagcaaatacacctgccaagttgaaatttaatttaagccaatcttgtctagatgaacttaagagaacgtctcctaaatattttattgcagtagtgtagcatgattgatagtatgctattctcttgaatagatggggttgtttcttgagccactttttattcctttgatcaaaaccttgaggagaaggaatgcctgttttcctgactgctgttgcatgaagttagacatccagttcctctaaaggtgacatcagatggtttagatacctaaaaagaagtgaggctaagccataggtcttcttcgtactacctgaagttgagacctggtctctgaactcagttattgctgaagcattaaaatcttacatcttgcttaaactcaggcagcttgacctgttctcatttttctctatcaaataaattgaagcctggtaataaattgatgatgagttccaaacatccccttggttggagacattgtattctccccactcacaatgaggtcctgccagtttccagaaaattttgcatgggggcttacccatccttttagaatcacattgcaagtcactctaaagcattagcattgttatctcatgtagctgcaaaagcttcctttcacaagctcttctggatccaacaaccagattccaagtatggtatcttaactacaccaccagctccatcttgcttcattgtatgttatgaagggatgagtaagcgttacacatgggctgcaatggtccaatgatgaccagtctgttcaagacccaagagggctgagattggcagccctggccattgtttaccacagcctaatgaagatgagtaaaagcctatctatccccaaggacctccacatatgacagtactcaactgagtctcacataggatagaataagataaaatgctggaagagaacacaaatagtgctacaaagcaggaagagagacttgatttggggatcaagacaagcttatagaagagacatcttgagagagaagatataatttcaggtacagactgagaggagggaaggggctttccaaatggaggcaaatgcttgagtgaagttgctgggacagaaaaatactgtccagggaacattgagatatttttggttcggagttagattatgggttgggctgaagtggggatgatactcttagtgcttgagctatgtatcagaagtttgtctatagtattatgcacaatttctgattttgaacagagctatctcctgcaggaccactcttggcccgttagttacagtgggcaatccgttgtgtaagctgagcaagtatacctgccaaagtgaaaatttaaatttagttaagggcactacatcaactgatttagctcccttgctcctggtgactttgcccatgtttctatatccaattagatgatgatttatgatcttttgatttagatgctttctcatttctgattcattctcattttctgcagcctacacataagtgttaggaaccaaggaagttattggcgataatgtctggttggaatttgtgggagcttccttgagagtcatgaaaagtctgttcttagtctgttttgtgctgctataacaaaatacccacaaccaggtaatttataaaaaacaaatttatttctcacagtctggaggctgggaagtccaagatcaaggtgctgacatctggtgagggctgctccccgcttccaatctggtgccttgaacactgcattctacggaggggaggaatgctgtgtcttaacatggcaaaaggtggaagggcaaaaagagaaataaactccctttatcagccccctttataagggcatctaatcccattcaggagggaggcgcctccagggaatgatcacctcttaaaggccccacttcttaatcctatcatattggcaatacctgaactttggaggggacacattcaaaccatagcagcctcatcaaataattttataaaatatgacttctaattttatgtcattttataactgggatcatctgttgttctgcacgccaatggagggggaaggtgaattttgttatgttcaagatgaatgcacaaaacttctgtgagatggccacattctactttacccagaattgtgcaacctcttctgcttttagaaacttctggatgacactttgtttcatgttcatatctccactggggcttcccagacacctgaaagttcaggtttgcatgctgctttctgcagctggcaagacaggtttctccattgccgcccagtttgtggggttgcaagaaattacatttgcattcacgctgtggctcactggacatgacattgctttcatgccatacgatgaccttgcttcactagagaagcagtagaaagaagggaatgttaagtacgtctttggatggcttagctggtcatgctgcatgctttgctactgattacagggaacaatatgtgcctttgttaccagatagtttgggggcagcgttggtgttctgtgagaaaggttgagaggcctgactaaacttaaccacatttgctgacacctggttagggctaatgtgggtaccagggaagtgtgttaagtgcttcaatagaggtgttttgttttgttttgttttgtttttcgagacggagtttcactcttgttgcccaggctggagtgcagtggcgcaatcttagctcactggcaacctccacctcccaggctcaagagacttttgtgcctcaacccctcgagtagctgggattacagacatgcagcaccacggccagctagtttttgtatttttagtagagacagggttttgccatgttggccaggctggtcttgaactccttgcctcaagtgatccgcccgccttggcctcccaaagtgctgggattacaggtgtgagccaccgcgcctggccagttcaggcatgaactttagaaatttcacttagatggaaggtagatttggagagggtgaggtctaaagcagggggaacagaatggctaggggaatgagtttggatgagagacggatggtaggcaccagcatttaagggacaggtgcagaaagagtatgctgaggagtagaagaaagttagagaagggtctgtgtagaatatagtggtgtgagctcagccaagggagaagagtttcaaggagggatgaattagcagtgtcagctggagttgagcagtcagatgaaagaggacttccaagtttttggatgtggcaaccaggaggtcaccagggcctcaacaagagctgtgtcatcagggctgggatactagcaggggcaaacgaggcactggcttcaggacaacatgtgagggggtgctcaaaaagtcagtcatcaagatagataatattttaatgcaatattttaaaaaacagacataaatgcaaaaaatctatgatgaacaaaataccaacattttaaataaagacagcgtcagtattgctgattgtcccttttgcctcagattccagtatggctcaggactgagtgtggctgtgtagaggagatggtggtgaggggatccaggtggaggcatgttgagaagtgaattgtggttgaagaaactgaagcactgagtacagactattccttcatgaggtcccagctttatgtgaaagggaataaagtgaaaggatggtaggtctaggggaccctcaggcttttttgagggtttggctttattttttaagatggaagagacttgcacatgtttacaagctgggaggagccgtctctggaggtagagaggatgaagagagtagacataggggattagtagagacaggagggcacacagggaggcttagccctaggcaagcagagggacaggagggaccagctggggcagtggaaaggtggaaggtggcaggagtttgtgcctgatacatggatgagaaatggcactgggggtggtgttgggatggaagagagttgtggagtgttggaggtttcccacactccttgaagggtgtgggaaaggagctgaacagagtcttcctgtaaatgaaactgttgagcagccgtaggggcccagctcaggaaaccaccagggtgtggtggtgagtagttttcagattgtgttatctcttctcccttccttcggaacttgctactggaggtgtaggagtggtagaggcttcctcattaaggcaggggtgctggagcgatcaaccatccctgtttgcctgggactgaggggtttcctgggactcggtcaccctagatgttgcagggctggcagtcaggagggaaaaaggccagataattgaaaatgctggccagagtttgtagcatgcgctgtctgattgttgtacctgagcgagttagagaaaacgccacactttgagatgaattaagagtccgtttatttagccggcggccaagagacagctaacgctcaaagttctctcagcctcgaagaaggggctagattttcttttatactttggtttagaaaggggaggggggggtctagttaaaacaattttacagaagtaaagtaggcaaaaaagttaaaaggataaatggttacaggaaagtaaacagttccaggtgcaggggctttaagactattacaaggtgatagacgcggggctttgggcgttatcaatctgacgaattcctgagaactgcggatattgctggccacagtatcttatcagttaattgcattcttggatgtgctgggagtcagcttgcacaagttaagtccttgcggaagggctgccagtgaaacagccaagatggagtctgtctggctctcttagctaagggagagtcaattcaggtgaaaacaaggctaagtgattaaaggaaagggagagtctaaaaacagcgttagtaaaaacaaggttgggcattacatgatcactgggtctccactgtcagagggtctttgagctcagttctagtggcagcctcctgatcctcacttccctggctgaggcaaggttgttgcagcagccccaggagtctttgttagaatcccaccccagagctccttcctccagtcctctcagcagttttgttagttccagtattaagtgtaatttctacaaaaaatgcctggaatatttctgtttccagaaccggatgctcctgttagctagtgtgtgaaagataactctgacttgcctaagctttgttgatgttttgaataataattggcgatagtctcttgacttctgcaagagaaatgaaacagaaattggtctcaagttttagttgctcttgtgaaggtcagggacagtttgtaccagggtgtgggtgtggaaaagaaggggagatatagtcattaaattagaatatgcctgtgaggggagttaaggggaattcctttaaaattctagaaaacacacacaggtgccaattttgtctggctagggaaaagtaaactgctgaaaacacttggggggagaaatgaagctaatggtatcttgatcagtcaggaggattgggtatttgaaagcagggaagaaaaataattggacttggatattcctttgccccttcatctgagtaaggtgaaagcaagtgactcttcagaagaggcgaatgggacactgagtccagcagctcaggcagggtggagttggtaactgatgggcacaagtcttttactgggctctaaagaactcattcatctgggtgtggtggcttacacctgtaatctcagcatttcggaaggctgaggtaggagaatcacttgagcccaggagtttgagaccagcctgagaaacacagtgggaccctttccctacaaaaaactgaagaccttatgagcttccctagtctaagagtaatttttatgttaatttcttggcttgggcttaaaccccaacaaagtggtgattattcggaccccagccctacctctccctagtatgctctcctttctcaagtactcaccacctctagccacagtgaactgcctccagcatacacacacgctgctattttgttgcatctgagtgggctggctccacacgggatctgtagtttccttttgatattttctttcaatgtgccagatgctaccactgagtaatctagattttgctgccaaactctacccccgttagcacagagggaagacagtatgccagtgctcttgctgagtgtgcgtgactggcagaaagcagtcatgggtgtgatggttggaagaaacaaactgagcagataatgttttttaaaatgattatctcattttgttaactcttggtggcattgttatattgttgatacttatgaattacaaaagttagatgactgtaaaaaaatagagaattaagcatttcatttctagtagttctgtttggttctttttcaaatatgtcagtgaatttgtataatatctcatttcttagtcttgtgtttaatgattttatttttgtgtttttataattccttctactgcatatattttatactttaatttataataacaactgttgacaaaattgtgactattcattaatacagtagaaaagaacttggcctccttttcatggaagctgatgatgagattaaagcactgttggcctgcgagtggagtatagatttgggctgtccagaacacataaaatttgtatttatctttctgataaaaaaaagtaaaatagtctgagtgccaatttttccactttcattgagcacatttaattttagtaaatttaacttagcaaatttaatttctccagttatttacaaataatcatatttaagtgaagttgggatgaatgggcaagcccatttcaaatttctaacctaatttttcctcttgttttcatataaaatttttctatttatgtgtttttattttaagatagctcaaatcttttgtggactgatactgtatgtatataaataaatggattcagtgcttctttcactaaatacagctagataaatatataaatatacttgaacacaaatacaaagcaaccattggcaatttagagttgggttgtgtttccacttattttttgttaataaatttgattttaacctgaaatattgtcttgtaggaacagataaagaacacaagaggtgatttaacataagttttagctgtgaaacttagagtagataggttagcaacttaaattttgaaagaaaataggatgagtttcaatggaagaaattaagaacacacccattgcatgagctccttacccctcctacccagccccctcccaggagtgagatctttccccagatcctctgtaacttccagatgttccactgagaacatcagaagcactaatggcaattgctgccatgtagcagtgcattgagagtcagggcctctggcacctccatggggctcagggtctgaagacgtgatccaaacctgacaacttggtggcaggttctgtgagcattcatgatgttgtgaaaagggcttggggtctaggaggatggcagcagaggtttctgccctcaggtgtgagtgaggggcttttgaagtaggagagcaactagaaaaaaggagtggcacagggacagaaacttcttttctccattgtttgttcaaggccacgtgggtggagtcattgaggtggaggtttaactctgtgacataagtttccctgatttagtcaggctgtctgtcgttgggcttttcccacttccttctactacgtacttcttccctattcctcctactgaggccattaaacccttagttgtaattttccctgaacatgctttacattctgatgaattctgaaaaagaatgtggggtttccttgcagatgagttcatctgttgtttcatttcctttacaatgtaggttttcttctctgtctttttggattagtctgtttttggttctgtctaccaaggatccctttctttagacttctatagatccctttctatagaacttaatctacttaagtcagggagaccacccagaaggaaagagcccatactttcaatcttaggcataagttagcttgataagattttcagaaaaattcccttttaaccacagaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactataggtaattcatcaactcttcctgaggctgggtgggtgggagggagtgaagtgtctcagactctactgaatggcagaaacgaggataataagaagtgcagccactttactgtctctgcccacttatccaactgccagatgatgtcacttcattcctgtgagccctttaaattcttgaaacttgttttcttgctttctttttctttctttcttttttttttttttttttttttttttgagacagagtctcaccctgttgcccaggctggagtgcagtggcgtgatcttggctcactgcaacctccgccttctgggttcaagcgattctcctgcctcagcctcccaagtacttgggactacaggcgtgcgccaccatgcctggctaatttttttttgtatttttagtggagacggggtttcaccatgttggccaggctggtcttgaactcctgacctcaagtgatccacctgccttggcttcccaaaatgctgggataacaggcatgagccattgcctccagctgaaacatgctttctcaaaggaattgggatcatatgcaggtagaagggcagctggtatgtgtttgcctgaaggatagaatgacaagacgtgaagaaagataggaatgactaagagctagtcattcttgccagcctctgacagtgtgagatctgcagcagtgtttactagttcattttctgtgaagtcagtccttgataatttgtggtacaaagaaaggaaataacaagtctgacagtaatcttcctacctttgtagagactccatcatcccttctgaatccctgttggccctaccctgctgaggaagtttatcagggtgggctcccttcctgcacttcctgcgcttggagacattggagagcccacattgaaaatctcttcagttaaccacatttaagtcccttcagtccaaagaggaaatggccactggagtctgctttagttcccacaagctttgggttgctccttcctcctgttcacatgttaatgtctttagaggttcagaggggcatggaagctactgagagactgacttcctggggaaaggaagataacttgtaaccttaagttggtgttttctttttttttttgagacaaagtctcgctctgcagcccaggctggagtgcagtggtgcgatcttggctcactgtaacctctgcttctgggttcaagtgattctcctgccttagcctcctgagtagctgggattacaggcacgcaccactatgtctggctaattattgtatttttactagaaacagggttttgccatgttggccaggctggtcttgaactcttagcctcaagtgatctgccctccttggcctcttaaagtgctgggattataggtgtgagccaccatgcccagccggtgttttttctctcgaccaccagccttttattatgttgataatgtgtatttggagatgataattattatcaagaactatactaaagagagctgaaagcagtgtgggctttggaaagtatatgagatttgaacttggaaagcctgtttttttggtttttgtttttttgtttgtttgtttgtttttgagacagggtcttgctctgtcatccaggctggagtgcagtggcatgatcatagctcattgtagctggaagacctgtttcaagcctcagatctaccaattatgggccaggcaggctgggccaatcactaaccttgttgggcctctgttttcctacttgtaaagcgaaaaataataatacctgactttacaaggttgttgtgagcatcagttgtaataatttactatgtgaagtactttttaaactgtgaagcactctacagatagaagggattattatcattgttattattattatttttttaatcttccacctattcagccatcagttttaatgtcagtaatcttcagactttccgggaggcaccaactgagtttcagtgaatagggcaatctctccatttcccatttccttgctatgatgagtggagattcttcaggccctctgggaagggttgcgggggcagttgaagaggagtgctagatttatttattcatctggtgagtgggcttcattgtgtattggtgctaagtgttttggtaagctctaggacaaaatgaaaagtctgccatcctcaagaatctgagagcctaactgggaaaatggccttgatgacaatgtcatggtaacaatactaaccacagggtgtccttaggagccccagaaaagtgtggttgttggttctcaaagtctatttcctagggggggaaaaatatatatatatatatatatatatagtgttagctccagccaccagtgagtcaggagaggctttctaggcaaagacatctaagttcagaatccttgtgatccagatgcctgtaccctttgagttcagaggtgggccagggtatctcaggtatttctttcctttagcatcttgcaattcaaaatatggtccttgaatcaacatcacctgagagcttgttaaacagagaaggctacttcaaattctatttctgtcttttatgttagtcatttgggttcttaagtcatttcactgtaacctctgggggagctaggggattctttaaggaagtttccattctctgagttgttttcagaaactgttagttggcaaaggatgtaccatctcctattaaacgggcaaggacaagttcccttttctgaggtcccttaagatctcttcctggggtgatctaggcttgctgttttatgagggagggacatatttacacaggggcaagaactagtcttttaatccattgttgcataggggaggcgtgggcacttggagttgtcttaggactgatgtctgaattaactaaatgaacttgtctggtttgcagagtgctgatggcagagattggtgaggatttggataaatctgatgtgtcctcattaattttcctcatgaaggattacatgggccgaggcaagataagcaaggagaaggtgagttttcttcttttggttcatggccccaggagcctatcagaagtgggagctactcttgttgatacagagagagggaagcaggcagtctgccgccactatagtgggagtcagacatctcaggtggcttttaaacaacatgaatgggaagagaattggtttatgaattgaagaaataggattataacatcttctggtgtggtcttggatgtttctttcatccttggattttatccttgtttctgtaaaattcataggtctggctcatatgtgtttccctccctggtttgatggggttgtggggaagacatcccatctgcttgtgctgggggaaaacaggaaggaggtgctagtccactatagtatcactctcctactgccatctatttctcctcagctgactcaaggtcattgtggggtctaggctgcatgtaggagtggggtggggggaggttcttgtgactggtgtatctgggaaatggtaaaagtagagatttagagttgaaaaccaggaggccgggcgcagtggctcatgcctgtaatcccagcactttggggggccaaggtgggtggatcacgaggtcaggagatcgagaccaacctggctaacacggtgaaaccctatctctactaaaaatacaaaaaaagtagccgggtgtggtggcgggcgcctgtagtcccagttactcgggaggctgaggcaagagaatggtgtgaagctgggaggcagagcttgcggtgagctgagatggcgccactgcactccagcctgggtgacagcaagactccatctcaaaaaaaaaaaaaaaaaaaaaaaatgaagaaaagaagaccaggtagtggtgaagatctcggggatgtcatgattgctagaaaaatatttaaaatccatggccaggcacggtggctcacgcctgtaatcctagcactttgggagactgaggtgggcagatcacctgaggtcaagagtttgagaccaacctggccaacctggtgaaactccgtctctactaaaaatacaaaaaattagccgggcgtggtggtaggcacctataatcccagctacaggaggtgaaggcaggagaatcacttgaacccaggaggcggaggttgcagtgagtcgagattgcaccattgcactccagcctgggcgacggagcaagactctgtctcaaaaaaaaaaattttttttaactccagttggcctagcacaatggctcatgggcacagtggctcatgcttgtaatcccagcactttgggaggctgagccgggcagatcacttgaggtcaggagttcaagaccagcctggccaacatggcaaaaccccatctctactaaaagtacaaaaattagctgggcgtagtggtgggcgcctgtaatcccagctacttgggaggctgaggcaggagaattgctagaacccaggaggcagaggttgcagtaagccaagattgtgctattgcactccagcctgggctatagagccagactccatctcaaaaattaaaataaaataaaataaaataaaataaaataaaataaaataaaaaaatataaaataaaataacattctagttggccctacatggtactgttgacctaaggataggccaggaaatgtttgagaacctattgtttctaaaatatgacaataggtcctcaaaataggcaggccagtgcctgcctgtaacgattcagataagtcattgcttgagaatttcctcatgttcctaatgattatagttttgtttcttaagtcccatcaaatgcaaaatgggaaggaaaatgaaactagaactccctttttggtttctcctagtaattgtctctcccagccatttatatatatctaaattatgattattattttcaaaaataaagatagcacttcagtaactaaatgttaaatgcaaaggaaatagatcccaaagcaatgcctgtttctgaaatatcgttcgttcataatcactgtggcccaaggtaaacgaatagcagaatactcaaaccttgttgtaatttcacttttttataatcccctgagtcagaacgtcagaatgagttggaaggcccaatattgattcaaatattttggaaactttaaaactataacatgtgatttttctcataaagtctttccccagctacctttcttctcctttttcagagaagcccttagagtttttcactatgacaccagcctggccttttggaaaataataaacttaggaggattgtcttttcagccctgctctttcacggtccttctcaatgacacaacatggcacacgtgtctctctgcaaccaaggagcagattgatgaccaaaagacttaccaccacctctgttctgagtaaaaatcaggagtctaagttgctcatgacagagatgtctggtttaagatcactgaaggtcactgaaagggctcatcttgtcacattttcttactgctataaatcacatggactgaggtttgcatttggggcttattagtcagctctattttttttttttgagacagggtctcgctctgctgcccaggctggagtgccgtggtgcaatcactgctcactgccttgacctctgagttcaagtgatcctccacctctgcctcctgagtagctgggaccacaggtgtgtgccaacacactcagcttattttttttattttttgtagagatgggggtctcactattttgctcaggctggtctcaaactcttgggctcaagcagtcttcctgcctcagcctcccaaagtgctgggattacaggtatgaacttctgcacctggcctagctagctctattgacatttgttttttgttggtggttctcttagagtttcttggaccttgtggttgagttggagaaactaaatctggttgccccagatcaactggatttattagaaaaatgcctaaagaacatccacagaatagacctgaagacaaaaatccagaagtacaagcagtctggtaagaattttggcctctcagtggtctaggggaagtactctgtgcatgggggtgggcatcatgactgataaatattcatttgttggataggtggatggaatggaacctggatgaccaaagcctcctttagcttgtggctagaaatcgcgtccctttatattcttcatatcccagatctgccaactccattgccctgtatattcatgatctctgcaaaatgctgccaagcagttcttaacatttcagtcttcaagaaagaatctgggatctgcacaggctggcagagctatggacattcaggggttttgcatgtatgctgaaccctactgccttgctctggtatttggcctcacaaccactgtccaacttcgggtgatgtcacttgggtctcataccttccttgcatgtgtcccaagtttcacaaaacctccttatggaaaagagcacattcgatttcttccttgataaaagggaccagattcacattggccttctgctttacttgcattcctcattgtcttttagactcagcctcagcttgggctttgttagcaagttcactgccaccatagcatcacagcctaaagggcatggctgagactcattgatctatagagcactcttttaccccaacatactctaaatgactgatcaaagatcaaaaacagaagagcatttatactccattcttgttttttgagacctgcttgatttattccgattatttaacacacagggacgcaacagtgatcccaaagtgtgtaaagttaaagccttcaactgcagctgaggagagggcaggaatggggacggtggtgagtcaggaatgacaggcaggcagccatgaccagggcagcctcctccccagggccagggactggggagtggcctaaggagcaggacctaagggtagcccagagctggggaagggggcagagacctccccttggcctaggtctggagctcagaagtgccacatgcctgagggggcagcggcctgggaagggccagaggcagggtcaggagagcaccatttcctggggggctggggacagggaggtgccctataggagaagccaggaggggccgtctgcccctgaggtgggggctgggctggagcaggctgcagcaagaaagacctgaggcaggcacagggcctgagagcccagctgcctgggttcaggggggctcccagggcagcctggcccagggagcagtcctgactctgcaggggatgcccagcaaggggggctgcagacccctcagagcctcccctcctctctccctggaaaggagctggggaacccatagtgcaaatctgtggaccactcagttatggagggaggctgtgcctgaaggtggacactggggtgcactccctccaccatctcgccctgcaccgctgtcctcagtacagccacttctcgtaagagtgcaggccatggatgccaccgtcgatctgggctgacatggtctgcttctcaaacttgagctcccctgagtacatcatggaccgaaggacagacaggctgtgggccccgatatcctggcagccatgctggatgcccactatgaggtagggcacgaacttctgaatggaccctttgtcctggatggagcccaagacatcctgcgtgatcttcgccttatccccgtcgttgaagtattgtttctggctgctgctgctcttctccatggcatccagtgagcccatgccctggtacttcttgagctgcattccgtctgagaagaagcactcgccgggggcctccatggtggcggccagcagggagcccatcatcactgtggaggctcctagggccagggccttgaccacatgccccatggtctggatgccaccatcggctatgatgggcacaccaaagttctgggtatgcttggccaccttgtacacagcagtgccctggggctgactgcaggctatcacttcctggttgatgtagatggagccgcgcagtccatgcccctgcccagcccatccacaccagcgtcaatcaggttgttggcctgggctgctgtcaccacgttccccccaatcacctggaggtggggttacttttgtttgatgtaatgcaccatggcgatctgatacaccgagttcccttgggacgagtccaagcctatgacattgacgcctacctgggtgagcaggtccaggtggtatttgtcatcctcatgggtacccacagctgccccgcccagcagctgctcatgggaatccttggaggccacagggtagtctcggttcttcagcgcggtgcaggtgataatggccaccagctcatcgcgatcattgacgataggcagcttcctttcttactaagctgcaggatctcatttgcctctttcaacctcacactgctggagccaccactagcttgatccttggcatcatcacctcactgaggagggtggtgtggtccttctcagcaagaaagtcgatgtctcgggaggtgacgatgcccaccagcttgctgcccatggtacccgtctcagtgatggggatgccagagaagccatgacgcatcttggcctccaacacatcacccacagtgtgcaaggggctcagcaccacggggtgtgtgataaagcccggttcaaacttcttgaccttctgcacctcactggcctggaactctggggtgcagttgtggtgaatgaaaccagtacctcccatcagagccatcacgatggccaggtcggcctctgtcacagtgtccatgggggaggagatcagcggcgtcttcagagtgaccattgggtcagggctgaggtcaggtccacctcatcagctatgaagtctatgaatcctgggagaatcaagaagtcgttgtaggtgagtccctggtcactggcgaagagctgctgcacggtgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgaccgtcccccagcccgacacccataaagggtctgtgctgaggaggattagtaaaagaggaaggaacgcctgtttgcagttgagagaagaggaaggcatctgtctcctgccagtccctgggcaatggaatgtctcggtgtaaaacctgattgtatgttccatctgctgagataggggaaaaccgccttagggctggaggtgggacatgcgggcagcactactgctctttaagtcattgagatgtttatgtgtatgcatatctgaagcacagcacttaattctttaccttgttcttgatgcagagacctttgttcacgtgtttatctgctgaccttctctccactattattctatgaccctgccacacccccctctccgagaaacacctaaaaatgatcaataaatactaagggaactaagaggccggcgggatcctccgtatgctgaacgccggtcccctgggcccccttttttctttctctatactttgcgtctgtgtctttcttttccaagtctctcgttccacctaacgagaaaaacccacaggtgtggaggggcaacccaccccttcagcgcagtgaacccgtcctcgaccacgtagccggtgctgctgctgataggtagtccctcatgctgccgcgagaccccgcgacccgacataaacgctgcagctgctgcgacgcggaggcgcgccgctgccacgctgcagccaggcgccgggtgggctgggtgggctgggggcgggggctgcggcagcggcggggcgggccagggcgccctatactccattcttcatgatgtttggtcgaagagtcatctgaaattttgaattcagtaaggtggctagaaagtttagggtattttgaaagatggtgattgaccttggactgaaccactattgaagatttatttgataataatttgtaagttttaactcagtacctcccttctgcttttatagttcaaggagcagggacaagttacaggaatgttctccaagcagcaatccaaaagagtctcaaggatccttcaaataacttcagggtgagtctggagaaaacatatggaatcccagcatgaaaccgtttcagagttctaataaaaatatgcatattctcacagcatgtactttatttaatatctgaaaaaattgtgatagaaatgtgtatttgttttaaaaacgtgtaacttcttatatttcaaagctaatacatgttcattgagatatttggagactatagagaaagataaaagaaaataaatcacctatattccactatccaaagacaaccactgttagtattttggtatatttccttctagactcttttttatgtgggtttgcatctgtatctgtatgtatgtatatatatatatatatacatacatacatacatacagttggacaattggacatttttttcactgttcatttattcacttgaaattgtaacttaaaaaaagaaaatgtaactttaaaaataaaaatagatgcaccatgcctatggaaaaaaatttaaatgtactacaagaggttttaaaagtatttttttgcccgggtgcggtggctcatgcgtgtaatcccagcactttgggaggccgagccggaaggatcacctgaggtcaggagttcgagactggcctggccaacatggtgaaactccatctctactaaaaaatacaaaaattagccaggtatggtggcaggtgcctataatcccagctacttgggaggctgaggcaggagaatcatatgaacccaggaagtggaggttgcagtagccaaatcgcgccattgtactccagcctgggtgacaagagcaaaactctgtctcaaaaaaaatgttttcttcctacccctataatactgacctccaattatttttcctaaaggcagctgttgtgaactagttcattctgtaactatccagagatagtctacacatatatttcatttttgcttttttctcttctacagatgataacaccctatgcccattgtcctgatctgaaaattcttggaaattgttccatgtgattaacatggaactgcctctacttaatcattctgaatgattaaatcgtttcattttctaaatgtgttataatgtgtttagccctttcttgttgctgtatgtttagatgctttccaatcttttgttactactaataatgctataaaataaatatccttgtacttctttg

SEQ ID NO: 1223 - DNA, 45154 bp, Homo sapiens
aaaacatttagtgatctttttattatattaatatactctgggtgaattaacccttaagccctaaaacgacaacaaaaatatattacttagatattttgtaattctggtacttgaaataaagacaaatagaaaactatgttaaaatattaaaaagttgcaaaatttcattaaaaacatttacatttgtatcctaatgccaatttatacatacaattcttttaagttagatttaatggaatatcttaacatatgaaaataatagaaataaatattaaatattcagaacatactcatgagtgaaaattcaattaattagtattcctaatttagatatttatttatgaatgaccaagggattttacagttcctttttaattttttgtacttgattcttggtcccttaacaatgtataaccctgtaaaactctcaatagccactaatcactggtaggatcatttcaacaaaaacacatgattgggccgggcgcggtggctcatgcctgtaattccagcactttgggaggccgaggtgggtggatcacaaggtcaggagtttgagaccagcctggccaatatggtgaaaccccgtctctactaaaaatacaaaaaaattagccaggcgtggtgacacacgcctgtaatcccagctactcgggaggctgaggcaggagaattgctcgaacccgggaggcggaggttgcagggggccaagatcgcgccactgcactccagcctaggcaacagagcaagactccgtctcaaaccccaccacccccgcaaaacaaaaacaaaaacaaaaaaacaacaaaaaaaccccctgtaactaacaaaagaggaacctgttttaaatgaacccgtttgcttgtcaatcactaaaaatgaagtctttttataagtattttctttaagttacaatatatagaaggcatgtgtatatgtgtgtatatatatatatatatttcttaaaagtgttgattggtgagaaaagaataattccttggttaacttttctcattcttgttctgtttaaagaagtgttttgtctgtattttaaaaatggattagaaaataatggccaacatctctttaaaaccagaaaaaatcattttacagacatcttggcatctatactctgttttgtctaataaactttaaagttatttctctccttatactttttttttttttcgagacggagtctcgctctgtcgcctgggctggagtgcaatggcatgatgtgggctcaatgcaacctccacctcccgggttcaagcaattttcctgcctcagcctctcaagtagctgggactacaggccaccacgcctggctcatttttgtatttttagtagagatggggtttcaccatgttggccaggctggtctcgaactcctgacctcaggtggtccgcccgcctcggcctcccaaagtgctgggattacagcgtgagccaccgcgcctggcctcctctctccttataaacacatttaacctgggcgtggtggctcacgcctgtaatcccagcactttgggaggccaaggtgggcagattatgaggtcacgagttcgagaccagcctggccaacatggtgaaaccccatctctactaaaaatagaaaaaattagccgagcatggtggtgtgcacctgtaatcccagctactagggaggctgaggcaggagaattgcttgaacccaggaggtggaggttactgtgagccaagatcacgccattgcactgcagcccgggcgacacagtgagactccgtcgcaaacaagcagacaaacaacactgagcagagcatattcttaaaggttcctggtaggtcttatatcttactcagtattctcagtcaaccagaggtattagtttaccaaacgtggagattaattcatgcaaatttatggttattaatgtatccaggccagggagtacattgttcaaatcgggattagtttttagatattttgttgtttcacacggttggcaattaaaacatatttatacactaattgcattaatgcaaactccatcaacccaaacctttctaactatcctttttgaagtctgcccatgcaacatcagcgaggcaagcagaagccctgggcaccaggtgggaggggactgcccttcagtccatggtagcctaggcccctgggagcacaggctggggcagcgagagggtggatgcttccagacagaccctgactccctccacatggctgcctggatgtgacacaggcccaaccaaagctatggacaaaacccccagctcactcccacaggaggggatggctggttaggagactgttttttgagggttggtttcatcattttaagcaatgtgttgatgttttaaacatcctatcaactctttgaagaaagtaaacttatggatccaatcacaacatggatgtggaaggggcgggaggcccataccagtgggcttctgcctgctgtgaacacagggtgatcaggtggaaattcatttaacagtgacttcctccacatgtctttaggaattcgaaagtgtggagaaagtgaagcgcctctgagcaaaggcacgggaagggcccacacctgtgtctacctcagttccagcagggagctgatgcctgtcacaggggcagcactactggagaagcatccagcaaggtgcggctgaggtgggaccaattctcaaaaaaactacgattaaaaaaaagatgttctcttttgcctttatttcttgctatagtgggaacgtgagttctgctacctggggctgagtgcactgggcagcaggcccagcagacggggcctgcagggggaaggcacggctggaggcccgtgcgcaccgccactctcctggaaccgctgctggccgagccacagccctgcggaaattctactgcgtgtggcagagaccgatgtgcaaaaggtttctggtgaatgttttatggaaattgctccaagcactaaggaaagcgggaccgtgcctgtgctgaccgtggccttgcgcgagcgcctcccggcggtgctctctggctctctccaaacaggacgcttccttctctgattctaaggaaggcctgagacagccctgaaggcttaatgtacagtgcggccaggtcctggcactgcacgcaggatctttggttagctgcatccatatcgtttgcacgagagctgacggcacagacgcgtaagaggcgtgcacggcggggagctggggacagcagccagagcatggggccaccaaggccagagagttctggagagatggtgtagaatcaggagacccgctccatccctcacagagaccaaggagcccgagcgccgcgtcagcgcttggcgtacgtcctgctggagctcttgctcagtccgcccttcggggtggggatcttgcttccggcctttgaccccaaggggcctgatgcggccacagctgagcttttccctgcagagcaagcacaggacctgcattaggaggggcactcctacccacggaccaggtgcagaacctgtggccacagacacccagcaacaacgtcccaggcccatgctgatggccgtcacccgactacaggagccagggctgagcctagtagggtctactcttcagcttcctattttttttttttttgttgagacagagtctcactctgtcacccaggctggagggcagtggcgcaatattggctcaccacaacctccacctcccgggttcaagcaattctcctgcttcagcctcctgagtagctggactataggtgccggccactgtgcccggccaattttttatagggtttcaccatgttggccaggctcatctcgaactcctgacctcaagtgatctgcctgccttagcccccaaagtgctgggattataggcgtgagccactgtgcctggccagcttcctgattctaaacacttgagtcagtgatgtagaaagagcggaggacgggagtgtgaatcctaggccacccgtggagccttcgcactgcacagccagtttgcaggtggagaaggattttggtcacacgattctgattattagcctgcttactaaggaaccagaacatgaagacaggcttggatgctttattttgcttttaaagggatggggtcttgccatgttgccctggacggggatgcttttttgaataagtcaaaatggagggatgcagactacacctgctcagcggcgctgtccctcacctggctgcagtgccggggccttctgcagaatgtgtgtcttgcgcaggttcatcgtgcagccggctgggcccatcaggtgagctttccatgcctgcagcagaggaggcacacagagtgttaatcaggcgagacggacctggcacgctacctgagacccaaaaggactcgctgtgtaagctgaaaacgagggcggccgctccagcaagagccgcagaagaacggctccctcacctgggcacctcccttcggatatgttatgatagcctctgcagtctgtgcagggtacaactcaggaagcaagaagtcctgtcaccaggcaagcctgcatctcgcatccccacccagccacacagggcccttggtgtcagtgactctgagcacagcagagcgtgcacgcaaatgcaagggtgagaagcagagcgcccgcgtgattacgttccaggccagaagacagaacgcgccaggcaccgcgggctccccgccagcctgctgcccacggttcctcgtggggttcccactctcttcatccctgctcttcctgagccacgccacatgcacttgccctgcagaatgtggggcttatgcaggcctgactgcctgggcagccagcttctttcctttacgaccagctgtgggaccgtctgcatggggacagggagctcatctcgtcctcctgttggatataaacgcgggatcgctggttccctgagtcttctggacattcgagttgttcctggttccttcccttctatttaaacaacactcacgaggctgggcgcggtggctcacgcctgtaatcccaacactttgggaggcagaggtgggtggatcacctgaggtcaggattttgagaccagcctggccagcttggtgaaaccccgtctctactaaaaacacaaaattagctgggtgtggtggcgcatctcgtgtccccaacagctaatcccagctactcaggaggctgaggcaggagaattgcttgaacgtgagaggcggaggttgcagtgagccgagatcacatcagtgcactccagcccgggcaacagggtgagactccatctcaaaaacaaacaacgcttcccagggacactgctccagccgctctcccattctctggtggaccagtatctccaccagacacagccctgcttctccctggttcctctctcactctcaccagtggctgtcagtttctggccacctgcggcagccctcaagatactagagcgcttgcagccccagcccagcccactcctgtcccgctttagctgctcccggcaggcctgggttctggtctctccaggccactggcaaccttcgtgtccctaaagctggggcgccttctcaccagaatgtggcccaccggcacatggggtgcagttgcttccccctcccccgtggagggacatgacctgctctaaggctccaattcctccctccccagcacagaggtggcaggtccctctccatcccttgaatctgggtgactgtggcttgctttggccaatgggacagtggcagacacgtggcagggcaggctgaaatgaactcatgcgcctgggcttgtcttgctgttgccctctgctgctgtcgcgagaacgccgtgcccaggctggcgtgctgggctcagacacagaaagcaaagctgaggtgccgcagctgcctccaagaccattctcaatcagtctccggctgcggaccccaggcacacgcgtgtgtgagcccagtcagggccagcagagccgcctggccgccctatggccaagtgcagatgcaagagccaggcggctgcgatcagctgaacccagccaggccagcagggcatcctctctgatgggctgtgctctggggcctccaggacgccaccctcgtcaggcttcctccccagtgcatttcttccccagcgcctggtttgccttcttcctcccactctgcctggggcttctcctctgtctacacttgctctttagaagagtgctcccagtatcatgaccttaaacccacttcttatacacgcttacaaaccccacatttccacctgcagccacctgtctaccggcctgcgcgtctgacagggattttaactccacagctccaggctaagctcctgagcgccctggattcctgaccgcagttacttccttgccatgttgtgaggactccaccggccaagtcctgggtctgcctgcagtgtgtgtccagaatctgaccacttctcgccacttagctctctgctactacccgacctctctgtcccacaggctgctctcaacagagcagcaaaactggctggcatagggcccgccaggccatgcccactcttccgctcaaaccctgcagggacattgccttccactcactttgaagaataatggtcaatgatttttcatccccagcattgtctttcagtctatttatgttctttgatgaagaggaggttctcaccttttacaatttaatagttttattataaaatgagtgtacagttcagtagtgttaagcatgttcacgatgcttaactccagaactcttttcattttacaaaacccaaactctgccccaaggttcttcattttaatctaattgaattgatctgcctcttccatcaaggcttaagctttctgtgtcctgtttgagaaatcccttcctattctgaaggctattctcttatctctagcatctcctgagagattcataattgggcctttcacatttgaatctcagatccactcggagctttcttctgagcagtgtggagggtgtcaaacttcactgtttatcccccttcacattcagaaaaattccagatgttagaattagcacaaaaggactttaaagcagatacctagtatgttcaaggacttgaacgtgcaatgaagtgctactgatctattagaacccgggcgaaccttgaaaacacgttaagtcaaagacacaaaggccgcatagtgtctgattccatttacaggaaatgtccacagtaggcaaatccatggagaccaaaactagacatatggtcgccaggggctggagagggggctggggagaaaaggggcggcatgtaggcagtgttgtcttttgggtgatggaaaagttccacacgtgtgcagatggttgcagaaccctgaatacatgaaaacccactatctgtccacggggagaggctgtgcagactagatctccatgaagctgttaaaaacaggtgatcttaatgagtgaacagaggtgaatctcagcagagaaatgaaacctgtaaagaaatcccagccaaacacaaatactagaattggaaagtaccagattgaaaatgaattcacttaacagaggactggagatggaaggagaaagggcaggggccattcaactagaacagaaaggaaacactggacaaagcccagtgacccacagaagattgagcagtcttcacactcacgagcctgcaggcaggagagaagggagggaacgctgaagagagaaaaaatatttgaagaatgaacggcaaaacaattcacacgaaattagaaagacgtgtctcagcaggctggagtggcagagtctcctgctggcctcgaggaagtgagctgccagcagagaggcccccggtgctgacggtgggggcctctaggagttgagtggctccgggttgacagcccccaagaacatattactgccagctgctgggatgagcctggaagtgagtccttccctagcagggctgacagatgagaatgaagcctggctccggacccagggaacccgtgaggtaatgagtgagtgtgttttctgcttatgctgaagggtgtgtggtgatgtgtaaggcagtgcagataatgagatacagggaaagcagatgacacatgagatacgcctggtgacagccttacaggtactacctgtaagaggatgtcaattcaaatcagatgttgggaacaagaagggaaggaagaaaaggcagttacaggagaatgtgagtactgctcctagtaggaaaccaatggcaataactgaaatcagaggggatgatgggcattgcacgggaggacaagtaaaggtaacaactcgaatgcaaacacaaaggctcccacattctggagataaccaggggaaaagatgtatgtgcagtgaaaactgcttctattgggtagaaaaggggcaggatgccctgtaggaaaagcagcccctggaggaaggcggatggaagcggggcaggacggcgcctctgtctggggtggaggaaggcagatggaagtggggcaggatggcggcctctgtccagggttcttccaagatgcctgattctatcgacccggaaacatgtcttctgtaattacagaacttaattctttaaagtcccctagaaatgtaatataaaatgaatgtatttacagttggtggcactgctagccagggctcacccaagtccctccaacacagggccactgggacccccgtcaccagtggcagatgtggtcaggacaagaactgggaacagatctaatttccagtggcatctcctgctggcggtgcaggtgccactgtgctggggctgccgcaggtgcagtgggggccaaggtgaactggtcgcctccaatacctgaattctgtctcctgggcctttggaaaccggggcccatggatgtaagaaaggagacacagatgttgggagagacaaggttaaataaagcctgcagctcagaacgggaaggggaagtgtgtgtgcatgagtgatggagcttacttcccttgatttctcctggctgtgtccactgagagtccagccacagcgaactacccagcagcagtgggcatgaggcccccagcgctgtcctgagacatccattcctgctaatgggaaccaggcctctgtgcccagatggctgattccaggtccggggaaggaaggcaccaaacaggagggagctctctgaggctgcgtggctctcatccaggcctcaggagcccagctgaagagtctgccataggctagagctgggataattcacgcatcactaagcatggtaactgctgtgactggaacacattgaataatttaaatccatggttcataacgacactacagacaaaacaaaacaaattagctgccatggaagatgctagtgacccagcttactattctgaaaaccagtaaaccaaggaaaaaaattaaaccttcactctgcctttccaatagaaagtctaacctagggtcaccacagagtggacgagcttctgcttagaggaatatcccagcagatgaacgaaggagggatgacagaatgaggcccctcctgagtcggtgggttaggccttgagcctcagcagctgccaccgtcacacatatcacgcgcctcccgggggacacaccagcattgcctgtgaagcggccacactcacaccgagcctgtgcacacctgatgaggcccagagatcccacctcctgtttacaggaaatacagggacagagaaacaggttaagcgcccccaagggaacgtagtcagcagatccagacgatgagaagccctacggggcaaacagctccttccttcaccaagtgaatcataaggaaaaagaacgagagaatgaacctgttcaaaacagaccaaccaggcaccggggccttctatggatcccggtaatcagatgcttctgacctgatgagatggcggcaatgtgactgacgtctggaaggctgaggctgctgctgtggctgtgtaaagaagtcccgattccgaaagctccgacgggaacatttacagatgcaacaacgtgctgtctgggttggcttcaacattacaagagaggggagcacgtgggggcacgggagaaacaagacgggctgagttgctagttgcgcaagctcagtgaccgtgacaagggagagtcctgagggtttctgtcacttttctgtgtactctgtgatgcatttcaaactctgagagagagagagactgacagacagacagagggacagacagacagagggacacagagagccagataactgggtagacaccagcgctgagagcggctgggggctgtcttctctgtttggtgtgagttttctggggtcaagagaaagctacagtggctgggttggagccattttgctggtaccatatcccagaaggctgggacaaggggagccagcagcaggacacagtgacacactgcaggtggcaggagctaaggaggttggagtggaagtggctgagccagattcccaaactgggtcctgagcagggccccagggctcagcattcgctgcctggcataaagagggcaccgccagcccatcgtgttggacagggccagaataattgccacggagccttgcacgcccatgtccctcctcgtcgcctccaatgccagaggagccgagcacgtggggaagtggagggtgggcgtgtacgaggcggccgtccccacttgcctgctgagtcactgcgtagtgcactggggcagggaggagagcttggaatcaggtaggaaagagaatcgtttaaccaaatagggctgggttttattaggcaaaagggaccgcagtgttacagaatctgggcaagatgtcactgagggtctcattatctggataaaggcaatgaccagaacaaaataaaaccatttcatgctgtatcccagtgacacaggctgggcctcagtgagttgaggctcctcgataaaccattcataaatgtacggaaggaaatcatgtgaacacgtaggtaaacggaacgactgctcagacagggctcactagacgctgtcccctccctgaacactcatgtactgtactctgtggctatggtcccgcactgacaccaccactgtcaccaccactgccatccacaggtgtgtcacctacttcactggtcccttctccccaggcccctcacctcttctccagggctgaagttctcatgacacaggggacaccggtttgccagcttctccggtttggcagctgaaatgattttaaaaagactcagtcgctccctgaatgacaggcgacaagacatgctgctggcctgcccgcaggtgccctttaattcaccaagcccttgcacaggctcaagagcagtggcacttcctccaagaggacccctggtgacccgagggcacgggagcctgggaaggggcactcacggttgcaatccttgtgttttatgtgtctgggcagctcttccttgaaaacagcctcactgcaacggtaacactttccaaacccgtcttttttgtcacattccgtcagcaagtgctccgtcagactggatatctcgaccacctggatttcgaaatacagagcaaagcatgttgctgagaaagcggcagcgccctccagccagcctgcagagcctgtgagcgcctcccctgcccagggaggtctgtgccgcctgcacatgaagtaagccacaggcttctatcttcggcatttgcccacagactgtctggagtcacttgtgatactttgctgaagaccccacgtccttcctttcctgtcatcttagcatcgggcaggggccactgtcaaggatggggaagctacggtcggcctgagtgtgaagcttggatgagggcgcagagtggctcagtggttacagtgtggcccaaggttgaaattgtggctccccactatttctaagaatgcacacagaaacaggaccacagaaaagaattttaagagattctctcgctacgttggtgtctctggcaggaatgacttgtatatactctataacttcaggccgcaggacttgacacactgtgagccagttcaacctcttttcttcataaattacccagtcttagggatatatatattttttgagatggagtttcgctcctgttgcccaggctggagtgccatggtgtgatctcggctcaccgcaacctctgcctcccgggttcaagtgattctcctgcctcagcctcccgtgtagctgggattacaggcatacaccaccacgcctggctaattctgtatttttagtagagacggggtttctccgtgttggtcaggctggtcttgaactcctgacctcaggtgatccgcccgcctcagcctccccaagtgctaggattacaggcgtgagccacctgcccagccaggtatttctctatagtaatgcaagaaaggcctaatataggggatggggaagacttgttacacaggacacgaatagcatgaaccatgaaaaagactggcaaggtgggcaatgctaacattaaaaatgcgtctcttcctcaagacacttcagacagcgaagactgcatgctgtggagtgggagcagatggtcacaattcatgcgactgaccaaccactcacatccacgtgtataaagaacggccccaaatcaataaaaacagatggacaacccgagggaaaccggtgagaaaccaggtgctttgcaggacagccaaggcctgcagacaaaaggacaggcactccacctcatcttcaccagggacaggcacagggggaactcaccaagacagcaggaagcatggccgcagtgccactgtgggaagggggcagtggcacggtgggaagggggcagtggcaccgtgggaagggaggcagtggcaccgtgggaagggcggcagtggcaccgtgggaagggggcagtggcactgtgggaaggggggcagtggcactgtgggaagggggcagtggcactgtgggaagggggacagtggcactgtgggaagggggcagtggcactgtgggaagggggcagtggcactgtgggaaggggggcagtggcactgtgggaagggggcagtggcactgtgggaagggagcagtggcactgtgggaaggggggcagtggcactgtgggaagggggcagtggcactgtgggaagggggcagtggcactgtgggaagggggcagtgcctgtgctgctggcagtggtgcccaggcacaacccctttggagcactcctgggcagccccactgagcatcagcacacctggcaatcccacaacacattgtgaacccaagaaagtgcattcctgtgcatcctggaagacaccagaacgctgtggcaacattgtttatcatggtcccaaactggacgcagccctggcgcacagcggaaggtggatgaaggtgctgtggtccattcaagcagtggacactataaagcaagaaatccaacatgacgccacatggttccgtttctacaaagctcaaagagcaaggaggacccatttgtggtgtcagaaatcagacccctgctgactctggaaggagccccgaggggaggtggcggcacagcatgtttccggttcactgggctgtctgtcatatggaatgactcgcacgcatttgcgggtgtgtgcttggcttcagttacttttctcgcaacctctcctctgaaaatactaagacttgggacagctttttgactcggcctttcaacagccaggtgttcccgctcatgcaagtagctggctgctgtgccgctggcctgacctgtttgcagtggtcacatcttgtcagcatgagacagtgcttccagtagtggagatccagaccttcctctgtgaaggattcactcctttccccacaaaaaatacacaaactgaaagcaaagcaaagcaggaaataaaggtaaggatctagttccactgatggccgttccgctcccacgtcacgaggaaattctgaatttccccagtccctgtgatgtgtgcactttccctctcatctggaactgcctcagtttgctctgcagggcccgggctgggcctcccttgcaggtggcagaggaggctgggtgtgccatgtgttaaagcacgataggaaagtcctcaccaaggaggtgcctgaaatcaacgggcgaacgatccttctgaaatttcactcagcatcgtcaagcagaaaggatattttaagttacaataaacagagggaaagttgtcttgactgactcggagtggatgctggttagtgcagaaggcacatttcctaccttttatgatgactacgaagggccaactagggaggacgcattccctttccagggtttctgtgtggctggttgccctgaccatcgtacaatgggtggaagacagcgcgacttacttatctagatagtgctcatccgggattcccagagcttcagcaggggctgctttccctccttgaatgtctgaagagattaaaacaatttaaataactttttatagaaattattttcaaaattttagtaagcagtttgatgtgagctctaaaacgattatacaagtaaaaaggtagcatgttttccattcagctgggagatggctgaggtgcagcaggcgtgcagtgatacttgctgaatggacagaagccgttcccacatggagcttccatgacatgcatttacacaccccgattctttacacaccccagttctttgtgcaccccaattctttacataccctgattctttggcttcacagcatcactttctttttcctaagacacagaaacagtgaggtcaggggcaaagggctgcagtgtgagtgagtgagagcctgttgaagatatgttttcatcacgaaagcacatttctgggttttgttttagaatttctactggctggcaaggtggctcatgcccgtaatcccagcactttgggaggccaaggtgagtggtggattgcttgagctcaggagttaagaccagcctgggcaacatggcaaacaaaaccctgtctctacaaaaagtacaaaacttagctgggtgtggtggcgtgccctgtagtcccagctactcaggaggctggggagggaggatcacttgagcctgggaggtggaggctgcagtgagctgagatcatgccactgcagtttctctcaaactcaaccactgactgtggaaaacacatgcagaagtgcaattctagttccacagacacccaccctgcccctaaaaagagcacaattttgttcttattatcattatttttagacagggtctcactctgttgcctaggttggaagtggtacaaacacaactcactgcagctttggcctcctgggtgcaagccatcctcctgccccagcctcctgagtagctgggattacaggtgctcaccaccatgtctggctaagttttttttttaagttttagtagagatgaggtctcactatgttgcccaggctggtcttgaacttctgaaatcaagtgatcctcctgcctcggcctcccaaagtgctgcaattacaggcatgagtcactgcgtctggccgagagtatgattttagaaccagaaaaggacttaatatgtaaattctgaaagttctggagatggatggtggcgatggttgcacaacaatgtgagagcactccatgccaccacagtgtgcactgaaaatggtaagatttacactctgtgcattttaccccaacaaaaaaagagaaaaatccatcccatcccgtcattctcctgggagaggccttcaccaggccctgtgtggggcgcaggtctgcgctggcctcgaggcccccacaacccatggcccccagcaccccgcagcacagacccactgcctgggtctttctccctcgtctgctcctccctggagccccagctccatgagggtgggactttgctttgctgcctgctgtatttccacagccagatggcgcctggcacggagaggcgctccataaacaccgagccaatgagcaagagctgcaggctctcaggacagctgtgtggaggctgtgcagcccatcagcataggcgaccccgggacagacagtgctgtgtgcccatgagcataggagaccccaggatggacagtgctgggaatagctcctgggcggctgctgcttctggagccactgccaccaggtcctgggctgtggtgagggaggcgggaggcaggcgcctggcaatgggcttagtacatgctagctcatggctggagggaaatcccttcagtttgcgacatccgtgtcctcgtttgtgtactaatcacaatgagtgtgtgctgagccactgagggtcactgagcacacgagtcatccacaccacgatgcggacctgagccagaggctcactcctcatcccagggtctgcctgcctccttccgcctcctgtgtccttttctgattgtgactctgacgttccagcatttggtggaaatgtcacggtgactttttgccataggaagttcagcctatattcagccacatttgatcttttttccccattcgtacccatttcttcttttaaaaatctgtggtaagaacacttgacatgagctctgccctctgaatagctctgcgtgcactgtgcagccacgtgggctgcaggcctgaggtgccagcaggtcccagaactcattcacctggcacggctgaaaactcaggtctgcggaacggaaactccctgtgttctgccacctttatatcttttttttaaggaaattttctttcaactgaaggaaacttcatcataaaattagtgttatgaagctaattcatatcccagaagctgggaggctgaagaggaacacatttatattcaaccaaatagtatttgttcccagtacatatgacacccccacaggcttagagtaagggctcatagaaacagaatgtttacctgaaaccttccctttttaatgcgctgaagtcagacctttatagtcaagctgatttttctcctttgcctctgaaggtggctggagagctgtggaggagagcagctctgggcccacagcccctggtccctccctaaacctcagcagcagctcacatcaattctgacagaggatggaggggcaggaagagtatctgccacccaattccacctctccatggagggcttctgtcatccaccccaaaactaacctaaaaaaccaaaaggaatcaagacgctcatttgcataatcccatgaaaaataagtcaagtatgatgtggatctatacagcaaaatacatttcagctaaaagcacacaggtgaaagacgtgttaacttccaacctgaacttcagcctgaatttctttcagtgctgccagctgcccttgtaaagcttttatttcttctttcttttgtttttctgcttcttctgtagccgcttttctccgtgcctggtaagaaaattatttttccattagaacagcttgttagggtaatcttagaaactgggagacaaattatggcatatcaactatatttcttataaattataatattcactaagactaataacaagttagaataagtcttttccattgatttcattggtgtctattgatagataaacccactgtgtcctcacggctatcgttattccgtttgcagcctgggaacctaagggtctcactggcagaaagtggagcagccgggatctgaatgcgggaacctgtgttctttcttagccaggacgccggggcttcccatacatgtggctccttcaaatgacatatttacttatttacgtaccgagtaactgagtaacttcttcaacacaggatgacatcacaacttcaccaaagttaactcaccctcatctcagcatctgtagctctgccatctattttagcaaatccctcaaaaattgttttgtagagaatgttcctgcgtgtgttgctgtcgtctggaggaaggtactccaggatggaagcctggtgctgtctgtacatgtccaaaataattcgaaccgccgtctcgcggacctcatacactctatgctccagggcactcactgaaaactaaagttgggaggggctcttgttactcattcttaaaataaaactaatttcttccagcttacaaaaaaggtacattataaacatgtgaaaaataaaagagaaaacatccgtattaagtattatgaaatacttcaaacataaaacctcacggatctaccgtctcatcgtaagccgtgttatactttcatcacgcttgttttggatcttttttaagaaacagaacgctgtggctatagtgcaatttcatccctgctgtgcgtctcgggggcccacagtttctcatcctccttggaggtgtgcgctcctgcgtagccgatgtgcagatttcaggtttttggatttgggatccaaaccagtaagtataatggaagtattccagaatccgaaaacaatctgaaatcctaaacacttctggtcttaagcattccagataaggggcttcaacctgtacctgatattctccatcacactgctgttattgtctcttaaagacaggccgggcgcagtggctcacgcctgtaatcccagcactttgggaggctgaggcgggcggatcacgaggtcaggagatcgagaccatcctggctaacacagtgaaaccccgtctctactaaaatacacgaaaaaattagccgggcatggtggtgggcatcctgtagtaccagctacttgggaggctgaggcaggagaatggcatgaacccaggaggcagggcttgcagtgagccgagatggcaccactgcacctccagcctgggcgacagaacgagactccatctcaaaaaaaaaaaaaaaaaaagacaaagaaatattttttatgatttgtttctctccacagataaagatctgcacacaccatgcaccaccgagtaggattagacagcaggacgcatgtgggggcccccatttgttggatgaaacactggctatttttctgaaatcactgcctcagtcattccttcaacaaatgccgatgagaccctcgccacgctccaggcactgtggtgagtgctgggccgcgtggtgtgtcacacgcgaggtctgcttaccttcatcacgttgtcaatggtgaagcccgagctgccagtgcccaggtctttcagcagccgggccaggaggcccatctgactcattgccaggtgaactgaagagtttgctttcaatggctgcaccaggtaggatggaataatttggagagacttaacttctttaaacaaggccatttcctatgaaagccaaggtaatttgttaatttttactggaaaatgctggaggcagtttagtacaattcagcatgatcttaaactaaacactgaagggaaaaacagggaaatacagattgatagtgacaaggagcaatgagagcactgatccgtaagcttgtatttctatttaaagcgtaacaaccattagaaatgaaaatctgagccacaggaaataaaatcatgaagaataaaacgattttatgtctactgaaagcttttcagaagcgtaattgaaaacttgaaggtttctgttctcagtattctcagcttcaaggaaaaggttttctcatttctaaaattctaaaagaaattagagctgctgctagaatcaccgttattttagtatttattaaatgtcagccaagagtgtatgattctgcagtgatacggtcaccagtgggttaagatggaaaaaatgtaagtaccattacatatttgaatgtctctaaacaaacaagtctttacgtaattaagatatttatcacttaattaaccggatatagagaaaaaaataagatgttgaatcattaagttacaatcagaaataaacctgtttccaataggtctgcaggtcttatcacctaaaataatctcttatcgtgctggcctgactcactctggatttgggcctgtgagtgactctgtacaaatctaaaagctaagagaagaagagcattctccagggaagtttggacagtaaactccttaactacaaacagatgctgttgagtgtgtatttcgtccactaaccggcacactggtgcacaattgtaaccctcgatagattgccttaaggttgtctcacatagagagaacatttgagcaccaccaaactgctcagaaattaatgtggcttaaaaataattaaatgaagcaataacatgtgctcatttgcaacatatcttttgaaagatgaaccctcctcacccccaaattctagctgtcataaccaggagtgtattgtagcacattaggtcgtaaccaggagtgtattgtaaccaggagtgtattgtaaccaggagtgtattgtaaccaggagtgtattgtaggtcgtaaccaggagtgtagtgtaggtcgtaaccaggagtgtagtgtagcacattaggtcgtaaccaggagtgtagcgtaggtcgtgaccaggagtgtagcgtaggtcctgaccaggagtgtagcgtaggtcgtgaccaggagtgtagcgtaggtcgtgaccaggagtgtagcgtaggtcgtgaccaggagtgtagtgtaggtcgtgaccaggagtgtagtgtaggtcataaccaggagtgtagtgtagcacattagcatgacagcatttcttcttacctttttattagcattccttttccttatttactctgaaaatttaggtttattaaatgaaactagatctgtggttcctcatattttggagaaatgacccctttggattcttctttttgagacactgtctttctctgtcacccaggctagagtacagtggcgagatcacggctcactgcagcctcaaccacctgggctcaagcctctcgcctcggccttccaagtagctgggactacaggggtgtatcagcatgcccggctaatttttgtattttttgcagagatagagtctcactatgttggccaggctggtctcaaactcctgggcccaaatgatctgcctgccttggtctcccaaagtgctgggattatgggcgtgagccaccccgcctggcctggattcttttttttttttttttaagatggagtctcactctgttgccaggctggagtgcagtggcgtgatctcggctcactgaaaactctgcctcccgggttcgattctcctgcctcagcctcccaagtagctgggacgacaggcacgcaccaccacacccggctaatttttggatttttagtacagaaggggtttcaccaggttggctaggatagtctcgatctcctaaccttgtgatccacctgcctgagcctcccaaagtgctgggattacaggtgtgagccaccgtgcccagtctggcctggattcttttttaagaaggatctgcacatcacaaaattttgtgtaaaacttaacgtaattcataagcttcttaagcccaaaggaggactcttaagaactcctagactagatgaattcattagctagtttaaagattttcaaattatggtgcataactgtgtgccccaaaactcatacatttatctctatctcaatatttcccataatatctagcctagaggaggcatatttggtgaaagaatgaaaatatttctattaagacagttatattttttatttctttaccctcagattttctcttttgatatcattttctgtgtgtttttatttatttaaaaaattaatggcatatgttggataaaaaaaacattggaaaaacccaactgtagattttaactgaagtttatgtctaagacaaaactgaccttttagagcataaggaaagtgtgatggtgaatccctgagaataatgttaactgagtagagacagaatcttgtaaaaggtgttaagaaagccagagagctacaggaatatgtttatcatctacggtttcaaatgccgtggtgaagttcagacctgaataaaatttgcagctgtgacgcggaggcgggcagaagaatctccagttctggtgagcaaaacgggaatggtcctctccacacagtgagctgtttcaagtttactcagtttatgtttaggaatatattgtgtaatgatcattttcaacaatttcaaagaagcctgaaaaacctaagagaaaagtgatgaacacggatgagttactacggtgcaattccaccaagaggaaacatggcatttactatcagtaacacatacgaacattatatcgaaaatgacatctcgtctgaaaggctgaaaattgcaaactgaaaactgctttctaaacacagcaccttgcatatagaggacatatgctcttacttcactctgtcagaaatcactccccatcttcccttcataccgagtatctaacatccctgcttcaatgggtaagcccaaatcttcccttcataccgagtatctaacatccctgcttcaatgggtaagcccaaatcttcccttcataccgagtatctaacaaccctgcttcaatgggtaagcccaaatcttcccttcataccgagtatctaacatccctgcttcaatgggtaagcccaaatcttcccttcatactgagtatctaacagccctgcttcagtgggctgttagaagcccaactgtgcaatgtccattcttaaggcccattcagcattagaaaaaacagtaattctcaacctcatcaggtttcatgcaaagtgaaaacacaaactgaagatgtggtagcattgaactaggcctctacaaacgcctggctttgcagaccatggaaaagctaacactgctggagaccagagacaatgacccaagcaaaggcagatttcccagacccttcatgtaagatcagttgcacagtatagctcttgctagagaacctcatttcttagtgattctattgagttacagttggtgaccacgtcaatgaccaactggtcctctctcaagctgctctggtcttctgtggtacggcgcatgatctcatccatgcacgctggagccagcgccagctgagggcactcacggaggtcacaatgtcctttatggctcttctaacgagaaagacggatgctctcagtgtgttctttaaatcttcttttggggttccaacaggcatttccattaacttcttagacaaggcaagcagtgcatcctctcggtaggaccacgtcttacaataggcctcagcaacctaccacaaaacaggcagcatttcatggcatcacacaaccatcctccaacactacacaacttgaaggctttgttttttttttaactaaaatgattcatttctaagaacagaacttttataaatgaaaatgattcatttctaataatagaacttttacaaataaatatgtatatttagagaaataattttctctgataaggaaatttaagactatgttaaaatataaaaagtattaaattctccaagagaaatattttaaagctgagaacgagggaaaaccctactcatttctttttattttgagacaaactctcactctgtcgcccaggctggagtgcagtggctcggctcactgcaacctctgtccccctgcgggttcaagcaattctcctgcctcagtcttccagctagctgggattacaggtgcctgacaccatgcccagctaatttttgtatttttagtagagatggggtttcaccatcttggccaggctggtcttgaactcctgacctcgtgatccacccgccttggcctcccaaagtgctgggattataggcgtgagccactgcgcctggccaactctactcatttctataaggagatacttccatcttttgctatgccatccttttgcgctggaattagctggtattcagaagggagcagttgtttaatacaagctccatgaatgccagaaggaaacacccaggctgaaatgagtactcactgatacatcttagctcatgtttttgctgtttcacataatttataatttacagaagggcaggcacggtggctaatgtttgtaattccagcactttgggaggccaaggccaggagttcaaggctatagtgagttatgatcacgccactgtactccaccctgggtgacagagtgacactctgtttcataaaaaaaaaaaaaaggccgggcgcagtggctcatgcctgtaatcccagcactttgggaggccaaggtgagtggatcacaagatcaggagatcgagaccatcctggctaacgtggtgaaactctatctctactaaaaaaaaattacaaaaaattagccaggcgtggtggcgggcacctgtagtctcagctactcaggaggctgaggtaggagaacagggtgaagccaggaggcggagcttgcagtgagcggagatcttgccactgcactccagcctgggtgaagagcaagactccgtctcaaaaaaaaaaaaaaaaaaagttaacaaaagactttccaattcaggaagaacaaagggaagtcaacaatattacaaatgcaaagccgtgggcgttttccctcctttatgtgtaagtacacagaggtgtgcgtaccatatagactagcctcccctctgccaccccgttttttttttttttttttttttttaccaaggtttctcccaacacatcgatggcagagctggcttctctcaaggccttctcggttaagggctctggctcccctaacatgcctcccctccgagcatcgctgatgtctgcattactcatttccggctccaccactgcctccccataatgcttacgaatagctggaagaggccgctcatcgtagggcagggactctgcctgcagtgagtgaaggagagaggaaagtgctggggagctccataggtcacattctccagtgcaactctcactggcaggcttactgcgcttacttacctgatctgaaagatgttattttgctaaatatcagtatcatcagattagaataatttatacaacaaataggatgtaattgaaaagattagatgaggctttctattactttctaaactcattacagacctaataaaaaaaagcaaggtagattccacctcaatgactgtttactggtagcaatttcagttcaactgacatggagactactaaagtaaaggctattacatctttttttctgacaagatctctgatattttcttagtttattgcttagaaataagcatcaagcctgattttaataaacatgctcacaaggtgtcattaggcctattccttatgtggctatgctctcactcagcactatggctcctagaatggaacagaggtgggtctggctggggagcactcatgcaccccatgcatgggaacagcacctggcacaacacatgtcctttacaaatacccaaataaattgaacgccaatctgaaacagaattacctacattgatctttggatgaggatctgtggcagggagtaacgggtctactgcagaatgctgaggagaaatagttagagaatatgatgaaggcttttcctgaaggaaaggttctgcaaactggttttctgttcctctttcttccagttgtggtagtgagggcattggcttttggtggcaaggactgccagaacgagcgaggggctggaggggcaaatcaaaaggtcttcgcatctagagaacaaaaaggaacatttaatttcaaatgccactgccacgccagatatatctatctcattccttcagatgaataagactttagaaagctgtgctggaagaggctccttggcacaatgaaaaatttcaaaaccaaagagaaacttccacagagtgaaatctacttgaaagtcccacacaatcaagttgcactcatctcagttgtctctccacatttctgtgttgactacaaaagtgacatacacatccaaaatgctagtgaaggaatgagcatttgtgcatggagcatgtccacacatatgtgcccctgcaggagcacggtggtgtggagaaagcacctgggctggacccaagtggacttttattcaaaatctggcactgctattcactgtgtgtacaaaggaaagtgatgttgtgtcatcccaacaagcaaagctgactgaccagttgctgcacactaggcatggtactgagtgttttggacaggtaggctcattaatgcttactctgtttacccccatttgaaagctgatggaaaactgaggcataaagctgataagaattagtctgtgatcacagagctggaatggtggtgcccggatttgaacccagacagtccagctccagagtgtgctctcttgtttttcagaggcagggtctcgctccatcaccaaggctggagtgcagtggtgcgatcgtagctcactgcagcctcgaacttctgggcccaagtgatcctcctgtctcactctcctgagtagctaggactacaggtgtgtgccaccaggcctggctattacttactttttgtagagacagggtctctctatgttgcccaggctggtctcgaactcctgggctcaaacaatcctccagccttggcctcccaaagtgatgggattacaggcgtgagccaccatgcctggccttgagagtgtgcactctcaatcactattccgtatctcagaaccttcatttcctaatctgtaacgtgggctgagtgccccatttgcatgagttctaaaatcagaggcagagcaccttatgggaaatatgttctcaatacaccgaagctgttagcattacgttctcacttgatccttacaacactgaggggtcagtggggcagggtcatcactgccttttccaaataaggaagcagctggagagatgaagggatgcagcagaaaagcagcagggcctcggttttcctgaccccggtttgttccctttcccacgactgtgagtctcctgaaagaacatgctgaggcaaagcctccctgacgtaggcacagagctgaggccatccataactgtcccctgagcactgcagagtgttttacactacacttcaaagacatctatccactgttgtgaaccacacagttgaatctctgttctcctaggctttcctccactccgtctgggctcctgcacccaccagctcggcatccaggaggctgtgcagctccagctgctcgtacacctcggcacgatactgctccatctgctgcttcttctccttggcgagatcgtagtcttccttctccacggcacagcgtttctctacctcatacctcccaaggcgttcaccaacctgaagcacaaaatatttgctttttctttcaaatttggatcaactcacatcaaatgcaaagctaatttttaagaatcacgcgtgaaccgtcttgcaaggagagggagtgagcacagggaaatggaaggaatgggccacactcagcaaaggtctggctgctgttgctgtatgggcatttaataagctcatggtttggttatgactttcaggatagctggttttcctattttcccattgggctcagggtcctagtaacgaggtagctgaccctgacacctgaacgtgagtctgaagaggtaaagcttctgcttccatttacatttttaaagtgcttatctgtctccgtaactttattttgctgagatctttgaactcacactaacttcacggcttttagtaactggtttcttttaccatgtagttattctaagtatacataaaacctattacaggcataaattaggaactgttttctccaaaggcaataccttttgcaaatcagcaatggcttgttttagtttcttggcataatcatagcgttccttttggacagcttcccgttttctttcatctaattttcgtatgatctgtgcaacttctggatcttggtacatatcaaaagctaagtcatctagcggagagatatagtcagatttcctaaagggaagaaatgcatattttagagataatttcacgccctaggagttcagtgctgaagatgcacggttgagaagatgcccctccccatcctgccccatcatggttcacagagcatttcctgcatgagaaaacgggtctcagagaagtaatgggcctcaggtcacaaagctcttaattgcaagcaggcctttctgactccaaagctcacgctcttgaccatggaccaaactgcacttcagggcatctgagcctccagtgcattcgctcagagtgcagactctgggcctcgcctcgttatgggccctgggaataggacagtgaatgtgaatcaactgcagaacaaggagaaaaacaaaaacaaagacaaatggatgaccaggccccaccctaagaaatgtgaccagtgggcccaagatggagtccaggcgccgtattttataacaacacagtatttttttcttcttttcttttttcggaggcggagtctcactctgttgcctaggctggagtgcaatggcgcaatctcggctcactgcaacctccacctcccgggttcaggcgattctcctgcctcagcctcctgagtagctaggattataggtgtgtggcaccacacctggctagtttttgtattttttagtatagacgggttttcatcatgttggccaggctggtctcaaactcctgacctcaagtgatccaccagtctcagcctcccaaagtgttgggattataggcctgagccactgcgcccagcctgtatttttttatttttttctttgagacagagttctgttgaccaggctggagtgcagtggcatgatcttgggctcactgcaacctctgcctcctgggttcaagcaattctcatgcctcagcctcccaaacagctgggagtacaggcgtgagccagcatgcctggctaattttttgtatttttagtagagatggagtttcaccatgttagccaggttggtctggaactcctgacgtcagatgacccacccatctcggactcccaaagtgctgagattacaggtgtgagccactgcacccagccagcatcacagtatttttgatgaacatgataggttaagaattgctaccactgaggttttactcaaagggttaagttgtatggtgtcaaccatcatatcctagaggagatcaaaaacattccttcagaaataagtgatcttttgtagtcacctgaatagctcatttctgattaaatatgacctctattcctcctttccagctctacagtagggtctagaatgtaaacagtaaagttagtctcaccaagcaacgagaggatgaggatggaagtgtcccagctgctgtatcaaccccattaaacaagccagctgcttacggcgacttgaacacccttcgagacaggtacgttttaatgaaaacacttgtcgtaaaagtgtacttggtgaatctgtattataatgaattcaagtggggcataggaataggccccctttaagcactcacagcccccctctggcatctccccacccttgaggtcacggtacttcgctcacagcagcaccacaggctggcggctgggacggcaccagcagctctgaactgtgtctaatcccaggggtgactaaacagcgaaacattttggggtgtctacaagatcacattaactatttttagtgtaacacatatgacactttaagtcacgttgccttgctgtcccagagatgaacacaaagacttcatttgattataaaaatccttcaaagtgaacatcatgtcctgtggtacccagtcccagctcctgttgattcagcagcagcgtggggtgccatctacccactttggtacagaacccccagcggcaatgaccggattccatgtccagcacaggcccgcacgtgccagtcacacagcttttcccagtccttgcacttaaccttcataaaaccccgggcgtggggcaggacaggcaaaccacagcctgccatcccacctggctgattggattaaggcaacagatttaaagtctaaatcaaaataacagaaagaagctttattggagatactgagaaactaaagacttaatcagtttggttgttcctgccctactgcacttgcttcagtaagggcagagccccagctgcggtctttgtggagaggctggcaggagggaggtagccatccactctcagcgctccttccccacagtgcttccatccaattgccagcttgaaggatgggaagagtactgtgatttttctattacacaaaggaggcatctgagggagagactgagaagctggtgttatttttttatttttattttttgagacggagtctcgctcttgtcgcccaggctggagtgcagtggtgcgattttggctcgctgcaagctccgcctcacgccattctcccacctcagccttctgagtagctgggactacaggtgcccgccaccacgcccggctaattttttgtattttttagtagagacggggtttcaccgtgttagccaggatggtctcgatctcctgacctcgtgatccgcccgcctcggcctcctaaagtgctgggattacaggcgtgagccaccgcgcccggccttggtgttatttttttatagacattacatgaatagcctctactctctgagcactccacactcacaagtgcctgtgacagctctggtctgcaccaggcctgtggggaggcggtgtagcctctgcaggagggaaggctcgctgtccaccagtgcacatgctcagcaaatcgcatgtggctcctgagcaactgcagagagaatctgatccaggttgtgtgcaaatagaagagcctggatcaagaattaatcactttctgcgagcagtctgtatgcaggtaaaagtgaaattacaccaaacacggacaaatttgaaatttctattaaagtttaaaaagttgatcttttctttattgggaagctgctgtcagagaagagccaaggattatttggaattcctctttatttaaaattttttttgtgcgtgtgtgagatggagtcttgctctgtcccccagactgtagtgcagtggcatgaccttggctcactgcaacctccacctcccaggttcaagggattctcctgcctcagcctcccaagtagctgggactacaggtgtgcgccaccacgcctggctaatttttgtgtttttattagagaaggagttttaccatgctggccaggctggtcttgaattcctgacctcaagtgatctgcccaactcagcctcccaaagtgctgggattacaggcgtgcgacataacgctcagcctaaaaaacatttcaattcctctttttttctcactgcggcaactatggcagcccttcccttctttcctttagaccaggcacctctggaatggagtcccctcattgtcatccacagcaggcaggtggcaagggaaccactgtcccaaagaggtgcccaggacagagagggtgaccgaggatggcacagcggggccctttagctccccaaaagtggattcacccccggttcttacactgctaaaaaaaaaaaaaaagaggaagcggcaacagcagcagaaaaatatgtataattttttttttttttttttgagacagggtctcactctgtcacccaggctggaatacagtggcatgatctcggctcaagcgatcttcctgcctcaatttcctgagtagttgagactacaagcgtgcaccaccatgcccagctaatttttgtatttttagtagagatggggttttgacatgttccccaggccggtttcaaactcctgatctcaagcaatcctcctgccttggcctcccaaagtggtgagattacaggcgttagccaccacacccagcctacaattgttaacacgacgaactttccccatacccatttttttttttagccaaatttagcagtgagaaaaaatatttttaacgggtagagagagattggtaaaaattgtggtgtgtgtttttttttttgagatggagtcttgctctatcgcccaggttggagtgcagtggcacaatctcggctcaccacaaccttcacctcccggattcaagtcattctcctgcctcagcctcccaagtagctgggattacaggtgcgcgccaccacgcctggctaatttttgtattttgagtagagacaggatttcaccatgttggccaggctggtcttgaactcctgacctcgtgatccacccacctttggcctcccaaagtgctgggattacaggcgtgagccactgcacccggcaaaattgtgtttttaaaaacgtatgtgatacatatttttcactcctctaaagaataaacttttgaagaggccataaggtgatgtctctagaactgataacctgggtccattaatatctttgatttttaccatgaatttgcttgtgctgataaaatatcaaaggacggctgacagatctttgttctaaacgcattttaggaaacttctagtgatacctgaacacaagaaaggaagtagtctctgctgagcaataaatgaaggtgtgtggctgggcacggtggctcacatctgtaatcccatcactttgggaggctgaggcaggtggatcacctgaggtcaggctcaggagaattgcttgaacgcaggaagcagagtttgcagtgagccgagatcgtgccactgcactccagcctggcgacagagcaagactccatcgagaccagcctggccaacctgatgaaaccccatctctgctaaaaatacaaaaaattagctgggcatgatggcaggcacctgtaatcccagctactcaggagactgaggcaggagaatcccttgaactcaggaggtagaagttatagtgagccgagattgtgccattacactccggcctgggcagcaagagtgaaattctgtctcaaaaaaaaaggaaaaaaataaatgcaggtgtgctaaataaaacagcgaccttaatctttatgtaaatttcagacaatccaatcagtggcttatccagctctaaactgaatttagaggctctaagtccagaatcctttggaaatgactgaccctttcaggattctgaggaaagtaaaagaagttcattgatggggagcaggactcttacctggcgtacgttccttctagagcagggtcctcgctgttgtgcccaaggtagtggtcaatcaacttctctcgagaggcctttgggggcaaaacatctgcttagtgtctcagagagaaagaggaacaacacaaaaccttaactacaagatttatttcatataaagctgtcagcaaggttcaatgatcctcatcttttggagagacagctaaaactgttaaagaaaagtttcatatgctacagctcctaaaaatcatctgaaagttattcactagtcaattttatgcagattataaaaatgacacattttttgggtgaaaataaatgactccctcccattataaatagatttacttccttaggaattaaaactttccaaacttacagtattgctttcatcactgaaatctgcagggtctccaatgatatttatggcaaccaaagcaacctaagaaagtgttaaaataacagaattaaatatacaatgtttgaaatgacttaacccttttatttacttattttgagacagggtctcgtctgtcacccaggctggagtgcagtggtgtgatcatggctcactgcagccttgacctcccgggctcaagggatccttcaccttagctgccctggtagctgggactacaggtgtgagccaccatgccctgctaatttttgtgtttttttgcagagataggatttcaccatgttgcccaggctggacttaacccctttataacaaactctgacctacactgttatcaaatgggatgatgtatatcaaagcgtattaattgttaaaatgttatgccaatataaataatttttaataattaacaaagaattttaaataaattatgttagtattctaatgctaaccaaatggttatttttaaccatttaaagcctgggcgcggtgcctcatgcctgtaatcccatcactatgggaggccaaggtggaaggatcacctgaagtcgggagtttgagaccagcctgaccaacatggagaaactccgtctctactaaaaatacaaaattagccaggcacatgcctgtaatcccagctactcaggaggctgaggcaggagaattgtttgaacctgtgagacagaggttgcagtgagccgagattgcaccactgcactccagcctaggcaacaagagtcaagagtgaaactccgtctcaaaaaaaaaaaaaaaaaaaaaagttcaaatcataatagctaaaaactcccaaagttttaacatagcctcaaaatgagacatccacgtgagattcagtatggagctcatctttgaaggatcttgggaaattagacaatgaaaagttaacacagctcagttcccagttggtgagtctcacctgaggtggggagtcacttttccatcctgcacccccaaccactgtagactaaccccacaccgcttccaaaaatgcaaaggttcaagacaggcacatttggggcaggagggcagctggcacaaactgggaaaccgagcaagttttgaaatgaaattttttagtctttcatgtcagtgaagtgctgctttagatagttactgcttttaaatgcagggcacatatattatcattcatgacgagattatctgaacataaggacaataaataatctattatttaaaaatctttattaaaaaaacaaaactccaaactgtttaaagaaaaccaagacaacagccaggtcattgctggtaaatacatgcaggtgggtggaggaaggaacagggttaagactcattcttctggcttcctggcgtgttatgctgcaaggggccaggcagcttaattggacctttgcgctcttgtccagctcacccgcttggtctagagatttgatttgctgggtgctcacattcctcttggagggggcagggagagttgtaaatgcttgtgctaattaacaagattgctttggacacaattgatttctactacactaatcatgtgagaaaaagaaaaaaagaaggaaagaaagggagggaggaaggaagagatgaagaattagcagcctgaagctggagagattctggattacatgcaacattcatgtgtccacaatttccaccagggaatttaccttgtgcacgttgggagggtttatttacaactgtgctgtcctacacaaataggatgtgagccacatatgtcattaaggttaagtaggcacattaaaaaatttaaaaatgcaattaattttaaaaatataggttaacacaacatatccaaaatattatcatttcatcacatacaattgacataaaagttctcatgaactctttcgcgttctccttttgtactgagtctctgaagcccactgtctggtgatgctggcagcagctctgggcactaggccagttcgtggtgggcactggccacgtgtgcccagaggctgctggatcagacagcacagctcagagagctcagcagtctcccagaagagatcctctcttataagatcaccttgaaaatgcatctaagaaaagatacgtgaccacataatcccacaaagaaggtaggggcagaatcaaaggcgaagctgcatgcatcttacctgattatatatgttgtatttgttgacatggttttggtgaaaaatcagtttaagaaattgtcctactgcatccacataaactgattttagttcccgggctttgcaacctgtcttttcattatcacagagagacacgtagctgaaaaacaaaacacaactgaagaatttgaaaatgtgctgttcaataaaactgctccctactctgattgaactcaataggctcatttatgtttattgttttattttttaaagctagactacccctatgcaggatcaacaggtttgaataaaagctaagtctagaatgaaaaacctaggaaaaacccctagaactcaaattctaattagtattcttcttttgttgttgttgttgttgttgagatggagtcttgttctgctacccaggctggagtgcagtggcgcgatcttggctcattccaacctccacctcccgggttcaagcaattcttctgcctcagcttcccaagtagctgggattatagacgctcaccaccatgcccggctaatttttgtattttcagtagagacacggtttcaccatgttggccagattggtcatctaattagcattcttaagaaaatttccacatctgaaaagtagagttgaatagcagaattcatagaaattatagcgctgctttttaagcacattcaataagaggcaggtgttaagaaactgtgtactcttgaaccaaatagaagtacataacacaggaccaaaagttaagggacaattcatttttaagagctttcagggccgagcgcggtgactcacgcctgtaatcccagcactttgggaggtcgaggcgggcggatcacgaggtcaggagatcgagaccatcctggctaacatggtgaaaccctgtctcaactaaaaatacaaaaaattagccgggcgtgatggcgggcacctgtagtcccagctactcgggaggctgaggcaggagaatggcgtgaacccgggaggcagaggctgcagtgagctgagattgcaccactgcactccagcctgggtgacacagcgagactccatctcaaaaaaaaaaaaaaaagagctttcaggtagaattagcctaaaagctgccatgatacattttaaatttcattcttacccaagtcttcgaaaccgctctgcttgatagggtgcaaaatattcaggcaagctttcactaatgtagaactcaattttacttgaaatcatatactggtgagcaagtaactgcagtttccttattcgacatctctccaccatttgaaggacaatttcttgtggaaactggcaaaatctgaaagcaaacacatttttatattttctgaacaacttctgcagagggtttctagatgctagcatctcattcttgcaggtaagaagcattaaccacacacccactttgaacagaacagtctgtaggtactgatggtacaaagatgcctgcgacatgattcctgttctctcgagcttttcttgttggagctgaagctgggaattgaaatttgacttgatctgcctgtaaccctataggaatcatactcttggcagctagtaaatggtctgatgtgaaacctgcagtttttcataagataaatcaatcttatgaggcggcactagtgggcaggacggagccaaaggattttccacaggaactcaaatgcttaagggccccaaggtatcaatatttaaggagtgcctgcctttcacgcatagtggtctagggagacaagcctatgctatgggccatgctggagcttctttgctcaaaagtgacataactttttttttttttttttttgggaaaaggtctcgctctgtcacccaggctgcagcggtgtgattatggctcactgcatctttgatctcctgggctcaagtgaccctcctacctcagcctcctgaggagttgggaccacaggtgtgtgccactgtgcctggctaaaattttgcccaggctggtcttgaactcctgggctcaggggatcctcccccttcggcctcccaaagggctgtgattacaggtgtgagccactgggcccagcccaaaagtaacacaacgtattaaataactaagagttgggtagagaatcacagcagtcagcaaagaccccacactgcttccaaaaatgcaaaagttcaagacaggcacatttggggcaggagggcagctggcacaaattgggaaaccaagcaacttttgaaatgaaattctttagtctttcatgtcagtaaagggctgctttagatagttactgcttttaaatacagggcacatatattatcattcatggcgagattatctgaacataaggacaataagtaatccattagttaaaaatctttattaaaaaaaaaaaactccaaaactgtttaaagaaaaccaagacaaccggcaaagctttgaagttgtatacagtcatgcactgcatgagacagcggtcccataagatgacaacactgtattttgacttagcttttctatgtttagatatacagatacctacttgtgttacacttgctaccgtgttcagcactgtcacgtgctgtacaggtttgcagcccaggagcaataggctatgccacagagcctaggtgtgtagcagtaggctgtaccatctgggtttgagggcactctaggtgttcgatgaaatcgactgatgatgcatttctcagaaagaatgtccccatgattgagtgatgtaggactgtactttaaaaaatccttccaaaaagggcctatgatttagctactcaaatgtagctgatgaacactttatagatgaatcaaaaatacctttcaagctgcatatgaaaagaaaccacacagctaaaaaggctagtatgcatttatcccttcaagataaattgacagatacagattttttaaactaaaaataatttgacaaccaaaaaaatggatgcccaggggctacggttggtgcaaactttacggtttcttggaaaaacgtcttgctctgaaggcttcaggctctctgaattctgaggtcacatgaacggcactgggggtctccctatatctctttaaccgccccgtcagtgtctctcctggaagtgcatcaatctatgccctgagctccgacgtagagggtcccacattttctatgacctgtggtaacagggtgccttgtactgtcattgggaggctcggcttcagggtatcctcctttgtctttctgcgatgtgcctgacctcagggaagtcaagagaccccgagccaaacccagtgggagtctgtggtgaccaagggcacacagatccttttcttgggtacatcctctgaaagcacgttactgaagtgagtgtaggttatgccctttaaagcaataccatgtcaatgcacaagagaaccatactggtgtgatttttataactactaccaaaaagggtggctgtgtgtatacttgagaatcttcaatccccaaataacacggaacatgtgctgtgagcgtacaggacctctgcagagggatgctcctgcctgggagaggcatgagcagggtcatggggagtctgggaggagagggcagagcgctgggctgcccccgtgggtgtgctcctcctcctgccctccagccacaggctggaccgtgttaatgctgcctgcatgggcagtgcatcggccacggcctgggcagtatcaggacgctggctcgcctgcaatcccagctctgcgggtgacaaaggcgctgtctggccccttctgcttgactcttgcttcatttctcagttcattcagaactcacttccgggaaatgcagggacagggggtcttatttgttgcatctcctcaaaaactccaaaaggaaaatacattttaattgtaaatgagatttacattcaattttcagcaacttgacttctgaataaaagcaagacagaattatatcactgaatttaaaatgccatacatatttacgcgttcgcgggttaggaataaatagtaacttctcaggcttgaaagcaagtcatgaaaagcacagagctgacgaggtgggatggggtggagggtgggtttttattcacatgactgagggcggagggcagatgccaagtgagtgcatgaaggggctcagctgtaaagaccaaagcagcagaggcaaaaagacttcaatgttttaggaaaataatcaagcaaaacactcatctaatgaacatttgttttgagacagcatcttacttggtcactcaggctggagtgcatggctatcacagctcatggcagccttggacttctgggctcaagggatcctcctgtctcagcatcctgagtagctgggactgcaggcgggagccactgtgcccaattgaacattttaataaagtatacgcgtgtttaagagaaatgtgaaagacatatcttttggttaaagcttggtgtcatataaaaacagttagacacacactctttcagcacaggagcccaactgtaaaagcaaaaaaagctgcactcacaatctctgcacagaaacttgatgagaatgtgcagcccagcgtgtgatcagggagtatggttagacagttacggggcctcatttctcttccttctcctccacatttgcacatcttcttaagggagtgtgggtgaatgttataagggaaagagggtcaacatattttctttaaaaatataaacagaaagagatgcctgacactgcatgctgacatccttggtcctgatgtccgagtgatagtaaaatctgaggctctgaatgaaaggagcccctgtaccctcctcagggacccgaggctgcctcccagcccaagccccgccccgtccagtcctcacctaggtgaccgccacccactgacagttggcgcgtggatcatgagctcccgggcactgaagccgtcttcgtgtccagatgagctgacgactacaaatccaatcttgtggggcattctgcacgtttgggctgtttataagagcaggaaaaacttctttaaaacaaaggaattcactaacacatggacatttaaagggttggttcatgccttgctaacacacacaataatgcactaagtattcagaattttcccatctctttgaaaagagtctatttttttttgttaaacacttttatagatgcttctggttctgcttaagatatcatttaagttatcttgacttttcccaaatatgtgtccaaaaagtttgaccagtgctgtggattgtgctccccaaaaggatacgctgaagttccacgtgtggtacccgtgaaggagacctcatttgaaaatagggtctctgtgggtgtgatctagttaaaatgaggtcctcggggtgggcccaatgcaacgtgacttctaagaagggaagagacacagccacacaaagggagagcgccatgtggtgacagaggcagagaccggagcaacgcatctctaagcgggccggccaaggacggctgaggatggccagcaggcgcccaaggttaggaagaagccaggagggatcctgccctacagcctccagagcgagagtgcagccctgtccatgcagccatctgacttctgcctgcagaatgaatttctggtgttttaagccatctagtttatgatattttgctatgtctagaatataaacacaaacttctttctattagttaggaaactaatacaaccagtatgttaattagttatacaataccaaggggaaaaaggcaacgtaagcgctagcattaacaactgctaaatgaatgtgtatgaccagaaggaagagcaggaatgacaggcaggcatattaagtacaaaaaggttcatgcagagttaggttgagggactgactcacaggacattgagcccaatttgctcagggactctgggttacttttcagttactaagccagtcagattcctcctaagtaagccaatttgggttaggtctaaatcatcgggggaaaaaaaaaaaggctcctcactaaaccaggataaagaagactccatcagaaagttctctgggataagatatactattaattgaaattcccaataggaggtaacatataaacatacccccacataaaactgtacgtattttgacatgcttgatgcatgatctagatctttcttttactttcattgagaattcgaagaggaccacttcaatatattaattattggctggcattattgctaatgtttcttggaatgtatgaacaaaagcactaaaatagaatgataaaccatcgagattctagttattttttgcacaaagttcactgcaagatgttactgtatattaaacaaaaacaaaactaaaccaactcagaaaataatttttaaaaagccccccagaacaggatgaggctgggtgtggtggttcctgcctataatctcagcactttgggagaccgaggtggaaggatcacttgagcccaggagttcgagaccagcctgggtaagagagtgagaccccgtttctaaaaaaccaaacaaaaaaagaattttgaaaggatgagtgtgatttaacccactgttagctgcacggccccacctgcactctgggcaacctatgccagaaacgcacagcccatggctcccactccttcgtgacctggcacttctgggtcgcatgggctctgagcctagaggtacttttcccttggccacagcatctctcttcacccactccccatccaacagtgtgccaggtcttatcaggcctgcccttccttctgatcccactgtcttttctagacagcaaccacctggtgtccccacctgaagcgcctccctcagacaagtcctaagttcctattgtgtgaacgtgcctcaggcccagctccagtcatctccatccatgtcctaactccagagctcttggtgggctccccatctagggatcaatgcgccaactctcccctgaccctcacttcttgtcctgaattctgaagtccagccaaacaatcaaagctcaaagttaatacccttcagctctgaagccctccaatcctttcatcagctttttttccttttttgagacaagagtctcaatctatcacccaggctggagtgcagtggcgtgatctgggctcattgtaacctctgtctccctggttcatgtgattcttgtggttcagcctctcaagtagctgggattacaggcatgcaccaccatgcctggctaatttttttttttttttttttttggtattttagtagagacggggttttgccatgttggccaggctggtctcgaactcctggccaatctgcccgccttggcctcccaaagtgctgggattacaggcataagccaccatgccaggcccctttcatcatctttcagggcagggcttgtcactccctattccaccttgaaaatacctcttgtgcccaggctgttgggttccagtctccaaatttttttttttttttttttgagagagggtctcactctgtcacccaggctggagtgcagtggcgtgatcgcggctcactgcgacctctgcctcctgggttcaagtgattctcccgcctcagcctcccaagtagctagtattacaggtgcgcaccaccacacccagctaatttttgtatttttagtagagatggggtttcaccatgttggccaggctggtctcgaactcctgaccttaggtgatccacccgcctcagcctcccaaagtgttgggattacaggcgtggccaataagcccagccccgattttttttttttttttttttttaatacaggttctcgctctgttgcccaggctgtactgctgcagtggcgtgatcatagctcactgtaaccatgaactctcgggctcaaatgatcctcttgtctcagcctcctgagcagctaggactacaggcacatgccaccatgcacagctactttttttttttttttttgtagggatggggtttcactgtgttgtctaggctggtcttgaactcctcccaccttagtgtcccaaagtgttgggattacaggcgtgagccgccgagcctggctagtctctgaacctaaccaacactctctgttacggctcgaagacataaatataggaccttttcagtcaaacagaagggtgtttccagtatgctatactgcccccaacaaatctaaaacaaagtactggcatttaagaaccagctaagagaaatgcacagggactgtggaggcaatgctattacctcagtctggtatttgaaaaggattccttttttagtctaccccctcccaaagaccttccagttgtaccctagggtcccctctgtgtaaaccttcaagtgttacataagatacttggaatgtcactgaaggatgccacttttaggctctataaaaatcaccattaacaatttgggaagaagcaaagctctgttgaacatccagttattggctggtcttcctcaccagaggcatgagggatccctgttgtcccaggggcagccatcgacatcccgacaaatgccagagtacatctctccccaggcagcgatgactccatggcggtctcatccctcactacacttttcctagtgctggcatggtaaaaggcaattaactataaattaaacggaaactcagtgtagcaacttccattttgttacaagactaggaaacaaaacttgtctctgattttctttttaagaagacttttaagtgtgactgcgcgcggtggctcatgcctgtaatcccagcacttcgggaggccgaggagggcgtattacttgaggtcaggagttcgagaccagcctggccaacatggtgaaaccccgtctctactaaaaataaaaaaattagtcgggctactcgggaggctgaggcaggagaatcgcttgaacccgggaggcggaggctgcagtgagctgagatcgtgccattgcactccagcctgggcgacagagcgagaccgtctcaaaggcttatgggtttctgatcaagtcatcttagcgactgaaagggcttcagagaaatctgaacttaagtgcaaacaaaacaaaacaaactccaaaacaaaaaacaaccaaccatcagactttaatctctatagggacagagcaattttcctcaaacttttgctcagcagaacacatctgaaactggccccctatgtgctacgcatccagaagaggaaaagccggatctgaaaacaatattccacgctaaatgggccgtcccggccggggcaggcggtcccagcacccgtgctgagctccccggcatacggcacgacggggccgcgccggctcttcggcgacagcaaggccggcatctaactccacaccgtccgcgcttgcaccgcgcacccaggcttcgtacccagctcccaggtggggaccgcgcccccgcggcgcccgcgccccgcgccccgcgccccgctccccactccggccctgggccggcgccgcagcggcccggaaggtacctgcttagagggaagggccccgactggcgctgccgcggccccggtggagagggcggctgggtcggagcggtgccgcggcccggggaggcggccaggcggcgcctcagcacccggaccccaggggcgtgcgggacccggctctcgtggacttcctcggcagccgccgcttcctcagacggaactcggggggcgccccttccgccgccccaggccgccttgcaccccaagctgctgcggcagtgacagggaagaagcagacccggccacctctgcccatagccccggccgcagcctccactctcatgacaaccaagcccagccctgggccagggcctctgcgcgtgc

SEQ ID NO: 1224 - DNA, 47812 bp, Homo sapiens
tttaaaacaaacacacattttattttaagcaaagtcaaaatgttaaatgccattgcatacaaattagggaatggaatggaggactggagggattattagaaactgactttttatgaccttgatatttccccacaaacaccaaagggaaatcaaccaggaactttatgtccttccgcctctgtgtgcttaaatgtgtcacgtgttagagctgtctctgtcatctgtatacagctgcctctgtacgcagattccacgatgaccatcagtgatggagactggattattgaggtgcaagctaattaacttttgattcatttttactatcatttatctaaaagagtcacagcaccgaggatttggctcccatggaaagattatgaaccacttcactcagctaccttacttctggagatatttgactagctttaggtcataaatagaaaaacttagtgtttccatttggcaattcatgtcccttaagagcacaggtttttgacttcgttgactgctgtgttcacagtgcctagaaaaacacagcccatgcctgttgctcctaacgtatctgctcagtgaatgactaaatgcttcagaccagtattacgaattgcctccattttgagcatgaacatcagatccagattatccaaatcacaaattttgttattgtctgtttgtgtgttaagatgaaaaatagactttcccacaatgatgagtgaattgttcatagaaatagtttgattacgaggaagagttctgtacttgaaacttcatggcagtggcgaagatgtctctctctctgatgagatccctgagaaataccatgaattggtatccaccttcttacatatattggaatctgttcatacattcagagtaggcactttcccaaaacattttaagcttttatgtgtttctgtttgttttttgagacagagtctcactctgtcacccaggctggagtgcagtggtgcaatctcagctcactgcaacttctacctcccgggttcaagtgatcctcctgcctcagcctcccaagtaggtgggattacagacgtgtgccaccatgctcaacgaatttttgtatttttagtagagatggggtttcaccatgttgcccaggctgtctcgaactcctgacctcaggtgatctgctcgcctcggcctcccacagtgctgggattacaggcgtgcgccactgcacccagccatattttaagcttttaaatgttgtgcttcattatttgatccatgggttgtccagagaatagagcagagtttggttcaattattttggggtaggaagtagaaggcacaggagttatttatggtagtggcttttattttgtattattaagtaaaacttataatttgtagttagaataataactactaccagcactgttataaaaacaactaccaattattgagagttatgtaccaggtactatggcttcacaaagctttatgggatgggtagtattctttcggttctacaaaagagggaactataactcaaagacttccacaagaatgtagagctagtaaaatgttaaagagttgggattttaacccagatatgctagatatacggtttacataattctggttaacaaatcctaagtcctgcttttcatttttgtgaatgagtcatcaaacataagaagttatgcaaaccttaatgaactacgttaaccttctcataggcttccagaaaacaaaataacggaagcgcacaggttaccttaaaggtgcactgtttacatcccagactaaatcagtgctcatacagctgctgagaaaaccacatgagagctagaaacagaagggagggatctataatgctgcactgtacttaagtttaatatcaaattaagttttttgtttgtgcctttttcaaccaatgatatactggaagacatgcagtttcctagggaaaaaataattcaagaacttccaaagttatgcttagataatgtgtaaagaaggctaacaaagaagagatataactagaagagattttaagcatcactcagctaatcttcctactttgtgcactatttgtaccaagagataaggagggaaataatatggtaactatcttgtactgaatggcattatataagcaatggacacattcaggagaggattacaacagaaacctatgcagttcctgcgtggtacctcacttagtgtcactttattttgtgctgtcaactatattctgtagttaagttcggctctctttctttatatatgtatgagtcagccactttccccatgaagattaaatgagataatgcatgtgaagtgttatctaaaccataatgtgccatgcaagtattagatattgtcagggcccaggaatttataagaattctccagttattctataaacaggttacaagccagtgatataaggctgcttgaactactgtgcagggcatttgttacatcatcaaagaaaaatatgggcagaggaaggatgaggaaataatcggtgaaaatttttctagttcttagaagatttcacttctatttctctgaactaatgtgtaataaatctttttctggcttctggctttccaggacctggaagtcaagcttccaacagactggagttgaaactggtagcagggaagaaggaaaaactggtctctcctctaaaggatgttgtcattgggaggatcttggcataagaagcagttttttgaccttgaggctacctgaagggtttccttaatctaactgtgcccaattactagcagttttcacagcagtatgtttcagcagcttatcaaagaatagaagcagacagtaaaaagagaggggacaggatgggtttcagtggttctgaataagtcaggcttctggtgaccagcaaaggaagagcctggtttccataaatcagagaggtagttagcaagggtgagttgggacttaagggaactttgccttgaaagcccaaagacttgtacttgtgccttaattatacagcttaggtcctcagagaaggttgtgacttagagtaggtgaggctgttctgtcagctgaccagaggagaaagcgctgatcttacaggcataagaaactgaccttgggtgaagatgaaagtatatactccttttgggtttcccattgctcagcagagtaatggttgtgctggtatttcgctgtctgaagatgtaaagaagtgtcttctattctggtggaatattagcaatccctgaacctctcctaatcgagatgtcatgtgtaccctcacatcagactaattgaactcaacaggttggtgggtgaaacttgggcattttatttttaagctttccaagtgattccaattgcagtcaggcttaagaacgatttacttaaaagttttaagatggaaatttgcaaagggctgctattcaaatcactgttcctacagctacttaggtgtttatgatctaagacgacacctggatatgtgtcaaaggccaattattaagagggtctggcagtgaaaactgatatcatccaggtgggccttctctaagataataacttgctgtgaagcttcatgttcgtttccacattaggaatgcagaggcagcttattaggaggaagctggcgtggtctgattctagagcacatgctgtgggctctatttctttacagtacacagaggagcctcaggacaaggccttccccactcctccaaatgcccacatatcagactagggggatactcccttttgaaattagccagcttgcctctgtcactgactgttgcaaatgactactgaatttataaaacattcattgatgttccttgttgggtttgagattataaatctttttctgccgggctgtcactgggagtagactggaaagctggagacaaaattcccatagctctggtagacacaatgactggcataaccactagagactggatagttccaaaaatactcaagaacttaagaatgttaatataagataatgaatactgaagaacttgagaatgttaatataaggtaatgaaggcaagggatatgtggaaggaagcctattgaagattccaacaatcttgattatagttttgttgcttttttttttcatctttctttacccgttgtgctagcatctctgcccagttcaaaaggttatgagagagaccagctagagcagaactggccggaacctggagttttgaccaatcaccaggggctgatctgtaaaaagtttgggcttctaaggaagtccaagagtagctgactggtggataactaagcaacaatgtgaaatagggctccacggctgtctagcaacagacatgggtagagatccaagatggagggcatctggtaaacacagtagatcacatgaatctccagtcttgagccccagaaatgggagagctggcaggactctaagagaacctgttgtagggtgcccagaataggggtactatacaggaaaacaaggcaatgagttgtacttgggcacatgggcaggatgaaacacattaaactggactaggagttaaagccttgtcctgtgaaatcaaccttgagcccagcctcgagaaatgagagaagagtttgtccaggggccaaggggacttcacgcttggctgatgaactcctggtctacagctccctgaattccccttacccaaggtcaagatgagttccagtcatgtcagggctggacctgtaggttggggttaagtggttccagcttctatatagaggcaggaagccaaaaggatcattaccataagtattttttttttaaattcacaattctactttcctccctcaactacaattttgttatatggacatgttctaagagtatgtgcagaggataacgattaaataaacttttccaagtaaaacacagttaaaggctacttcactgtggccaaatgactttctgtaaggccaaaattacttactgtagagagcaaccaaatgcatttgatgctctttaatgctctagaatatctaatattatgtagagcacataatatactttaagtgagtgcatatcaatacatacaagaatatcatagctatgagagaggcatataattaatatatttgaaatatcactactatccccattctagctcaaagtgtgaactgattttaaattttttttaagcttctgcaaaactttattcttgttttctctctttaaaattgtaaatcttaaatatttaaaagatatcttgctgtcatgtaatatccgatattcacacacacacacgcacataggtacacaaatacacaaatggagacttccaatgagaaaacaaccttgtaaaaggagttttacaagggagtgctgtgttaactgacatattgctgagttagcaactaaataaccagctacatacatcccttttgtatcattgagtagcatgcattcttaaagtgataatggaactaaatttggagagaacaggcccttaagtttcaatttatttgtttcacaatcgcagcctcaaactgaagggaaaattacgctgcagtttgataaataaagcactatacattcaaaaacaaaatgcaaaatggaaacttttagaacttcaaataatcaaggatcttagattaatttcatcagtggttgagagttttttgttgttgtgaatttgctggagaatttagtatgaaagcactctaactagtgtctgattatatcagtgtctctatttccttttagaacacacatctgttgttgtggggggtttttggagaggagagtgtggttgtggttattatggaaatacggcaaaaccaaatattttaaagcagatgagaagaaacccacaaacagttggctcacaaatgttgtaatgctttccacacccaggcataaagcaagtggcagcggcagcagcagcagcgttcctggtggcctctgttttatctgtttcaaacactgggctgctcttgttagttaactgactggagattgttttctccctttatcccctctctctctttttaattgttgttactctgttttgcctgaaagctgcagtatctcactgttcattattccctgttcagtcaaatcctgtccaaaattaactcattgtgtgctggagttcttctcaagctctcttttcttacaagatgcacaaaatagacctcactgtagctctttcaagaagtttgcatatcatacggataactctttgaactaactcaatgctgactttactgggctgtgtttctttaatatttacaacttctaactagaaatatttccaattattaataagaaattgttataaaattctaaagtttcaaccattttaatcctttctctctctctctctccctccctgtctcttatataaacctagttccacagaccctgttttgactttagtttctcttttttattttacttggaaatttttaaaagagtcttctgagtctccaaactaaagctataagacagaaaaaaaaaaaaagccatcagtcaatacagctggggaactagtttctcatatcagcatcgaattccaaggtattcaacttgaactaagtgcagccatcagaaaaaccatagaaatgggaaagttgctgttgtaaattaatgattatttgctgtgtgcgttagagttgcggtttgtaccacattttattgtgatgttttattcttactcagtgcaacagtaattgggtcttaaacatgataaagtatcttcaaggctgcattggtagctgagctgcctacggcaggtttttaactctagttaaagaaggttaatcaaagctaatgaatctgttttatccattgccatgagttttttttttttttttaaatgtgccaggaggtgactgacctaaaatccggattgttcagctgtgaaggcaaatacatctttagcataatgattttgcaagcctctttgatggccctgggtccatggatggcaggtacctgcaagctctgtagttttcttacctttctaccactgctcactcttctgccattaaaaaatacgagccttatgaaaatacaggagagggaatgcaatcccacactacagccttcagtgtgagaatatcaagagactgttgcattcagaagttcagaatagctctgctctttataaaagaatatgaggagccccctaataaggccaattcattagaacaagtgtttgttactaaaacacaccacgcaggaccacagggatccgagccagacagcacggcaattaaagttgcctcccttccaaacgcaggcggcccaccaactctcacccacgagttctgctttgttttcctattagaaatgtgattgaagaatgcaagttcataatttgttcatgcagcagaagactagtaactctctggttgcaacatccttttatacacttcaaatcagaattaaaaaaaaattcaggttgcttgtgtgtgtcctttctgaaagcgcaggaggagcaaaaccttttgctctgggaatctaccttgctgcctagaaaacattgcctagttgcatttgcaaaaacgctcagcgagagaccatcctccaaatatctaaaatcacagtagtggagggtttttaattttaagcccagcgtttacagaaaacacacacacacacacacacacacacacacacacacacacactctcagcctgcagtgacaccttttccctcccctttggtgctctgcggagctttggaatgagattcatagcgactcaggactgttgctggcaaggaaaaccccctgcctaccagacagaaagaggggcggggagggccattgtggctttccctcctgctctctttttaagcccaaataatatttgtactttgaggggagggtgcaaaaaagggatcaagatatgaagcaaggcagaacccaaaaagcgagggggagaaaaaagctcaaggagagagaccagctctggtccgagaaagggcctacatcacaggtttcaaaagcatcttttttcagtttcacgagccacaacccccttgatgaaaactagttgcgaaattcagcgcctgttaggcctcagctaattagaaaaaatgggctttttttcttttcctttctttctttagcaccttttctttcaagcatttagtctcaggagggggatccaggctcttggccgggctgttttgaaaacacgcctttgaatgcgtctccctaattcacgccttttgtttttcagcttttgtgtttgccagtttgaccatataacgttatacatctggtgtatagcttgttgggggcttttttctcccagggttcctatgcattccctataggaccctcctgagcttcaatttgagcgatcgtgtaacataaagggggtaaaggagagcctaggaggctggggagtggggggaacgagggagcaggagaggggaggaggcctgggggagacagagagagaaatgagtgaaacataaaaaaaaaaaaagttgaaaagaattcttttgctctcttcttttcttctcactgttgcgactggaccctgagtcagccggcgacaaggcctcggtgggaaaatgaaggggccacagaatagataactcattggaattctggcaacatattcgtaaataaaacaaaagtggggcggcggactgggggagggagtgtgttcctggggaagcgcagagctgcacagggcagggctaggaggacatttccagggcaggctccctgccttgcctcttgcaggggaaatctaagatggtcaaaggaaaggaatccaacggttttgcccaggcttgtttagcaaagctcttgcagctggagctgtttattattgcagctaggaagatgctcttccaaacacacttcccaagctgagagagctgaaataatctatcctatttcttcagagcctgcagggtctgtgcctcagaaaggggtttctgttaaaagaggaacattcttgagcatggttattcttccccagctcctcaagaagaggcatcccccagatttagtttgcagatatctttcccaactcttacctcccatgcgcactttcgataaaacagcttggataccgcttcttggaatgatgatactgatgtaagtttcttgacttaaaagctcccagtcttctagtggatttggttgctattggtgctcattgatgggtaatcttgtggatgagctctcatctcaatttctccatctgcaaaatggacatatcttaatatcaaagtcacaattcttagttttcacatacccggatggttacttttgtaatgagtcaatttcatatttttgtttaatatatacatagtgtgtgtgtgtatctgtgagtacataaaacccattataaagatatagtgtatattttggtggttgtgattttgtatgtcatccaactgctctagaataactctgcaagtctgattttggctgaaagaaaacctagaataaataggaagacaatatgtttgtggcggttgtttaaagctaataccagcagctttttcttttctttactgctgaacaatttcaaaagcaatactaggcatgaaagcaaaacaaactcatttcagtgcaaagcttatgagttatttgtgtttccctgaattcaaggagggggtggatgggtaggaaatttgttttaaatatagaaatggggaaaatacaacaaactccacagaatatcttggaaggttctgcagcttgaagtgcagagtttattacagatgtgatgtaacttgtgggtataattttcaaaaatagctgaagaatacactgtgagaaatcttaccaaaagtaccattttccccaatatatttgtaactcaagttaccagctgattaaccccttgaaaagagtttctgtaggtggaaatctatatccctgtctgttcttaatcaatccagccacatgaccaataatgtggatgcaagggttaacacaattaaattaacaaatgtttggaaggaaatggtaaaattggtttttaaaaagatgtttaacaaagacattttgctgttccaatcagacacataattacacaataggctattttcaggaatctattttttcctaaatgttaatcagaccagaagaaaacgcctgttagtccacattgggatatgctgtaattcccttggaaaagtaacttaccttagggaaatattttacttcccagaaaaagactgtttatttactctgaattctttcccttgcaaggttgttgtctggtttttgtttttgtttaaactggtctcagaacatggagaagtacgaccatcgtcaactgaaacaaaaacaaaacaaaacaaaaaaaccatggacttgagctaaaattcttaaatgaattgtttagcttcaaaatgtaaaactgtcccagcaagaatgtcacaaagtgtaagcacagaaggatctgtattttactgaaaacattctttatataacacccggagaacacgaaaagaatgagccacccttacttatattacaatgtctgtatttattatcttttcaagtgtgcttaacaagttgataccattttctaaaaggttttttagtttgagactcctaactcatacacctgctctcttaggtcacaactgtaagtccagaaaaaggtgtgctttatgtttctgtgaaaactggctttatttctagttataagggaggctgaacttttaggtaaacttggtgccaggtagcagcagcaggagcaacgtgaaaaagaaaaatggcagttacccacttaagaaaataacattctgttgatcgacaaacaccctttaaattttagctattaacagctcttacagaaacaggaactgccaataacaaacttgatttctaatgtccccaaggtaataataatccactaatttgactatatcccagctggcctatacagcagtttctatttgttttttgttgttgttgttggtttttttttttttttttttttgcagcagggaagacttatctttctttgggaaaaaaaaaaggtggggagtgtgctgtaaagttaagaaggagtgtggagagaaaacacatggaaatttaatgtgaaagtttcttgttgcaataaagctgttaggtttggcatgtagactgttatcagatggttcctttgacattacttgagcctttcagtaagtaagacaagcctgaaggattaggttgtcaacttcagcctgtcatctttgagcagaaaaaaagaattccttttctttttcttcctttcttttttttttttttttttttaggttgcatcttccttcaccagctttgagctttggagatcgcagcagaggtagttactggaagacaatctcaggcccacattgatcatggaagtctagcttttaaagataagtgagccaaccaagctgtaaggctaatcaccctgtgcaagtatgaatttatctaaagaggatttcatgtggaacccccggagccggccgccaaacggatgactgcacactttaagaaagttcgtgggacttctcccaatcaactgtcaggccacataaagggtctggaacgcgctgacttaagcaaataatatttagccatctaaggataccgtaaggcccaagattttgctttgttggcgctgacaggaaatattgatacatatcaagtaacactcctgatgcaaaaagcgatatgtgtctcctttcggcactatctctgtttaggaaacaccttgctttaaaagaaagcacaggtgggggcagggacaatgtcaaacccagcacttcactgggttttccagctttcctgggatcacaatttcatgaaaataggaactaagcaaaagtcgtctcctttttgaaaaaaaccaaatgtattggaatttgaatttgcaaactctcagaatgtctagctgacaagtgaaccctgcccataaccccaaaactattccttaagtttattaacctaggaaacctgccactgattaggtttgggtgtgtttctcagcttttacaatagtctaaactatattacaactatgtggttacagggcctaaaaagtaaattgaaatatgtggctattaagtcgcaaatcccctcaataggacatgtgagtcaaaactcaattttttgtgagaagtaatgtctgtaatcctattgactcatcatttttagacatttgtggctttaattacaggggaaaaactgtaatgtcctgtcttgggaaaatttgatagggaacatcgggctgttaccatagaataaaggttgcgttggaggatttaatttaaaaaggaaaaagaaagaaccctattttatcagaatactctaaacattctccatcagtaacgttgtgcctgaggtgatatccttgaagatgctggaggtggcggtgttaatgaaatacccgttggcattaaatagcatttctagaatcctgattgtagcgctaaaaaggaaagtgaattttctaacagcacaataaacaaggggaattacgaaaaaagaatccgctggttctgtaaggaagatcgcttccagttaaacaaagaaatttagggtcgtctgcttttcatgaaaatcacatacatatggcctttgaaatttgtcactgaagatggttttgctctaaggtaaaattcaccactttatagcttttcagccgcaagtctctggattttttttcttctctcttttggcctgcagcccaatatgaatgtatgatcactagcacaagagttaaacatctgagtctttttgaagtgtcttcaatgttacaatgatgtgatggttgattgcctagcagtcagtttagaaaagtctgcattctgccccctagtggtagagattaaagtttaatggctgcttcataacacgtaatgcctttttccctccttttccatatgttaaggatatagagcagtgtgggaattactgatgagttttgtcataatctgtaaagtgtatattttaagcaggaaaatttctagactgaatggacaggtttacgaggcacagggtcatttgatgtatgttttgtgtactctgctgtgctttgccaaacaatatacatcaccactataaacagacattgtccctaatacaacattccttctgggaaaattttgggacttcttaatagaagctattaaccaaaaagtgcatggtgttgccaaaattataatattatacacacacacacacacacacacacacacacacacatatattcagagaaagcatggtatactgtcagatactgtggaacttcacatttcttttcagatgaccattttttgtacaggaggtaataaaaacaatttgcactagttataccacttactactccacaggtcacattccctttgtgttcaagttcataaagaaaaccacgcacacccaaagtaagggtttgtgatgtccgaaagattttgatgtgggaaacgttgatcacgcacagcttttttttcagctgacaatgaagtggaagacatttgtttgagtttttatcgtatcctgagttcttgcttgtttgttattcatctttaatgtagaactcatatcttgcatgcaggcaagtgttggaaggcacacaaaatcaagcacccatgatataggcatcatccaatgagtgtgtgtttagatcttgcagaagtgaaaccccatgttggaggaagacgggacagaccgaggaggagaaggaggaggaggaggcatccgtggagagtggacaggcgggacagctggaccatgtgtaatgtgtcagtttgcttctgtgccactattgtgttgctgatgttggaatgcagggaaggcgctagtttattgaataaggagccatgtaaattccagctgtcaacatgtgatcactccctcggacaaagagagaggctttctcctcactcatatttgatttctagtcacagctacacattttccagagccctcattgccaccaggctacatctgagtagcctttggccagccttctcttttcagactggttttgcagggtgagtacctggcttgtaatggtgtgttggctggcattcaaatgacacagtcagagttagttcaaaaagaatgctatggctgtagtgataacaaataatcaatagtatttttaaagcagaattcttgctattgtttgatctatttcagtataaaaggcaaatgctttactcaagaagaatagtccaaaacaacaattcatacactaggtagcttttcttattgtgagacatgtcaactgggttgtaaccatgtcagtctatgcctttctttaaaaactgctccagggaaccacaggtccacagagggacagagaggcgctcacttcttatcttgctgtcttgctgtctagctctgtaccctcgccatgtggcttgagagaggctgctgacattactgagattttgagtggggttctgggaagctctctacagactggaaggggaggaggaagaggagagtgaggagcgggaggacaggagaaaagcattctctgagtaagatcaactccaaagcagcttgagtctcatgggagtttaattagaggaaaaaaaaattcatccttgttcacacaggcaaacattattcatatctaggagatcttggatgccagtattttttttataatgggaaacatagaacattttgtggtgtgtggcaaaatcgcagtgtttctttctccttgctgcagaatttcattatcttgaaagaactcaaaatgctacaacattggaacggtaaggctccttacccaggcacacattgcttcctgctgccgtgatatggcactccctataactctgcctataatttgcagtaagaggactttgatgcttctttaaatatacatatattacatacatatggattacatatgtatttcactttaagttactcaacataaaacctccataaatttccataggggtattttctagaaatacatggttaaacattggatgaaatggagaaatttctggtgtcagggttgcctagaaaaactcttttgacctaaaaaaaatgcttttttaacccccattaattttctaataaaaaattagctccaatttcaaaatgatttggtgacatttagctatactgattttaaaagatgtaagggtagcttcatattgaaatcattcatcggtggtcaaatcattgccatgaccatcatcttcatccactattgaatggtttgctgttgactaacagatactgtgctcaacacagggaagggcacacagatgtaaaagaggatgttttcctcgccttgcctgggattagagtgaggtgagtgaagcctatgaacaattttttttttttttttgagatagagtcttgctgtgttgcccaggctggagtgcagtggcgccatctgagctcactgcaacctccgcctcctgggttcaagtgattctcgtgcctccgcctccagagtagctgggattacaggcacgtgccaccatgttcaggtaatttttgcatttttagtagagacagggtttcaccatgatggccaggctggtctcaaactcctgacctcagatgatcttcccactttggcctcccacagtgctgggattgcaggcgtgagcaactatgcccggcctgaactttgatattttttttgtcatggattgtttgcactcattttgatttttcagtatatttcattctaatattctttctcttgattactaagatttttggtgcttccttaaattctgtacccagagaagtgcctcatggtccatccctgctggcttgcctcacgtggaaagatggaggctcgcttgtttgtttctgtctgttcagctttttaagatttcacagaaatcaattttagccaaaacatccttcgtgaattcactaaaaacacatttatagacggtgactttccacatcctctctcaaaggtgctttttgggggctcccaacactcaaataaaaactcttgctatgtgcactgatatttttctgtctaggaactagtttttttcaaatttaggatggaataaacagtgattttcctgcacactgtttgtcttacgtcattcctctgatgccttccaagagccctggtcaaacctcttcccaagagaggggtttctaatcagccccaggctcctttgccagctcttccaggtaacaatccatttcccttcatccttcacctgattaactgcccccatctgctgtggattcctgttcttagtcatgcgtctctccccaatgctgccctctgggcagtggatttcagatttccttgtaccgggcaacatatgttcttcaactctggagcctcatgtcagacacggccactgccaagacgcttgacatggcctgctccaaacttcttctttgctaattcagcctagagagacagcgtgccagcatggagaataacaccgttaacatgtgtttacgggcattaaagcgcagctctacactgttataaacccctggcatatttgacctggaaggaaaaaaaaaaaaaaagatctccgtagtgcagtacttggctttttcagcagattgtgagttcacttagacgactggaaaagacaaagggatgagagaaagggagagcaagagcaaggggagagagaaataggagagagggggcaagagagaatatacatctctatttgtaccatttagcaacagagaaagaaatgcagaaaccacctctcaagtcaggagaatgctccaaccagccagggtgttataaattagagcctgtcagtattacaatgtatattaatagtcacacctctttttaatgagtttggcattggcagctgagaggaaatacaagtcatcatggctctgctcatgcaaaccccgacaaaggaatccgtaataaatcttcctagaacagcactcaccataaatatgtatcacataaggcatctgttttacattctgcatataaatcagcatagcgctgaatagcaatgaatcagcttctcaatgcctgatttgataacaaatcgacttggatcttaggagagagaatttacagccctcaccctcaagacagatagtcaatacttaagatgagtgccaagttaacttttcttcagcaaccaagtttacagaatgagagtcctgaggctggggtgggagcccagcgggtggggctggacagttcctgggggagggaaagcagtcactcttcccagggagaggagctttgaggtttgcagctctggatttgaaggatgtcgtgtggcatatctctgcattctgcatctgacctcctctccgctttgtcccctttcttggatctcccacaggtacagtttccgcaggctgtaatgatgatggagtcatcttggtggtgtcatttggggcggggatggggagaacccaaggtgcccccccaggccgggtagggctttctctctgcagcctcttcacctgtcccaacttggctggggtgactcccacgactaagggaggaagcaaagctctgacccctttctttacagaccgttgataataacttcctgtaaagaccttttattccaggctacaaaatgagtgaacagtatttatggcatttttccagtatcagagtgttgatgggatcaggtcacagagggaaacttgaatggctctttattgtcagagcactgcctgatacagacatggccagccacacagagatatgaaatgcttaaagactgcacaggcagaacagcccctctaaagtctctgccaagataaaggcagctgttccggctcacttaggttggcggagcagagagcaggtaccagttgggcaactgggtgtaacctggggagagcagatgtttttttgcaaaattctgaaggcaacactttatttgctcctggttttttgtttttgtttttttttcacttcagctatgggtcatcattcctttttctttgcaaacatccatctcatttgtagtaggaagcagccacttaccatattgtgagctatgagtcttcttaaacactgtctatctcctaaggccaagcagttgtgatctctttttataggctcagctgctgtggcctttccaaataaatgcctgtttggtgacccatgtctcaaccccaaagtgagaaatgtatttcaaaattgcttcaaatactgcctatattcaatgcttttggatctaactagattaattataaaaagccctcttccgttgggtttggatagataactagaaaaatggagtctgagctttcccaaaatcctctccgatttaaactaatcacaaatctactacagccactatatttttatccctcactttagaagatatgcaggtatgattgttcattgaagaggctgttgtgtttacaggcctcttaaaattctggttttattgttcaaaatctccaacgtacccgaaaaacaattataataaaaattgcccgaagtataatctatttcaagtatcaactcacttaactatttttcttgtcatggaacaatttggatatatgcaaatactagaactaggggtgtttttttcccctctaaaagacattttgcagtgtctggaaacgtataaagttatttttacatctcacaatttggtggtggtgttggggggtgccactggcacctgagaaacaccagatgctcttaaataccctacaatgcacagatggtacctccattcccatccccagctctgccctcatgcaacgaagaatgatctggcccaaaatgtcaatagtgccaaggttgagaaactctgtgctggaagagattgccccaaactggattctaaaagaacttgagttggcgtcccagatctgtggattctgtgaccttgagtaagttacttatctctctgatctcttctgaagtgaaaagtgatcaaactgtctgggtgtgagaagaatataaaaggatatatgtaaaatatctggccagaaataagttcaatcattacttttctcccttcttttccctaacaaagtgtagtaaaaggctctgcctcaaagtgagttctgagagaaaggagttttgaagtactcatatttttcactgatttggtaatatctcaagattttattacttgcctgtttaaaaaaaaaaaaaaaaaaaaaatatatatatatatatatatatatatatatatatatatatatatgcgccaggtagagtttggtgaactgaactgaagttgtctttttggtttgagagactgcagaaaggattttagtcttcatttaaaattttctatagtggttccaatggcattgttaattttgggtgagaaaagcagaaaaactctaggtttggcaagcagacagacctggatgcaaattgtgtgtctctccttcttgactttgtgaccttgggcacaaggtattctttccaagattcagatttcctcattggtaaaatgggcatcatgacttctatatttcagattttttgttgaacaataaataatataaataaagcagtatctaacacaaagccaaatggtgttgaggatctgcctaaatcacagtagttgacagtaacagttcgccttgcttttgttcttgcctcattaaagagatgagaggtaggccaaaggcaaggaaccaagggctgcctacatgcagggagcaagccccatggaacggaccggggaagacagctcacctttcagggaacaacctgttcatggaaatcaaccctacacatttgtgcaagatcttccaactagaaaagtctcctaacattcagcctgtggtttttcaaagagaggaagtggtcaggtaccacatattaacagaagggctctgtgacagactgtattttccaaagatggctgcaacaaactcctatcccagaccacccactgagaaactccgtaaattaattcaaggtattttattttaatataatttttgatatgctcatttgtttccatttataaatgttatgcacactcattatagaaaatttggaaaatgccataaaaaagagttaagataaaaaaaatcaagttagcagtgatattaagatacctttttgatgaatttctgctttcaaatgtgtttagctacatagtttggatacaaaattataagtgaccacaatgctaaggctgtgtcatcacatgcaaaacgaagtgcaaattaaaatagttattgcaaaaatttaggcccagaactttcttacctacagagtccctgtaattaaggaaaggtgtttaggataattgcctccatttaccactttagttgtttgagggaatgaggtatcaggaactggctggcataaatttttcttttctgattatataaaatgcttagtccgactatttttctcaaagtggtttttttgctcaatgaaaagccgtttttaaaaaaattaaatatactttgattcagttgtcaaaagaatcttcatgttttcaataaccaaattaccaatcaattctatcaatttagtttaaaataataataataaaccaacccagtcattaatgaattcaaaacagatatttcaaggtataaaatgttccttgaaatttttctttttctttctttcttttttttttttttttttttttttgagatgaagtctcactctgctgcccaggctgaagtgcagtggcgctatctggctcactgcaacctccgcctcctgggttcaaatgattctcctgcttcaacctccagaatagctgagattacaggtgcatgccaccatgcctagctaatttttgtatttttagtagagatggggttttgccatgttggccaggctggtctcaaactcctgacctcaagtgatccactgcctcggcctcccaaagtgctgggattacaggtgtgagccactgcgcctggccagaatttttctaataagtgaaattaaatatactgttcatattatgctgttattccaaattgaatttacaggtggcaaatagaggtgagccagtcttggttatgcactatatttgcccccatagtgcacgcatgttagtgagtgtggggtgaggagatggcttgaagacgaggtagacaagagaggttgtaaatattttctaatttttttccaataatttagaagagattgcaaatatgttctttttccaagacttaagtcagatacaagccttcccaatgacgtgtgaaaggcaaattttgggggtgctcctaattttacatcctatgtcttatattaaaagatgttgaataagttcttaggtagcacttaggattaagagtcacacagcacgcctgtaaccccagcgctttgggaggccgaggagggcggatcacgaggtcaggagatcgagaccatcctggctaacacggtgaaacccccgtctctactaaaaatacaaaaaaaaattagttgggcatggtggctggcacctgtagtctcagctgctggggaggctgaggcaggagaatggtgtgaacccgggaggcagagcttgcagtgagctgagatcacaccattgcactccagcctgggtgacagagggagactctgtctcaaaaaaaaagaaaaaaaaaaaggagtcacacggaaaattgacttactatgaaatcatcagaggagtagataataggtaaacaaaaactccctttggcttctagtccaatcttgaaggcaaatacagattagaaaaaagcaaagctggaaccctgaatgtcacagccacacaggctataggacataggacccataaggaaaaatcagggatcccggggacaggcaggaggtggattggatgtaggaactataatctggtgaggaagggagagaaagacttttgccaggaaaggatggatcgtactgccaaggaatgcagagtgaggcatttcctagcactgcagactagcaggactaagggtttcctactggtacactgtccacattcctaagcccacatttccattgtctgtttacttagggtattttttggctgattgtttgctcatgtatttgtttcttactttcaaaatgactaatttgagagcagactgccattctacgagtcatattatgcaaaaaataagtagatcgaagcacagggaccatctaccttgcaaaacaaagtctttggttcattcagagttggttaattttctcagtgcttttctccccctggtgatgttgaacaattttctttctacctatcctcacttccaatgtgcttgtttttaagatcataatttgttgatgagtggttgtttgccaagaccggtcttagggtctgtgaaacactaaagtgtatataataggcaaatcctcaagctttgtttcaaagatgtatgctaccttgacatgtagcattttgtatttgacaaaaaggcaagagatctgcataatctagacaaaaaatgaaatcttgtaatttgcagcaacctggatggaactggaggccatgatgttaagtgaaacaagccaagcacagagaggcaaatatcacatgatctcattcatatgtgggaatgaaaaaagtgcatctcatgaagacagagtagaatggtggttaccagaggcttggaagggtaagggggatggaaggatgatgggaaaaaaaaccgaacataaatactgaactgtacactgaaaaatggtagagacggtatactgtatctgtatattttatctcaataaaaagtgtaagatattaaaaaataataggccacgcacggtgactcacgcctgtaatcccagcacactgggaggccgaggcgggtggatcaagaggttgggagctcaagaccagcctggccaacatggtgaaaccctgtctctactaaaaccgcaaaaattagctgggtgtggcagcgagcacctgtaattccagctacttaggaggctgaggcaggagaatcgcttgaacccgggaggcagaggttgcagtgagcggagatcgtgccataccacttcagcccgggtgacaagagcaagactctgtctcaaaaataaataaataaatatatacatacatacatataaaataataataagaagtaaatgtggctggtttcaagcatgagtgtggtagactaattgggatctttttgccaaggtaagtatcatggtgggtgtggtatgtgaaaggcttggtgcccagttgaaagtcctgttctcacatcatctgcctctcatttacgcttcctgttacgacagtaaccaggggtgatcacaaaacagtaggagatgtatttcctggtttttgccgactagtgagcatctaagagacacttgtaacttctctgtgcttactcacactctgggatttctctctctccagcttggataggtagttcctcttcttttaaaatcattcaaaactattttcccaactggccctatgcttaaataaagccagtaaatttaactacggttttcactcagtaactcagagtacataataactaattgattatttagttttaacaaaagtggcaaatattaaaagatatgacttttttatgtagcaaagataaactcttctccaaatcctgccaaaagtaattctgaagtaatatagaaagggaagggagagaaggaaaaagaatttaccaaagacagactttatatatgaaaatcagtagataaacataatactaacttgagagtagaaataataataatagtaatgatgatggcaaatcacaaacggatagtactaaatttccctcccttttcaccaccttacaggatatcccgtctagctgcagaaacaaaacatggaaatgaatcagtcgataaaggattttctctcattaaagatgttggtgattttgtcccgtgtaggggaagttgaacattaaggtggatgtccataatctaaggggaccacggtcattcactctccttgctatgggatgcaaactgttttgcatgtgataagaatgccaggctaaaagtaaaaaaaaattttatctcagtatgataagaaattacgccatagactgacctaaacattgaattttttgacgattgcccccactgatagattttgtatttcttagtaaatctcaggaaattaatatccatgacagtctccatagaaaatacaaaatagaatcatacaaaaattgtgtataatttttctttatggggaaagagatggagcaaagagcaataattttgaggaggtgggaccaccagagagaataaaagaagttcttatatttaagagaaattcagaggtcattcagaaactattatcgtgatatttctcatttcaaagagatgtaagtttctcttaaacaatttatatttttaaaaagttataacggaaaatgagtgagaagtgaaaagtcccttttattcccaaggttcatatgacccagaaatgaacttgccctaagaatcaggtttaagacattcactttcaagctttagaaggccttgagcttcatttttcctggaaagataaacttaatattatacatgttatcatcctgttgggatcaaaatggaggatttgctgggatgaaatattaaaagatggaggatgtgaagaaagatttatgtaatgctaatttcaggcagctttcaaggttaatgcttgtccaaattttcatggccaattcctctcgcccaaggaccacatgggcagctctgtactgcttgtcactgtcatcagccacttgtgtgacacgttggctgcaattcaacagtaaagcatgcatattctctactgaacatttggggagcctgcaggcagcgagttgcgatgtaaatggaaaaaaagaaagtctgatcatagccctcaccatcataagttatctaggtgtcctgctcaggcttccaatgtgggcactcacacaggccacccaaactgctgacatccttcattgaccttttcacagcaattgtgagcctaatgactttgttttcgcgttttggaactgaactttacaaggattgcttccaatcctgggtggtgctgagaaaactcagcttcactagaatttggccgagaccaccagatgcgtttcatgtgagggccttttcccataatctgaccagaatggtttatgaatgttctggggagcagaaagccggccccggaggctgagaaagggctgtgccctgctcagctaggagaccacacagccgtcctctttcccctctgagtatttatagttaagaaaccacaccacccctctcattcggaagctgagggtgaaagtggaaaaaaccagaaacacaaattgcatcctacagctgagaaagtctcactcttggaaaagctagaaaataaataaataaaggggaaaatccaaatgggatcgctcttcaaacacacaaatgatcttatgttaacagttgggattaaacagctgtctcgtggttatgcgatcataacagatgctgtgtgcaaacgtttcctgctagctttgttttggttattgctgtttgtgcagttcattgggctgaattcagcttaagggatacaggtttttattatccttctgtgctgcgcaggcagcttcatcatctctttaagaggaaagggggcgtgtgagagggatagttggaagggaaatggagggtgggctctcccatgtcacattgggaatgatgtcatattgatgaaattccaacacactggtttatgaccactttgccattaaagtggtccccagctcatttatgagttttttgttgttgttgttttaaaattttgttttagtggaggctgtgttcagttctagtgcagtttatgcagctggaatagaatttatagaacatagagaaaacgtttcccttctttctttctttttttttttttttggatgactaacagattacaacgttgtaatgatccctatcttgcctcttcctcccatgccctccagagataaaatgtagtggctgattttgatttttcctagaagtttcatttcatcttagaagttgggatcgccttctctgtgtcagccaagtgaagtggtgaactatcactgtttttggaaattcaaatttggaagccattttggcctgaattatattacttagtcaaaccaaaaatatcctcttggcttaaattcttcagaaaactgccacaattcatagcacactttgcctaccaacggatttaattctattacttatatcccagccttaaaaaatacaatgcaaatggcagaaacaatatttctgggtacaaaaagcacctgtctatcataaggaggaagtacagagaacgacgtgggccatgtttaggggttctggccaaagctctgactgcctgtcacccccatgaggacctcgtttctcatctataaaaggctgattgtccatgcattcactggccagtagttcatctgtgcttttggaaattttggatgggggaatgggagcagatttgattgctcgaaaccttatcttaggaatcgtaccctttcagtaggaccatcctagcacagccaagtctgacagctttactgaagcagagctttctataatgtgtaaacatatttaaggaactgaacttaaattgctatctttttctcactcattcaattcaaggggttgaatgattacttttcaggtcttaccagctcacagaatgaaatttggccttgtctgataagttgtcaaagtagtagcatttctttgttttaaagacatttcaaaataatttcatgtacatttaatgcttgatcctactaacagcttctggaggtatttttctaatcttacagaaaagcaagtcaaggttcatcctataaggtaagtatcatatctaagttgtccaagtttattcaagtagtgatagagcctacatttggaccacattaggcaccaatggccagatgacatagagattaagaagagtatttgcccatagacctcttgttgtcactgactttttgagtttgagaccagcgtgggaaatgaagggagatcttgtctctacaaaaaaataaaagtaaaagaaaattagctaggcctgatcatgtgtgcttgcaatcccagctactcaggaggttgagatgggaggatcccctgaatccaggagtttggggctgcttgcaccactgcactccagcctggatgacagggcaagaaaccatctcatgaaaaaacaagcaagcaagcaaacaaacaaacaaacaaacagacaaagaaatccctgaatagcagctccttttgtggggacaagcctgtggcaaccttgtaacaaaaggtcctttgaaagaagatatacaaatggcaaataagcacatgatgagatacgatcccacacccacaggatggctaatatcaaaaagaaaaacacagaaaataacaagtattggtgaatatgtggagaagctggaattcttatagattcttggtggcaatgtaaaatgatacagccattgtgaaaaacagtttggtggttcctcaaaatattaaaaatagaattaccatatcatccatcaattctacatctgggtatatacttcaaagaattgagaaaaaggtcctgaaaaaatgggttcaaatcagtgttcacagcagcataatttacaatagctaaaatgtggaagcaacccaggtgtctattgatggataaatgaataagcaaaatgtgttacatagatatgtcttagttagttttatttgctataacagaatatcacaacagaaatttattcacagttctggaggctggaagtcagagatcaagctgccagcatatcaggttctggtgagggccctttactgggttgtaggcagccaacttcttgctgtgttctctcttggttgaaagagagctagttatgtttttggcctcttatagggcaccatcccactcatgagggctccaccctccttatctagttacttcccaatgaacctacctccaaaccatcacattgggaggagagcgtcaagacaggaatgttcggtggacataaatgttcagtccatggcaacatacaatgaaatattatttagcctgaagaagaaaggaaattctaacatatgctacaacacaaactaatcttgaggacattgcgctaaataaaatagcctagtcacaaaaagacaaatacgttatgattccacttatatgaagtacttaaagtagtgagaagcatactcagcttttccgcattgttatgtaaccaaacactacagtgtgcaaattcaatacctgtagaagaagtgcaaatcaggccatcagagcagtttgatttgtaccctttccttgatgattagaagtatccaagatcttcattcttttcttttcaagcttgctaccaattaaaatgtaaatctctccaagatagaatgttttaagcacttttatcgttgaatgaatttcagatcctttaatcttctgtcttttttgctaaaacaaagatttttaaaatataaaagtaatagagaaaaagggttaatagctaacgtatgccaggatggaggtgaacagcccaatagaagagttagcacgggttgtgaggagacagtcgacagaagtgccaatttagatgtcccacaagcaagtaagatggtcaaactcacttggtggcaggaaaatgaaagcaccaaaacagtgaagtatcactttacatccatcaagttggcaatttttttttttaaaaaatcaccaattgcaggcagaaatgtgcagaaaagggtacattcatacatcacttgtaaaaacctgaagacttttttgcattttggaaaagcaatctgatagcatgttgtaaatttaaaaaatatatgtgtgtatacatatattggtatacgtacacatacatatatatatacatacacacacatattatacacacacacaagtgtgtgtgtgtgtattcttccactcagcagttccattcccagcaatccatctcaagaaataaacaccttcctcttttaggcaatatgcagaatgtgtgtgtgtgtgtgtgtgtgtgtgtatgtgtgtgtataaatatatatgtatgtatgtatatattattcagcctgaaatactatagttaagagtgatataacaaacatatatatatagcacatagcattcttcctgggtacaaaaaaagaaaaagtgaatcaagcataatacattcatatcatggaatagcatgcaatagttaaaaagaataaattagagccatatcaattgacttagatggaaccccatgaagaactactcagtaggaagacacttatataggaagcatatagcctattttgggaaaacaagtaatcactcacaaccatacacacacacacaaacacacacacaatcacatgcaccatctatatccacccatagaggatcaaaggattataattgtataagaatatatgtgcttggaaatatgaaagaattagcactgcgtaattcgtattatttccctgtggggagctgggctgatgtgaggtgagagagcagagactgaagtgagtttacaagctgagaagagaaggaataacaaaaacatagtgccagtggaaaggaaacacatttttgtatttttttctatatgtggatataggtataaagaaatttatattaaaatattaatctcccatatagtattttttataattaaaaatcttgaggaaatgaagcttcatgagagatactgcccctcttaagactattataatagctttctcagtcaaaaacaaaaatgaaaacctgaaatcagtggcttgggtcattcaagttttgatgtgcaaaaatttcactgggccatttcctaggaaactaagtggttctcatttcactgttgtgtacgccttctagaaagctgaggaaggaaagaaggcaatagttcataattggctgagcattatttcctaaacatgtagaggtaccatctataataaaggctgaaactgagcatcattggttattgttttaagtagtggccaagttatcaaatgatactgcgttacactccttccttgactctgggagctgtgttaggggcagctaaggatagcaaggcagggccaattgtgtatcctggtgatagggtatagctctcaacacataatactctaaattggtttcccaatttgtatttctaagataggaatccaacttgcaaaagtgaagatggggctgttttacgccatgtaatcctattcctaatttattttctttttctttttttttttttttttttttttttgagacagagtcttgctcttttgccaggctggagtgcaggggcgcgatctcagctcactgcaatctccacctcctgggttcaagtgattcccctgtctcagcctcccgagtagctgggactacaggcgtgcgccaccatgcccagctaatttttgtatttttagtagagatggggcttcaccgtcttcagcaggatggtctcgatctcttgacctcatgatctgcccaccttggcctcccgaagtgctgggattacaggtatgagccactgcgcccggcccctattcctaatttcttaactttggttcatctctcagttggtcagtcacaaatgtgaattctttttcgagaattatggtacaaggatgatcagttttgagattatttgaaaatgtgtatatgaagcctttatctactagcggaaagctttattagtgacaaaaatagatgagtcactgtcaattttccacagatctaggtaaatgcttctctattacctttagcatttcagcagaagtgtctatggtcagcccattttatgttgttacaggtcatttttttcttttttaaataaatttctgtatgtttatatatttactttaataatttaataatcttctcagcctgattatcttttcactgagtttgcttgaaaagctgtgggcccatgaactacatatccagattgtttctaaattcagtaaagttttctttaattttgtcttcaactattgtttctattctagttgtcctgtcttcttcttccagaaactatacaaattctaagagtctatcttcattttgttatcagtgtctatatattcttacaaactaacaccatattcttaccattttttaatagttcttcagtgtatgaagttggttcatgatatcactagtagaattttctgtctttcctttcttcagtatagttcctactctttatggtgatcaaattttgctttaattctgcaatcgcatgttagtttatcttgtgtaattgatatgatacatcacagttagatactatgcaaagctcatagtatccaactcatactgaactttgcttagtatctaactctgatgtatcactggtaatttctttaccttataaatcagcataatttctctcaaacagtcctcatttgcacagatgccaaaacgtataatgttattatttcctggaatgctccttaagagatgcattagtttcctattgctgctgtgacaaatttagtggcttaaaacaacacacacacttattatctcacagttctggaggtcagaagtctgaaacacgttggcagagctatgtttctttggaagctcctggggagaatctgtttccttgctttattcagcttctagaagtcaagtgcattttttggttcatggacccacatcactaacactcccacctgtgctttagtaacatctctttctttacctctggtcttcctggctcccttttaaaaggacctttgtaaatacactggacaatgcagtataatcccccatctcaataaccttaacttaatcacatttgcaaggttactttttgccaagcaaggtaacatatttgtaggtacccaggagtaggacttgtacatcttttttttttttttttttttttggtggggtggggggcatgattcaactcaccacagataaatttacacactattatctttatcttagtcacaggcaggtacataaactaggctttttattctaatctccctttccagtttgctcagaatttttgaggatggttcccagaaagggaagcagaagagacactgttgttgatggcgttattaatacagatttttccaggctaagccagcaagctatctctacctgatctcacctcctagctatttgtctattctcttttgcaaatgtttctctctgccacctgaaaatggtaatttttaaaaatgtacttgatatcgtttgaatatgtgtccccaccaaatctcatgttgaattgtaatccctcatgttggaggtggggcctggtgggaggtgtttgggtcatggcggtagatctctcatggtttggtgctgtcctcgtgatagtgagtgagttctcatgagatctgcttgtttagatgtgtggaacctctcctcctattctctctcttttgctccctctctgccacgtaagatgcttgctcccccttcaccttccaccaggattggaagcttcctgaagctttcccagaagccaagcaaatgccagcaccatgcttcctgtaaagcctgcagaactgtgaggcaactacacctatgttcttataaattacccagtctcaggtatttctttatagcagtgcaagaacagcctaacacagtatttaatttttttttttttttttgaaacagagtcttgctttgttggccaggctgaagtgcagtggcacgatctcggctcactgcaacctccacctcctgggttcaaatgattctcctgcctcagcctcccaagtagctgggactacaggcgtgctaccacacccggctaatttttgtatttttagtagagacagggtttcttcatgttggccaggatggtctcaatctcttgaccttgtgatccacccgccttggcctcccaaagtgctgggactacaggcatgaggctccacagtaattaattttaagaaactgactgactgacttgcattctgtagtaaggtgcatcgccagctcacagtttacttcccactgggtcccaaagggaaggaagcccctggacaggggaaaggaacacactcccgtagtgctgcccgtcatctgctatgtgtgcaatccttcctcctgtcatcagtctctcactttggcttttcttataacttatcatttagtggtgtatttctgtcctgttactcagtctattctcttgcattttgctccaatttcataaacaccaagtcttcttgtattttactgattgagccaaactgttctgactttttctctggttctgacaacagagcacatgccatttatcacaattgccatatacttttctttgtcctccaagttacagttgctgttgttccctctgtactcttgcttaaccaaagtgccctccatccagaactagtattgagtagagcactctggagcaccactcactctccacttgggtgctgactaaaatctcttctcagagtctcagctgctatcagtttcatgtcaattaccctagcccaattccaagtatttaataccagtgatctgctagacaaaaattggatgttatcctaaggctactgcctagtatgtgataaattaaatttatacataaaaactacgccccatagaatttacctgtcctgaaggactcttcttgtagggaccgcatctcccacagtgacatttgctaaggcgattccccaccaatgccacacagttatcccattacatgtactcgacaacacctgtgtctgcttatctttttttggaaatacacaattcctagcaatgttaaaaagttaactattaatcaagaggaaatagaagggagaaactaaattctgagagcctcaaagaacctgcaggtacatagtatgttcttaatcagcctaaagggtgattctcatgggaggcagtcagggtggagagttgagagggggctggaagagcacagaaagcatcttttaatttaaactctgatggcacagcacagatgatggattgatttatctcttctggctgctttcatcaatactccagttagtggaaattgttcccaatttggcaaaagtttgtcaatgctagggttcatttttaactttttccatgacttcatggggggaagagtattatttagatggcattttaaaccaaactctttacacgtgatttctcttcaaggaaatgctatgcaacacatgagaggaaaggaacatgggacaagcagaaagagaaacactatgttagagtgagatagcaggcagctaggcttcaccagggaatcggtcatgggtgctgagtcttattatgtaaactagttcaacgcacctcaataggcagcttcagattctgcatacttccaaatttatttgtattctggtaacagaattgatttaaagtctttgggtttgcttagttctttctggcccaccttcctttccaggtcaaaatccttctctccacaactaaagtcacttgttcccagtaattctatcctctgctttaactggaatattccctaggcctctttatcaagtccactgttttccccaaccctaccccacaatgacatattctaagtatctactcctgtttcccagtcatttccagctggcttatctatgggcactaaacatcctcctagttgcccctgaaactctgcagccctcaggaaatcatcctgctcttgccattagttctattaaaagcttgttttttggtctccatttttgttccactttgtttattttcattttttaaattttattttattttttcagacagggtctcactctgttgcccaggatggagtacagtggtgcaatcacagctcactacagccttgaactactaggcctaaatgattcttcagcctcggtctcctgagtagctgggactataggtacatgccaccatgcccagctaatttttgttttgtgttgtttgtgtagaaacaaggtcttgctgtgttgccctggctggtctcaaactgaactcctggcctcaaatgatcctcctgcctcagcctcccaaagtactgggattataggagtgagtgaatcactcttccaagagttcctatcctaaacaggcaagttctagttcaatgcttgttacaggaccaacacatcagacaccttttctaatgactcttccaaaaatcagctcatttacattgtttggggttgcttcattctgttttcctccagtaaatatataatgtttatgggggaattatttatttatttgctacagtcttcttagattttgcttaaattattgagtaaaaccaagccaaccctacctaccggggaagaaaagagctttaccctccctccctaagcctgttggatatggagaccctggccccttcccagcccctgctagattggtctcatgtgcctcatttttggcttctcacagtccccttcctcagcttctgtttttcttggacttcttcttcccctaggaacaggatacaatcaccacagctctcagtgggcttatagtttccaataagttcacaaatactctaattttatttgatgatttcataaagaagcaatggggtttatagttctttgcaaaagttgttttgcatacccaaggtatgtttgcaaagtgtatctgtttcaaataaacagataaagagctattcataatagctactactagtttccacctctttcttaggtggtaaagagcccttctggttcacactgtactctaagactcagtttctgaaactcaaatctccttaattttggcatggggaataaagtctgcctaaacttgcatgctagatgctgaattaagctacttggactaaagcctaaagcaggatcctaggcttggcaagatttacatacactgccatccagaaactgcttcctagttttccattcaggtacgggttcctggatcatgtactctaatttaactgtatggaagggactccccaaaagctttcaaagaatcttttcctgagctccagataaatgcgaaataacactgtcacactttttgcatgctctcaaactttccagagagtcagagatggacatttagcaagccacccttaaggaatgtgggcttcccacaacccagaatgatatttctccagttggtacaacaagatgaagcagaagcaccttcagaagattatgctaccgagagctgatgttatccaaaaattagaaaattacccttttcccagcctctacaatcatccaaattggcctctaatcattagaaagagatatttggaaatcaacatggagttagttattattcgtacatttaacaaatactaagcttctagtcatagcaagcattttctaagtactaagcacacattggtgacaaaacaggccagtcaagtgctatcaggcttataggtttaggaaagagatatacaaataagtttcaaaatgtaatctcagcactcttggaggctgaggcaggcggatcacttgaggtcaggagttcaagaccagcctggtcaacatggtggaaccatgtatttactaagaatacaaaaattagtcagtgtgaggtgcatgcctgtaatctcagctactcaggaggctgaggcaggagaatcgcttgaacctgggaggtgggggttgcagtgaaccaagatcaggccactgcactccagcctgggtgacagagagagactatgtctcaaaaaaaaaaaaaatgtatagttgaaagtagtaagtactagacaacataatatgtaatagcccaaaactggaagcaatttaaatgactaccaatgaatgaataaaaaagcaaatgtggtatatccatacaataaaatttatatggaaataaaaaaggaatgaagtactggtatgtgttatcacttataaaatggatgtgaaaatatgatgttaagtgaaagaagctagccacaaaataccacgtattatatggttccatttatataaaatgttcagaaaggcaaatctatagagataagaagtcgattagtgattgtttgggtctagtggggaatgaagagtgactccaaatggccatgagggaaatgttctaaaattgagttgtggtgatggctgcatatctcagtaaatttatgaaaatataaaaacatcagatgtttgcttaaaacagatgaattttatggtaaataaataatacctcaataaagtggttaaaatatctaaaaatcaattaagccaataaacccataaattattacttgaaaaataatgattattgctctaaaggaataaaagaccggggagttacgaaggattagtacacataggtgtgtgtctccttaagcaaggtggccagtgaaggttttgcagaggcaataccatttaatggggtgtctgaatggagagaaagagccactcacaagaactgacatgggaagagactactagagagaaggaccagcttgcacaaatgtcctggggtaggaaatactttggtttttgggaggaactccaagaaaacctgtgtgagggataatgatgttctatcgggccatatgctctcggataaggagctcggattctgtcctcaatgtagtagcaatccactgtggagcttggagcagcagagctatatgctttatttctttatattaatctgggattgaaaaggaaagagggaaagttggaaaatcagaacagatgccattccatggcccaggcgataggatgtcagaagtaaagatgggtagaaatagacggatgtgatttttatgtttgagatggacctcatcaggactgctttgagatgaggactctaaggagcgaggtagagagcagaatgggatatgactcccatattctagataaatcaggtcggtgaatttgctaacatgaggatgattgaggtagaaccaggtttgggaggtgggagaatcaagagtctcattttagatacattaggtttaaatgcctatgaaaccaacagaagagtgatggagcagacaattgaaatgtaggattgcaaaggagactgaggagtagtaaccagaggggccaaggaaaactcaggacagtgtgataacacagagttctagaaaagagagacttgtgagaaagtggaggatgcccagtgctgctgctctgttgggtaagaagaggactggcagatggaggtcagtgcacctgacaaatgcagtttctacaggatgatggtggaagccacactggaccaggtcaaggtgtgacaggagtgaggatgtgaaggatgtacatggagataactcaaaattctgtctgtaaagaaaagctaagggcgaggcaattttagggacatgagttgtaaggagtgttcgtttatcagctgagattagatttggctgcaagtgatagaaaaatataacaacagcttacactaggtaggtgtctatttttctctcccattgataatgttaagaggtaagaagtccagagctgctatggtggctccccaaacaatgggggccaagatctttctctctcacagctctgccaacatcagtataggaggaagtgatgaagggctcagatccctgcactgaggatgcttccaagagcttgaaatactgcatgtgtttactcattcacacggcctcacctagctgcaagagaagctggggaacattgcccgttccaggtgttcatggacccagacagaagcatagattcttgtaccgagagaaggaaacaatggatattggaggtcaactatcatcttttgccaaattagaagtcagctatcatcttttgggcttgagttttgtttgtttggtttaggtgtttatactgcctagtgtgtacactgatccagtaaagaaggtacattagatgcaggagagtcatgacccaaagtctacagaattcttcagaaggatgagaggataagatcttaaaaaacaaaacaaaaaaaaaccctgacctttgaaaacagaagccacctttcatcagttgtaatcttgaaggaaaaaagacggtgtggatataggtgagttaaaaaatttaaaaatatttagaaaatgaagtgaaagatgagggatttctcaattgatggcatttactttccaagtgaaagttgaggcaaggtcagtttagtgtaagccactggtttgagtagggagaagacactgtcttggagactcaattcaatagggagactttttaaagctgcaggacagtggtgagagtccactagagacattaagattttattctgtttgtttgtttgtttgtttgtttgttttgagatggagtctcactcttgtcgcccaggctggagtgcaatggtgtgatctcggctcactgcaacctcctcctcccaggcacaagcaattctcctgcctcagcctcctgaatagctgggattacatccacacaccatcattcccagccaagattttattctttctagtgaaaccaagattagccgggatcagccacaattagccaagcgaagctgccagcacaggtgtggagaaggaacacagtggtgctaatccaaggttggggttcggcaaggcaagtactaagaaagactagaaagtgccaagttgttacagaaacttgcaaggaaataattttaatcatcattatcatcaatcagttccaataacaactgttttttattgaacacttcatttgcatagggcatttttgacttataagaattgccattttatagcttcactttattttttagctttcacagttaatggaatatattactatacatggaaaattgttcctaatttaagcccatttccccaaatgttattacttttacccctgaagaaaaataatcttgccacttcctcttcatcatttcatactcctgtcaccttgtaccttcttcctctgtagaacaatttactgaacatagctcagattctattgcttatatcattcatattcctcttctctgaactccctagaagttctccgcccctctttgaagtgtgggaccaaatctgaatgccgaaggccagctgaatgaataagggaaaatcatcccttatttaatttactctccaaaggataatggtagaggcttcatttatacaatgtgtcatgaaaggaaaggtggggaaagatgaaagggtagctccacaatctcaaatgttcccattatgatgcaggtcgggtggcccttaataagctgcttgagggcttatttgtatttctagtggcatttcattctcttgaaggggttttgctgggagactagattcccaggtcaacatacctagatgaaaacaaatgctgttatcgataccaaaatccgttcagtgctgttttgctgaatttcatatttacattgagtcaattattaagtaaacatgtgagagaacgtaaaaattcctttcagtgttactctatgggaaaagtcacccaagttgcaaaatgtgatttatactcatgttgcattaaaggaggcagtagatgggctgaattggaggactcctggcctttaattgccttattccgagagtgtcttcccatgatatcttgaactgtctccttttttttttttttaatttctacttttattttattgtggtaagaacacttaacatgaaatctaccctttaacagatgtttaagtgtaccttacaatattttaactatcggtacaatgctacacagtagatcaccagaaattattcatcttgcataactgaaaccttatacctattgattaccaactctccatctctccctccccacaggccctggcagctaccattctactctcagcctctaagagtttgcctattttaaacatctcaaatgagtggaaacatgcagtatttgtcccttgcgactagtttatttcacctaatataatgtcctcaagtatcatccgtgttgagtggaaaatacaaactcgttttctctattgtctcacgacatgcttctgacaccacacactggggtggttttccccacacatcaagcaagcaatcaattctacagcagacatcagccgggcaccctgcaattcaactctgacgtgatctacctggagactgcctcatatcccacaggttgagggttccatctcatgagactgcctccacttcagatgttaatcacaagccccaggttgtttcacctgtgcttctgattggccagctataaatcgggatttatagccagtgaccccctccctgggtctgattaatttacaagagtggctcacagaacacaggaaaacacttacatttacgggtttattattcaaggataccgcgagggttgcatatgaaaaaaaaaagtcatagggcaagatatgggggaaggtgtgcagagcttccattctctttctgggcacaccatcccccaggagcctccagcttgcccaggtttccagaagctatccacacccagtcctttatggtaatttcattacctcatgactggttatatcactggtcattggtgaccaacttcaccttcagcccctctcttctcctaggtggttgaaggatggatttaaaagtcccaaccttctaattctctcttcatctttgcagtgttaagtcccatcctgaagctattagggactgccagccattagtcaagcctcaagcatacaaaaacacacttttctctttggcgattccaagaattttaggagttatatgccaggaagtggggaccaagaccaaatatatatttcataatatcacatattgtcacatattttaggagttccttcttttctttaggctgaataatatcccatagtaggtacataccacattttatgtatacatttatctgctgatggacatttcactggcttctacatctcagctattgtaaataatgcttcaatgacatgggagtatacctttgtgatcttgattttaattcttttggataaataccaaagtgagatagctgaatcatatggcagtccaatttttacattttctagaaaccttcatactgttttccatagtggctatacaacttggcattcttaccaacagtgttcaagggttccagttgctctacatccctcaacacttgtcatttgtttttttgaaaatggctatcctaacaagtatgaggtactatctctttatggctttgatttgcattttttatgataagtgatgctaagcatcttgtttttcatatacctgttggccatttatatgtcttcttgggagaaatgtctttgcaatccatagctcatttaaacaattggctatcattattatcattattttgctatttagtcatataagctctttgtatactcttggcattaatcccctgttggatgaatagtttgcaaatattttctcccattctgtaggttgccttttcactctgttgactatttcctttgctgtgcaaaagcttttgttcccctttgcctacttttggtttttttgcttgtgcttttggcgtcatatctatgaaatcatttccaagaccaatgtcatgacatttcccccctctattttcttctaggagttttacagattcaggtctttagcccattttgagttaacttctgtgtatggtataagatataggtacactatcattcttttgcatgtggatgtccacttgtcccaacactatttgttgaaaagacaatactttcccattgtgtgttattgacacccttgccgagttgaccacaaatacatggatttatttctgtgctctctattctattctattctattgctctatatttctgtctggacttcttcaatttttaattcctgttacactactctatcatcaatttcctgggaaccgtaagaactactaaaacctttgcttgttttgtttggtgattcaatttgttattgggataaaagtatatttcaaactatttctgtaagaacagaatctcaaaatacaaatgttattttgtatattatttacaaattcccaggctatgagcttaatttatggtcatctgcaaaaggtagaaaacaaggttttgagttgagtctcaacttgcctgtcactaaattgtacagaatagatggtaagatggattccttgtgagacataactttgcaagcccccaggcaggaaattcacccactaggacttgggagtcacccaagttgtatttgtgcatcccttaaaaagcaagactgggccgggcatggtggctcacgcctgtaatcccagcactttgggaggctgaggcgggcgaatcacctgaggtcaggagttcgagaccagcctgaccaacatgcagaaactccgtctctactaaaaatataaaattagccaggtgtggtggtacatgcctgtaatcccagctactcaggaggccgaggcaagagaatcacttgaacacgggaggcagaggtgtggtgagcctagatcatgccattgcactccagcctgggcaacaagagtgaaactttgtctcaagacaaaaaaaaaaaaaaaaagattgcaagacttccctttccctaggctcatcaaaaaagtaattaaagtaagtgtatgtagccgggtgtggtggctcacgcctgtactctcaacactttgggaggctgaggttggcggatcacccttaagtcaagagttagagaccagtctggccaacatggtgaaaccccatctctactaaaaatacaaaaattagccaggcacagtgatgcacacctgtagtcccagctactcgggaggctgaggtaggagaattgcttgaacctgtgaggcggaggctgcagtgagctgagattgcaccattgcactacagcctgggtgacagagcaagacaatctctcaaaaaaaaaagtatatgtataaaatatgtgtatataagtgcgtatacagatataccatatataatttatatatatatataaatacatacatatcttatgtatgtacatttataaatatctgtaaatgcaaagaggctccagatttaccttttgaataaaatccagagtcactactatcttaatttttgcatgagttatctgcaaagcaaatgagaagtaactaacaatttatttaaatagaaagaaaatcccctctgctatttattataaaacacttcattaatttatcaccggagttattgtctcaaactcactaatgtcttctctgggctacttttcatagattatttcttgtacatttgcaagacgttactgagtcccaggcaatgtcccagatgatcagggcatttgtggtacctggtatttggcttctataccatgctctatagactagatggggtgtgtcaaggaaaggatgtctccatttgcctttgtccttaagaaagtgagtaactgtctctttccttgcctatttcttccatggagaatttactggccccaatttaaaaaaaaaaaaactcctaccacactcccattttctgtaagtgcaattagttgcaggtacaaaatttggagcaaagaggcctctcgtggcctgttgtgcctgcagttatccaactgtggctgcagtttttcagtgcacaactgattgcacccacaaaaagaaaggctaaactttgaaaatgggtccctttaagacagttgggggattgcatgcctccggttggcaaattgcaatcttttatagaggcacagccatcactctggctcgcactgccagtctgaaatccaggttaggcatcttgcatgagggagagacctggctggagagcaggtgcacaggactctctcctctccgcccaccacttgcccccctttcaccttgagctactcatggactatgcattagtattcagcattcctgactccatctcctgtttagttcaccagtcactctccaaaagggtttgcagagagaagctcagtcggtcacactgtcaatataacacatttaaccaactctaaatttgctttaaagagacagctaccaagattgacttttgcaaagtgactcactccaccacgcggcaaagccgtccgtttgctctcgactgttaagtgtgtcactgagtacataagaaagggttttgaaggaattccagtgtgaatccactaattcaataatccaataccataaattcaagtaatggatattaatactatgttcaaaacacgctcacaactttgatatctctctttctcaaacagacagagcatgcgtcgtgagaggctcctgatgaaataataaaacccaattttcatctagaaacaagaatcattataggaggatggtaatttactttatatgaccttcaattgattattctgtggctgccacacaaatatcacaggagctattgatcgtaaaacctaccaaatagatctctaatagcttttactgggcaaaaataattatgcttgcactgtggtcaaacacacataaaccaatgtggaggtattaatatatggcattattacccatctgtctgctaggcatggagaagacccttcacgggaacactctatgtctaagctccatgaaagctcaatatccaagccaacaattacagccagttacacagaaaaattgattaccgtaactaaaagctagagctggagagtagaggctgcagcttgcttaagaaaagtaaaataataacaagagaaatcctaattgagggggagtcctgctgcagtgactaccaggactcagaaattgcatttccctgtggtgtcagcagccgagtaacttttcagagtcaagagctttctatccagcctagatcatgatcaatgatcaacactcgtaaaaggtcagggtgtctaatcaaagaccagatcatctatctctcaaggtaaagcgtacaacataatccagaaatgtggcgctgctggccatggagagtgagaaaatccaagggaaagagaaacttcagttccactttggtgaacaggaagaatgttctgctcatacaaaatgtgcagccagccttctgcgggcgatcctcagtggctcaggtgggcctgaaggggatgaacaaaggccacgctctgaagggggagcttctccaacatgctgggcttccaggttctgataaaaacattttagacttcaaaatgtcacagcaagtctatcacttgctctccaattcccgaaactcagtattttaaaaaataatatgtaaatataaatgcaccaacagcaaataacaaaaatcccaaactgctatcgaggtgttaaaatgaggagtgatacattttaacaaccagaatgaatacactaaaatgctaatagaactgagtagtggaaaagaaacaaaaagagagatcttgtttacccaatgtgggttctgtgcatatgcttgagtggagaggggagacaactgtgggatgggggcataagtatatcctgtgaaacagaacagaatactatcccaggaatcccgttcatatatctcatgaaatagaatcaaataatatctcatgtagcccatgaaacagaacaggattggaatgcacagctggatggctgcacatgccaaggattggaaaggttttcccaaaatacctatgtctaaccccaaagtgcttctgcctccaccacaccccagaccaatcaaaccagagtattaattttggcatttgtatttcttaaaacaaaaaacaaaagcctatgtgaatctcacatgaagacaggtttgagaaccactaactttaaagggagagaccctttttagggaagggaggtccttagagatgaggaacctccggtttcccaagggcacctctccttcttctgcagaaatacagctcgcctgtttatttctcttcctttttggcattagcagttccagttgttaaaggcaggaaaactggagtcattgtctctctctttttcatgatttatgactcagaagcaagacaggggcaggaggttggagggtaatgcttgcggctgtggttgctgttatttttattttgtatttttcttaaagaaaataaaagaaatatgcttttctgaaaaatcttgaagccttgaagccacctgcagggctgttgttttccaaggccttgcacttacgtaattgacatctacatagacacactcctggaacatatcgggggaggcaggcattctgcttgttctcatttgttctcaaattacatgataaaatacatgttttggaccttttaaaccaaagggagttattgagcccgcttacaaaatccataacatgttagcaggacttatctagctgcctccacagaatagccaagcaactctacacccgctttagcccccacaaaaacaagcggattgcactacaaataatttgcctatttggaaaatgaaagcttctctgtagtttgaggtcctattttttctttaagttgttacagtcttttcatggtccttgaggtctaggttaggtttttgtttggggtaatttttgtatcctatggatactatttaatctttagtattgagtcagtatttctcacttaggccttaggggaatactgcctgaagtatgtagggggcatgcggaattcagacgtggcttggaaactgcaccatgggttcacccaagaaacagaccagaggcaacacattctatcactaaaacgtgttctcagttacacttcccttccaaaggtaagcatcttaattcttcaactttttaagaggctaaacccagtgagggcccgtatgtccacaaatagatgacacacccatccaaagcacgcgtgtgtattaagggacagcgtgtcctcccacgttccagccgcccccctggctgccagccgcgggctcagcgcacgtacggtccctgtcacccgagcgtacctgtcccgttctggccttggagaacgcagtggctcacaagggcaccgctagcacgcgaggcgcggcgaagggagcggagggaagcggcgggctgtcgcgcaggtgcggccccacctgccgccggattggccgcggcggctgcggcgctccgcgggaggagggcggatgatggatggcctgtctgccggcccgggtccgagccgcgggggccgccgagggaaagacgggcgcgcgcgcgccgctccgtgcccagcgcagacagcgagatgcc

SEQ ID NO: 1225 - DNA, 418802 bp, Homo sapiens
agttgtaaacttcacctcccgggggctcttccccttctgtacccctttgctgtttgtccccctcctcccgggtcctggagtccgtcgtgttccaacagtttttgctcttattcccgtgggctgcctgggcctcctttcacccgtgagacttggagcggcccctggggtcttgggtgtgcagcacggatcacgcgagacccctgaggtaaccgcacggtgtgggggcttcgaggcggacgacttgggagggaggtgttgagagggttgtaggggcccctgagtgagtttggggcggccctggggctgttggcgtaggctttggggcacgcctccagctccctgggctgggtctccccgcccacctggaggaagatctccgtggagcatcctagccagagatcgctgaggctgtaccagagcgccggatggggaccagaggggaggcagaggaccgggatttggagcttcttagggttactgctgcggagcgctttcgttcccgagaatcagtaagcccctcgaggatagggaccacgtctttcagcccgctctcccctttttaaatgccggccacacactagacactctacagatgtttgataaacgggaatgagttgtgctagactgtcacctgcagcttctacctaccctccaggactctgagagacttagaatctgagtcagctgtgcgttttcccgaagctgtaaattttctgcagaaatggagccgactttttgaatttttttattccattatgatattgatcctaagaaaatacatatttcatgtatacattttaggtaaatgagataaatacgtctttattttgtttattagagttggtgtccagctcttttgaatacatgacataccgatgttttatggttttcataatattggagaaaagaacatacgattttgtcacttttttttttttttgagatggagtcttgctctgtcacccaggctggagtgcagtggcgcgatctcggctcactgcaagctccgcctcccgggttcacgccattctcctgtctcagcctccccagcagccgggacaaccggcgcacgccgccacgcccggctaatttttttgtatttttagtggagacggggtttcactgtgttagccaggatggtctcgatctcctgacatcgtgatccgcccgcctcggcctcccaaagtgctgggattacaggcgtgagccactgcgcccggcatgtcacttattttatttaactgttagttcctactctcaacaaaacagtggtagagcagaagatgaacatggtttttcataaaatgcagaggaaacaaaggcagtgcaacctgctaagaggaaagatgaagggcatagtcttagtttgtagctttctgtgttagtcttggggctcagccatttatgagctgcgtccccacaggcaaaccacctaaccttcctaggcgttaggttctttatctgtcagataaggaggaaggacttagtctctaaagtctcatttgattctaaaacgttttggttgtctcagtcccttggtcttggtcttgttttgatgtaagaaccaaacttcccctttaaaggttgattatgtacctatgctgagaaacacttccaacacaggtgtggttactaatgaagacagcactgcgtagtgaaagaggatggacttagccagatgtggatttgaattctcattttccggctgaatatttttacacaaattattcaacatctccaagcctcagttttcttatctgtgaaatgtgcataatctcatagagatgttgggattaaatgagatcaggaatgctgatctcagtatctggcatatagtaagtggctcaataataggaatttctattttttcatccacccatccctcgtttttcctctgatctgtgcagacacactgaaagatgagtgcatttgggatgaccaactgaaggactcagatgtaaggtagaaaaattttttaccagtagtggctccgaaatctaaagtagattcgcctttctggctggcacctcctctcaggatgtcgggatcactgatcccttggcctcaattacccttttatctatttttaaaaatgcttctcattgatgaatgatacacataatatcccatcatctattttagtaggaatggtgagattagttcaactccactatcaaaaaaagattaatctattaatacattaacataaaaagctaatttgaaccttgcctttctttatctattactgctacaggatggcctggttttggtccagaactgtgaaggtgctatctggattgagaatcgactgaaggtctgagtaatcttttgttgagaaggccatggcttgtcagtttcgatacggggaaaaatgatatttttaagaaatctccagcaaagagcagaaatgcttccctgataagtgaggtcttacatgcttccctgactgggatgaactgtgtcttgagggccaatagcaaggcacacagcagagctctggagtcagctaacttgggtgtaaatcctgaccctgtcactagagatgtgagagatgtgactttagtcaagtgactgagtatctatttttatttcttttattattatactttaagttatagagtacatgtgcacaatgtgcaggtttgttacatatgcatacatgtgccatgttggtgtgctgcacctgttaactcgtcatttacattaagtatatctcctaatgctatacctcccaccttcccccactctctgccaggccccggtgtgtgatgttccccaccctgtgtccaagtattctcgttgttcaattcctacctaagagtgagaacatgcggtgtttggttttctgtccttgcgatattttgctcagaatgatggtttctagctttatccatctccctacaaaggacatgaactcatccttttttatggctacatagtattccatggtgtatatgtgccacattttcttaatccagtctatcattgatggacatttgggttggttccaagtgtttgctatggtgaatggtgccgcaataaacatatgtgtgcatgtgtctttatagcagcatgatttacagtttctgccgagaggtccgctgttagtctgatgggcttccctttgtgggtaacctgacctttctctctggctgccagtgatgggatggctgggtcaaatggtatttctagttctagatccttgaggagtcgccatactgtcttccacaatggttgaactagtttacagtcccaccaacggtgtaaaagtgttcctatttctccacatcctctctagcacctgttgtttcctgactttttaatgatcgccattctaactggtgtgagatggtatctcattgtggttttgatttgcatttctctgatggccagtgatgatgagtattttttcatgtgtctgttggctgcataaatatattcttttgagaaatgtctgttcatatcctttgcccactttttgatggggttgtttgattttttcttgtaaatttgtttaagttctttgtagattctggatattagccctttgtcagatgggtagattgtaaaaattttctcccattctgtaggttgcctgttcactctgatggtagtttcttttgctgtgcagaagctctttagtttaattagatctcatttgtcaattttggcttttgttgccattgcttttggtgttttagtcatgaagtccttgcccatgcctatgtcctgaatggtattgcctagattttcttctagggtttttatggttttaggtctaacatttaagtcgttaatccatcttgacttaatttttgtgtaaggtataaggaagggttccagtttcagctttctgcatatggctagccagttttcccaacaccatttattaaatagggaatcctttccccattgcttgtttttgtcaggtttgtcaaagatcagatggttgtagatgtgtggtattatttctgagggctctattctgttccattggtctatatatctgttttgttaccagtaccatgctgttttggtgactgtagccttgtagtatagtttgaagtcaggtagtgtgatgcctccagctttgttctttttgcttaggattgtcttggcaatgtgggctcttttttggttccatatgaattttaaagtagttttttccaattctgtgaagaaagtcattggtagcttgatggggatggcactgaatctataaattaccttggggagtatggccattttcacaatattaattcttcctatccatgagcatggaatgttcttccatttgtttgtgtcctcttttattttgttgagcagtggtttgtagttctccttgaagaggtccttcacttcctttgtaagttggattcctaggtattttactctctttgtagcaattgggaatgggaattcactcatgatttggctttctgtctgttattggtgtataagaatgcttgtgatttttgcacattgattttgtatcctgagactttgctgaagttgcttatcagcttaaggagattttgtgctgagacgatggggttttctaaatatacaatcatgtcacctgcaaacaaggacaatttgacttcctcttttcctcattgaataccctttatttctttctcctgcctgattgccctggccagaagttccaacactatgttgaataggagtggtgagagggggcatccctgtcttgtgccagttttcaaagggaatgtttccagtttttgcccattcagtatgatattggctgtgggtttgtcataaagagctcttattattttgagatacgtcccatcaatacctaatttattgagagtttttagcatgaagtgttgttgaattttgtcaaaggccttttctgcatctattgagataatcatgtggtttttgtcattggttctgtttatgtgatggattacgtttattgatttgcgtatgttgaaccagccttccatcccagggatgaagccaacttgatcgtggtggataagctttttgatgtgctgctggatttggtttgccagtattttattgaggatttttgcatcaatgttcatcagggatattggctaaaattctctttttttgttgtgtctctgccaggctttggtatcaggatgatgctggcctcataaaatgaattagggaggattccctctttttctattgtttggaatagtttcagaaggaatggtaccagctcctctttgtacctctggtagaatttggcagtgaatccgtctggtcctggatattttttggttggtaggctattattgcctcaatttcagaacctgttattggtcttttcagggattcaacttcttcctggtttagtcttgggtgggtgtatgtgtccaggaatttatccatttcctctagattttctagtttatttgcgtagtggtgttcatagtattctctgatggtagtttgtatttctgtgggatcagtggtgatatcccctttatctttttttattacatctttgattcttctctcttttcttctttattagtcttgctagtggtctagcaattttgttgatcttttccaaaaaccagctcctggattcactgatattttgaagggtttttttgtgtctctatctccttcagttctgctctgatcttagttatttcttgccttctgctagcttttgaatgtgtttgctgttgcttctctagttcttttaattgtgatgttagggtatcaattttagatctttcctgctttctcttgtgggcatttagtgctataaatttccctctacacactgctttgaatgtgtcccagagattctggtatgttgtgtctttgttctcattggtttcaaagaacatctttatttctgccttcatttcgttatgtacccagcagtcattcaggagcaggttgttcagtttccacgtagttgagcggttgtgagtgagtttcttaatcctgagttgtagtttgattgcagtgtggtctgagagacagtttgttataatttctgttcttttacatttgctgaggagtgctttacttccaactatgtggtcaattttggaataagtgtgatgtggtgccgagaagaatgtatattctgttgatttggggtggagaattctgtagatgtctgttaggtctgcttggtgcagagctgagttcaattcctggatatccttgttaactttctgtctcattgatctgtctaatgtttacagtggggttttaaagtctcccattattattgtatgggagtctaagtctctttgtaggtctctaagacttgctttatgaatctggctgctcccgtattgggtgcatatatatttaggatagttagctcttcttgttgaactgatccctttaccattatgtaatggccttctttgtctcttttgatctttgttagtttaaagtctgtcttatcagagattaggattgcaaccctggcttttttttgttttccatttgcttggcagatcttactccgtccctttattttaagcctatgtgtgtctctgcacgtgagataggtctcctcagtacagcacactgatgggtcttgactgtatccaatttgccagtctgtgtcttttaattggagcatttagcccatttacatttaaagttaatattggtatgtgtgaatttgatcctgtcattatgatgttagctggttattttgctcattagttgatgcagtttttttcctaggctcgatggtctttacaatttggcatgtttttgcagtggctggtaccggttgttcctttccatgtttagtgcttccttcaggagctcttgtaaggcaggcctggtggtgacagaatctctcaatatttgtttgtctgaaaaggattttatttctccttcacttatgaagcttagtttggctggatatgaaattctgggttgaaaattcttttctttaagaatgttgaatattggccctcactctcttctggcttgtagagtttctgctgagagatccgctgttagtctgatgggcttccctttgtgggtaacctgacgtttctggctgcccttaatattttttccttcatttcaactttggtgaatctgacaattatgtgtcttggagttgctcttcttgtggagtatctttgtggcgttctctgtatttcctgaatttgaatgttggcctgcctcactaggttggggaagctctcctggatgatatcctgaagggtgttttccactgggttccattctccccgtcactttcaggtacaccaatcagacgtagttttggtcttttcacatagtcctgtatttcttggaggctttgttcatttctttttactcttttttctctaaatttctcttctcttttcatttcattcatttgttcttcaatcaatgatactccttcttccacttgatcaaatcggctactgaagcttgtgcattcgtcacatagttctcttgccatcgttttcagctccatcaggtcattcagggatttctctacactgtttattctagttagccattcatctaatcttttttcaaggtttttagcttctttgcgatgggtttgaacatcctcctttagctcggagaagtttattattacccatcgtctgaagccttcttctcttaactcatcaaagtcattcccagtccagctttgttccgttgctggtgaggagctgcgttcttttggagggggagaggcgctctgatttttagaattttcagcttttctgctctggtttctcccatctttgtggttttatctacctttggtctttgttgatggtgacatacagatgaggttttcatgtggatgtttattcgttttccttctaacagtcaggaccctcagctgcaggtctgttggagtttgctggaggtgcacttcagaccctgtttgcctggatatcactagcggaagctcagttggaaatgcagaaatcattcgtcttttgtgtcgctcacgctgggagctacagactggagctgttcctatttggccatcttggaacctcctccgtgactgcttatctttaagccctggtttcctcatgtataaagtatggatattagtattatcttccccttggggttggtgtagagtgaaatgagacaatatgtagaaagtttttaatacgatgcctggagaagggagttttgtgacagttggaatgatgacagcagggaatgactttgtatcatatagtttgttcacaagtaatgatcaattgaatgttttcaaatggaaagtaatatttagagttcaacaaatattgaagaagagaaaggctgattttgattgcatgtcatgaggaatttttaatcactgacatagtttgaccaaattgtgtattttaactttgtggagtttcacagggaagttccaagtaaagctagaaataaatactctttaagggcactgtagttctttaacttaactttgtattccattgacattttcattactatcctgtaactctgaacttgactgtcctcatcattccttgcctttttacctggtggaagaagagggaggagattttactgcaccttctctgccatgctcgattgcatgggaatcccatcatagttcatattcagccactgaccgtatcaactttggtccttcattgatttagtcttcctaaaacacacagagaagtaaatccttgttctctgtgtcatcaggggctgatatcagcgaggaagatgaagaaaattaaaaaaaaaagaaagacttgataaaagacacacaggcagagctggtgtggaaacccattttccttcttacctgcctgttactcaagattttttcaccttaggtccaagatgctgcctgcagttctttgccatgtggcttcttccatgggcagttcacagcatgacattttgcttcttttttttttaagatggagtcttactctgtagcccaggctggagtgcagtggcgcaatcttggctcactgcagtctccacctcctgggttcaagcgattctcctatctcaacctcctgagtagctgggattataggcgcccaccatcacgcccagctaattttctttatttttagtagagtcggggtttcaccatcttagccagactggtctctacctcctgacctcgtgatccacccacctcggcctccctaagtgctgggattacaggtgtgacccaccgcgcctggcctgacactttgcttctttaaggtcagcaggagattgtcattcagtctgctaagataaaagtcttatataatgtaatcataagagtggcatcccttcatctttgctgtattctcctggttatatatcagtgagctagaagtagatgaaacttgcttctgagctatggaagatgctatctctctagaggaccattcagatttgaagatgttaggtgccaaaataatgcactgaagtatgatgattccctttaactttattgaaacaactttattaaaagtttcgtaacctctacttgccacacttctctgcccaatatacgaaaacatgattaaggccctaactatctgaaattattttcctaagaggtaaatagaggtctgtttatgcctgttgtgctacctctgcatatgtgtatttaagcttttcaacaaaacaggaacatttcatgtatgtgtttttgtgccttggacattactcttaaatacagaagggtccattccttctgggttctaactcttactttcattctgaaggaagtttccctggggtctgaccttcaggagcgtggtgataatgtgacaagattttgggacaatatctgaagagcttgatagactccttggtgccccccacttaatagctgaatggctttgggcaagacagttgagcgtctctgaatcagatgagttttcttataaagtgaggataataaccctcacgtaagataacttatagttcaggtttatgtgtcatcagtggcctgttagaaagaacttgaacttcagtgtcagagagttatgaattggaatcttggttctgtaactatgtgactttttcaagttacttcttttttttttttttttgacacggagtttctctcttgttggccaggcttgagtgcaatggtgcaatcttggctcactgcaacctccgcctcccaggttcaagcaattcttccacctcagcctcctgagtagctgggattacaggcatgtgccaccccgcctggctaattttatatttttagtagaggtggggtttctccatgttggtcaggctggtttagaactcccgacctcaggtgatctgcctgcctctgcctcccaaagtgctgggattacagtcgtgagccaccgcacccggctcaagttacttttaatctcagtcttggttttcttggtagaaaaatgggataatccttacattgcagtgttgtaaggatcacaatgctatatataaaataccaattacagtgcttgacgctgtagtaggtgttcagtagatgaatgacggtggtattcatttgtctaccactatttccaacctagtctttcaggtccctggatagatgagatctccccattcccacatcatcttggccaaaatttcaacctctgtcctaggtcagactgttcagtcagccacgtgaatcactgttgtaaagatcctttggatctatatgtaggagctgttagtcatttctcagcactgagatacagtctccatctcagtctgcttatttgagttccttttcttttggtgatcttctgaggtctagatatctctatacacctacaatttcacttatcaattattacatctttccaaaataaaccaaaaaacaagaaaaatctccaatagtatcaggactcaaactgctattgtatcatttactattttaacagacctcaaatcatctaacgtgaagccacagacatcttgggcaattttaatcatcaagaaagaaatatgtcattaagaaatagcagggtattttgaaagagttggaaaacatcatgaatttgaatacttcaagtaatactggtgatacccaaaggtaagcctctagtctcttcttttagttgatgaacgtttttagttgcaaggaacagggagaagtcagtggttgtagagctaactgtaagaattctcatgggatggtaaggggagtagaaattctgtgggactgaaggagcatgaatgaagcctcataagaattggaactgattctagagactttatggggattttgtgctcctctgttaatttggaccacaaaagtctgtgtgtctgaactttgtcctgttactagagacttgcttgttcttttccactactttaaatgtttcccttgtattttttatttatatttctgttttgttttctttaacctctgtggctttaattcctctttcttcattggcccagctctaattcatggctactgcttaagcattcatttagtcttagctcctgttgctgtttcgcttccttacttggtatctctcagtttacccttcaagacgtaacgcctaattgctgttgctcatcttttttgtaccattgatttctgcctttgggcgtggcgcctacctttagttcattcacctttggtgggtggagtctataatacaaaactggaccacatagggcagtgccactctctcctaagtgtgctttacaaagaaataagtactgaaattaaaagtaaatgtttagaaacttttatagtcatgtaacagagtaatattctgtctgctgaatctaagagtaaaacatttggggttgtattctgtctgtttttaaaatttctttaaaaataatgcattaaatgtattttacaaaatcatcatggatggggtgaagatagtccttcctcatatttagtttgagaaggactgatctagactgccttttcagcaaggatgtgtgggtgggacaagtaccaagactaacatgtaatttacccgtaaatttgttttccacttagcttttgaagctacccaccccccacttttttttttttttttttttgagacagaatcttgctctgtcgcccagattggagtgcagtggcatgatcttggttccctgcaacctccgcctcccgagttcaagtgattcccctgcctcagcctcctaagtagctgggattataggcgcctgctgccacgcctggctaattttaaatatgtatttacaaattagaatatttcaccttatttagtatcctgctttttcaattttggggaaacttcttaccacatcaatgtatcaaagtttttaaatttttctgaagtggggtcttgttatgttgcccaggctgtctgagaactcctggcctcaggcaatcctcctgcatcagcctcccaagtagctggaactgtaggcacgcaccattgctccggcttgtcatcatttttaatggctgaattactttttataattagagaatctggatacagttatttaaaatctgctactaatctactttctgtttctatagatttgccttttttgaacaattcatgtgaatggaatcacataatagatggtcttttgtggcttcttttacagggcatattcctgagttttgtaaagttgtaacacgtagcagcccttcgtttctttttattgctgattgtattccattgtatggatatgccacattatgcccatctgccagttgacagacatttgagttgtttccactttttgggtactatgaataatgctgctgtgcatgtttgcatatgtctttgtgttgacatatgtttttgtttcccttaggtagattcttaggagcagcaatgctgtatcatatagtaaatttatgttaaaattttcaagaaactgccaaattgtgttctgaagtggctgggtcattttatattatcactagcaataattgagggttttaatttctctataacctgaccaatactggtttttatctatttcaatttagccattttggtgagtgtgaagttatatgttattgtggttataatttgaattttcctaatgattaacgatgttgaacatctttgcatgtgctttttggtaattcatgtatcttcattggtgaaatgtctcttcagatctgtttatttttaaattgtgttttttttttttatgttattgagctttaggagtgtttgtatatttggaatgcaagtcctttatcagatacatgatttgctggcctggtgcagtaactcatgcctgtaatcccagcactttgggaggctgaggtgggtggattgcttgagcccaggagttcgagaccagcctggccaatatggcgaaaccccatctctacaaaaaaatacaaaaattagccaggcgtggtggtgtgcctgtgtggtcccagctactccagaggctgaggcatgagaattgtttgaagctgggaggcggagattgcagtgagcctagatcatgccactgtacttgagccagggtgacagagcgagactttgtctcaacaacaacaacaacaaaaaataagatatatgatatgcaaacatttttctcctgtttagtggcttgactttttgttttcttaatagtgtctttggaaatgcacaagtttttaactttgatgaagtccagtttatcagttcttttcctataggagttgtgcttttggttttgtatataagaaatctctgactaacctaaggtcatgaagatttttcttctatgttttcttctagaagttttataattttagctcttatatttagtgctctattttaagttactttttgtacgaggtaagggtctaaatttgtctctttgcatgtgcgtagccagttgttccagcagcgttgttgataagagtaacatttccccgttgaattgccttgatacttctgttgaaaattacttaactatttaagtataggtttatttctagagtcttaactctgatatattgatctacatgtcctttttttttttttttttgaggcagagtctcactgtgttgtcaaggctggagtgcagtggcgtgatctcactgcaacctctgtcccccgggttcaggtgattctcctgcctcaacctcccgagtagctgggattacaggcacctgctactgtgcccagctaatttttgtatttttagtagagacggggtttcacaatcttgggcaggctggtcttgaactcctgaccttgtgatccaccggcctcagcctcccacagtgctgggattacaggcgtacatgtctgttcttaatccaatatcacattgtcttgattactgtagctttatagtaagttttgaaattaggaatcaaaagttttcccatttgttcttcaagattgttttggctattttgaattctttgtctttccatatgaattttaggatcagcttttcagtttctgcaaaaatgtctgttggggttttaatagggattatattgaatatgtagaataatttggggagaattgccattttaataatattgagttttccttacatgaatgtgagtatggtggaatgtctttccacttgtttagcttttcaactcctttgaacaacattttgtatttttcagtgtaaaaatctttcactattttttttttttgagacaaggtcttgctctgttgcccaggctagagtacagtggcatgatcttagctcactgtggcctcaactcctgagctcaagtgaccctcctgcctcagcctccttagtagctaggactacaggcatgtaccaccatggctggccaattttttttatttttgtagagacaagatcttgctatgtttctcaggctggtcttgaactcctggcctcaagtgatcctcctgccttggcttcccaaagtgctggcatcaggcatgagccaccatccctggccttgcatttcttttgttaaatttattttattctttttgatgctgttataaatggaattgttttcttaattttgtttttggattgttcattactaggatatagaagtataattgatttttgtttattgatcttgtattctgtgaccttgctgaaattgattttagttctagtctgttttttcttagtggatttctagaattttctttcagaatcatgtcctttgtaattaaagacagttttacttcttcttttccagtatgcatgccttttatttcttttacattgcatgattgcaccatctacatctccaatacatctttttttttttttttttttttgaggcggagtcttgctctgttgcccaggctggagtgcagtggcgcgatcttggctcgctgcaagctccgcctcccgggcttaggccattctcctgcctcagcctccggagtagctgggactacaggtgcccgccaccacgcctggagaattttttgtatttttagtagagatggggtttcaccgtgttagccaggatggtctcgatctcctgacctcgtgatccacccgccttggcctcccaaagtgctgggattacaggcgtgagccaccgcacccagccttattttttgactttttgataatggccattctgactggtgtgagatggtatctcattgtggttttgatttgcgtttctctaatgatcactgatactgagctttgtttcatatgcttgttggctgcatgtatgtcttctcttgaaaattgtctttttatgtcctttgcccactttttaatgtttttttttcttgtaaatttgtttaagttgcttatagatgctggatattagacctttgtcagatgtataatttgcaaattttttttcccattctctaggctgtttaaactgttgatagtttcttttgccacgaagaagctcttaagtttaattagatcccattggtcaatttttgcttttgttgtgattgctttaggcatcttcgtcatgacatctttgcccattcctgtgtccaggatggtattgcctaggttgtctttcagggatttttatagtcaaacatatttgttagtcttttgtataaaacctatttatttctctctagactttggaggaactacttttttgttccttgttttctgaaatttccatgcatttaacctgggctcttttaataggccttttcggtttgaaacttatatccttcggaatccgcctatttccatggatttgtttctgtaatagtttcctcccattcagagagacattgtagtgcagtggttaagaggatatatcatggagccagggtttcagggtttgaatttcagctctgcctctccctcactagccctgtgaacttgggtaatagggggtcataaaagtaccaatctcatgagattattgtgaagaataaataagtttatatatgtaaaatgcttagaacaatgcttacaaaataacaagactatttaatgttataaatttattgtttttcattctgcacctttttttagattttgaacttcttggacagtcttctaatttaaaaaattttctatttttcggccgggcgcggtggctcgcgcctgtaatcccagcactttgggaggccgaggcgggcggatcacgaggtcaggagatcgagaccatcctggctaacacggtgaaaccccgtctctactaaaaatgcaaaaaattagccgggcgtggtggcgggcgcctgtagtcccagctgctcgggaggctgaggcaggagaatggcgtgaacccgggaggcggagcttgcagtgagccgagatcgtgccactgcactccagcctgggcgacagagcgagactccgtctcaaaaaaaaacaaaaaacaaaaaacaaacaaacaaaaaaaaaatttctatttttcatctccatctctttttttgctttattttctgggagatttttcttttatttttatttgtttagtttttcgttttcttagtttgtgtttttgattacttttctttttcttttcttttttttgagatggagttttgctcttgttgcccagggtggagttcaaaggtgtgatctctgctcactgcaacctctgcttcctgggttcaaggattctcctgcctttgcctcccaagtagctgggattacaagcatgagccaccacatccagctaattttttatatttttagtagaggcaggatttcactatgttggccaggctggtcttgaactcctggcctcaagtgatctgcccgccacagcctcccaaagtgcttggaggccaggcgtgagccactgcacctggctgtttttgattttttaagagctgttttttttttctctgaatatttcatttcctattgcagtcatggatgtgacatatggatgatatactcctattttttttagtagacaatgttagttttttttttcccctcttctaagttgtcatctttctgcatagtctttcaaggcatgcttcttttctatgcaccatatttttggtctctgcttatcatattagatgcttattaaacttttggtgattgttggctgtctgcttatattgaaaagtaggggcttaacctaaaaagatgactggaagctcagtgtgtgagactttgtgtttgtggcatgctctgtagggttatatggttaagctgtttttctagagaaccactggcatcagtatctttaggtatttttcacctggttgcttaggttctgtagggaagacacttccaatttctgcttgactgccatcgttctggcaagaacattctggcaagacaagtagtgttaaaactctagagcgctctttccttatataacttttaactcaagcttcttgtatatagtatgaaaaacttaggtcatttgtatctaatgtcttctgatccagagaccgtctgttttatcctctccagggaataaacccctagtgtttttctgccagactgggaaagagataggtacccagttgtgtggtataggggatggggatctgaggatgtaattattttgttggcagactttcaaataattctcctgttttctgctctacttttacctccattttcaaaggtgttgccaattactgagcttttgggggttatcagttaccacttgtccacatgcatttcagcttccagtaattggttgctattatctcatcttttgtgttctctctcttgtgagtttatacctctaaattctgtttgctgttattttaatttttaatttttatttttgggagagagtagggtgctttagtctgacatttttctttttgtattatgtattacatttgcagtaaacaaaatgtattatttacaaagaaaaaaagtgggagaacccagtctcttccaaaattatccagcttgtgatatgatcagacaatttaagtagcaatcttgaataatgtggtaatttcccattagacagtggtttgttgctaggtatctatctatatatatatactactttgtatttctacatagcttttgcagtggacatcttttactagattgtgaactctaagtcaagaaccatgtcatgttctctttgttttttgaaaaataagttatcaaaaatatcagaaatgctctgaaatgtgctttatgagaagcatatacattttactgtaatctcattttaaaggttgaagattgcctcattggatgtaaaacaaatacttaaaaatgaaacagagttggatattactgataatctcaggaagaaactccattgggctaaaaaagaaaagttagaaataacaaccaaacacaatgcagaggtacgatttattttcctctcaaataatgttaaaagttgagtttgattttttagatttatttcatatgaaaaactccatgtttaacctttataactataccattcttgggcttaaaaaggaaattgtaataaaggaaacataattttaaaatgtagtgtaattgcataagtgttaaagtagaactttaatgaattatgtttatttgtatgttatcttagatttattttaattaatgggttcaattgattaaaattatttatgaacatgtttgatgattaaaggatttgtaaatcagacatttttgaaatcataatgtaggttcctttaaggtctccattatggagcaatctctttaagtaaatttgagtatggaatttttaatcatagttcagttcataaattgtcttagtttataagtcattatttcttttattagtatgtatgtgtgtgtatatatatttcatatgtatatgcatatagtccaagatagttttccttcccttctaagataattcatgagtcatatctttatgcctcttctctctgctgtgttttttctccttttttctctgataagtcttatttattcttaaaactcagtttaggccacctggtatagtgggaagaatatcaaattacacagagctcaatttattcctggcctttccatttacaagatgcgtcatcttgggctactcatttatcctgtacaccattggtttctcattgtgaactgctggtcccaaagggttgttgtgataattaagtgaaataaaatttggaaagtgcttgtgtactgtaatagctgtaatttattgacagttaagtgtaaacagtatgtttttcttccctttttgctaagttctgcagttctcatgttgggaaaccttttaatgtctctctaagtgaaactggctactactttgttcttccacaacatgttgctgttatagatattttagaactaaaacatttatatcatgctttcctgctcttctttagtttgtaaaccccctgagagctgaaaacagtgatcacactttgtctccatattgcttatgtttactggcacataataggccgtcagtagttgtgtattgaataaatgtatgaaaagggccaggtgtggtggctcatgcctataatccaagcactttgagaggccaaggtgggtggatcacttgaagtcaggagttcgagatcagcctggccaacatggtgaaaccccatttctactaaaaatacaaaaatcagctgggcgtagtggcacacacctgtaatctcagctacttgggaggctgaggcaggagaatcgcttgagccctggagctggaaggttgcagtgagctgagatcgtgccactgcactccagcctgggcaacagaggagagtatgaaaagatgatttttttcaggatatctaaggagcagtggtattgctgattgaaataacaagagatgaatacataataattctctttgtatttttttagtagcatttgaggtaatattattatcataatttttctttttttgagacgaagtctcgctctgtcacccaggctggagtgcagtggagcgatctcggctcactgcaaccactgcctccaggttcaagtgattggagaatcacttgcctcagcctccccagtagctgggactacaggcacgtgccaccatgcccggctaatttttgtatttttagtagagatggggttttaccatgttggctaggctggtcttgaactcctcacctcaggtgatctgcccaccttggcctcccaaagtgctgggattacaggcgtgagccactgtgccccgcccaattgaggtaatttttaagtgataattgaagtaattgcttctatttacattgtaataatcatataaagtggtatgtgttaaatgtgtgctaattattcataaactctaaaacttgtttttttaaaaccaaatgcacattttacttgagagtattagtgtgatgataatcattactctattaaataaattctctcacagccaggtgtggtggctcatgcctgtaatcccagcactttgggaggccaaggcaggaggattgcttgtgcccgggagttcgagaccagcctgggcctgtgagtgagaccctgtatctacaaaaaataaaataaaaataaatatattctttcataatatgtttatagttgtcattagatttctcagcagaacacactgttctcttttatttgatcaaaatgttttgaagtatatgttcacattaaggagatagaaattatcttagggaaggaatacagttttcttaaaacaggaaattataattggttcaactccagatttatattactaattattattttttcaattatttcttttctttctctttttctttttttttttgagacagagtctcactcagtctgttgtccaggctggagtacagtggtgctatcttggctcactgcaacctctgcctcccaggttcaagcgttcctcctgcttcagcctcctgcgtagctgggattacaggtgcctgccactgtgcctggctaatttttgtatttttagtagagacgggatttcaccatcttggccaggctggtctcgaactcctgactttgtgatccacccgccttggcctcccaaagtactgggattataggtgtgagccaccgcgcctggccaaatttttgtatttttagtggagacggagttttaccatgttggccaggctggtcgcgaactcctgacctcaagtgatccacctgtctcgacctcccaaagtgctgggattacaggtgtaagccattgagccactgtgcctggccttcaattatttctttagatgatcatacttgtattatgtagttaaattttttagccatataatctccaactgtacgcatcaggaagcaaggcagagaggaatgcagtgatttaaaaactaaggccatatttgccttatcaggtattcctaatgcgaacacaaatgcacggtgattggcacaaaatatctttaaagacttctgtaggagttttattgttggaggatcttgggcaagttaatttatttttctgagctacaggtttctttgataggtattcaaataatagattactgttgaaaggatttattagtagacagagggtacagggagaagaattgcttatagactcatacgttccagatgagactgaattgcattgatgtaggtgattgggatgggaaaatactgtaaggtttttagaatcatttgagcgtaacaatactgttgtggaaaataggacaagaagaccgtgaggctattcagatatctcattggcccagatagtgataacagagcaagaaaatccagataaattagaaagagagagggtaaaggagagtgacataactacttttttttttttttttttttttttttgaaacagggtctcgctctgtcacccaggttggagtgcaatggtgtgatcttggctcactgcagcctggtctcgaactcctggactcaagtgatctcctacatcagcctcctgaggagctgggactacaggcacgcacgtgccaccatgcttggctaattttttgtatttttatagaggtgtggttttgccatgttgtccaggctggtcttgaacttctgggctcaagtgatccacccaccttggcctcccaaagtgctgggacaacaggtgtgagccaccgtactcggctgacataacttcttttagccaaaaaatactggaaacttaggactaatcagtaggctttatggcttgaagatattgtctgacccagccagtactcttgagagcagggattcttaagctggagtcctcagagaaatcagggaatctgtgaacatagatggggaaaacttataattttatttttattaacctctaactgatattaagcatttccttcagttctgaaaggcttgacccagccagtcctccttttaacaagtcatagtagtgttagcagcacttttgagtatcatcaatagaaatcacagatacatatcacattttagaaattatagttacaggatgggtgccatggctcacgcctgtaatcccagcactttaggaggctgaggtgggcaaatcacttgaggtcgggagtttgagaccagcctggccaacatggcgaaaccctgtctctactaaaaatgcaaaaattagctgggcgtggtggtgcgcacctataatcccagctacttgggtggctgaggtgggagactcacttgaacctgggaggcagaggttgcagtgagccgagatcatgccactgtactccagcttcggcaacagagcgagactctgtctcaaaaaaaaaaaaattatagctacatatatatcatatttcagttgtgtgtgtgtgtgtgtgtgtgtgtgtatatacatgtatatatatttgttgttttaaatctttttttagagacagggtcttgctctgttgtccaggcttgcatgcagtgatgtgatcattgctccctacagcctggaactcctgggctcaagtgattttatgctgtagcttcccaagtagccaggactgtaggtgtgtgccatcacacctggctaatttattattattattatttgtagacatggggtcttgctgtgttgctcaggttggtctcaaactcctagcctcaagcaaccctccctcatcagcctctcaaagtgctgggattgcaggagtgagccaccgcacctggccagcattttaattttaagtaatgtactttgtgcccttgaagaggatgtagtcaaggaaaagggaggcttggtttgcacaaaaccactcccgtgttcttaagtgtttgtattatgccaggaaagtgctagtattttgaccttatgaaatgattgtaggctaatgtcgaattcaattttcagtcagccatccaagcaaaactgttaagagttaacttagagacgatatccacgtcgatcttgtacacgttctccaagttcctgtgaataccagattagcaagagctttcagttcttctgctatataagctatttcctcctggagcagactgcatttttccttctgtagcatactgagatctgagtcaatctgtggtgaacagagcggtgtaggtggctcttgcaaatcctcctgcaaggcagctgcttcaggtgtggtcattactaattctttcagcaaggaaaggctggttacctcagtcagaaaggagaggctgcttttttttggtaaggaatgttcagtggggatttgagagttcatagtttttaggtttgtttaattctgaaagtcctcatcctatgttcttcctacttaatatccagctgatagcatcttaacagaagaaacctggtgaaactcttcattgaacttgtaattttgcatttcccataattagatttccaggtttgttcataaccttatctgccctggggctgtactaaataagcagttattttaaagtcaccataaaaactcgtttttctgactgtcttgaactgagattctaaagctctgagattatcattttgtgtttgtaaattctctagtatagtgagatttaccctttctatccctcaggccttgtagtaaatcaatactggcatcatagttaagtgcgttcattacttcattttccgaaggcttattttcaactggcacttcatcctaaacaactgcacaccataatttaaagaactgtgatcccactgtatgctgtagatcactagaatcccatttctacctgcaaagaggctttcactgtgttcaggcttaaatatattagccagccaatattataaacccatcttgagacaatttctgataccaagagcaatattactgggtgtttagttaggaaaacagaaaccattctaagtcttaaaacaaagggacattaatagcgggtattggttacacaggtaccagaaaagtggaaaagacaactagaggagattaagacaacccaacattaagaactgcttctattcccaaggttgattagagctagaactggacaaagcaaggcccatggaaggagggactatccataaggatttgcagccacaggcaagagagggataactgctcaaggtagatctagaaaggcagaaataacttggcatcttcacttctcctgctgtcaatcattccacatgtgcctctcattgatcaagcctattgagaagccagttgtctctgaccttctgtcatgctactttggaaggatcacaaattcgatattcgttcatttaaatccctgcaaaattggcacttttattactttatgatcagtgatatcataatcaagagaaataatacagacaatatttattaaactatactttgatgcaatttgtttattggttccatttagggaatagaaggaggagaggaaagaatgaatttttaagtgcttagtatgtatcatgcatttttttgtttgtttgttttttaggtatgaatattttcttttctttatttttttttttttagacggtcttgctctgtccttcaggatggagtgcagtggcatggtctctgctcactgcaacctctgcctcccaggctcaagcaatccttccatctcagcctcctgagtagctgagactacaggtgcacaccaccatgcctggttaatttttgtattattattattattattattattattattattattattattattgagacagggtctgcccatgtggcccgggctggtcttgaactcctgggcttaagtgatcctcctgccttggcctctcaaagtgctgggattacaggagtgagccaccgtgcctggccaaggtgtgactatttctgattaaaacgtaatttatctttaattttataaaaagttcttataagattttttttttcctctagtggattctctaaaataaaaaacataatgggtgtcattttgtaaggtagtgctttctttccagtgattcagaatatataaatttataaatttttgccttgtatatattatggaaacaagtttctctaagaaacttaaatgtttgagtgtatgatctcataatctttggacacatgttgatatcaggaatctgtttttagctggcaagctatgagagccagattgccaagctacggtccgaggttgaaaagggagaagcattgcgacaaagtctggaatatgacctagctgttgctagaaaggaagctggtcttggaagacgggctgctgaagaaagattagccgaggcacataggatccaagaaaaactctgtggtaagactgtttctatttcttcccaagtttagggttgtaacctgattgtatatcactcctcgctgttgtgtgtacatcccatacagggtcagaggtaagattctgattcgttgactgacttttgatgtacagacttagctgggtatgtataaaaagtcttctggcaattttgtgaacatttatctactttacattgatttttttatgctgtgcatatatggaaaaaggagttcaaaattctcttaagtcactttttagaagcacttcttccatgaataatcaacagaatcacaaagggatttttgtttgtcttaaacatatactccaggctccccatcacatataatatgaatccaaatctctagcttgagaatctatatgttcaagaagcactgcctctttcattgattttgccaggtttagaaatcactgggctagagtgtggtgcctggaaaagaaaaagtcactggatttaatcttcaaaagctatgtgttatgtagcccttggacttaaataaagcctttctatttacatataatatataaaaataaatgtgcctagatagcgatatcactcataacaagcacccagatgagggaccagaaaatgatcaaaagcccttctacatggatgactactatactggtttttaatagtgtagattaattttgccacttttttgtactttatatgaatggaatcataaagtatatattcttttttttctggcttttttcctccaacattatgtttttgaaattcatgcatattgtatgagagctttgtattgatgtgtagtattgtgtaaacattccacacttatatttatccatttattattgatgggcatttgagtagtgtccaatttttgattattaacaataatgttgctatgaacattcttgtacacagcaggttttaattaagagaacactgaatgtgaattcagatttagatttaggtcctggttctacatggtactggtataaaaacaggcatggagactaatggaacagaacagagtacccagaaataaagacaaatacttacagccaactgatctttgacaaagcaaacaaaaacataaagtggggaaaggacaccctattcaccagtagtgctgggatacttggcaagccacatgtagaagagtgaagctggatctttatctctcaccttatataaaaatcaattcaagatcaaagacttaaatctaagtcctgaaaccataaaaattctagaagataacattggaaaaactattctagacattggcttaggcaaagagttcatgaccaagatcccaaaagcaaatgcaacaaaaacaaagataaatagatctttaaactaaaattaaactaaaaaactaattaaactaaaaagcttttgcacagcaaaagaatagtcagcagagtaaacagacagcacagactgggagaaaatattcacaaactatgcatctgacaaaggagtaatatccagaatctatgaggaactcaaatcagcaagaaaaaaacaaataatcccatcaaaaactgggcaaaggacatatatagacaattcttaaaagaagatatacaaatggccaaaaaacatatgaaaaaatgttcaatatcactaattatcagggacatgcaagtcaaaagcgcaatgagataccaccttactactgcaagaatggccataatttaaaaataaaaaaataacagatgttgcatggatgtggtaaaaagggaacacttttacactgctggtgggaatgtaaattagtacaatcactatggacaatagtatggagattccttaaagaactaaaactggaagcattccctttgaaaaccggcacaagacaaggatgccctctctcaccactcctagtcaacatagtattggaagttctggccagggcaatcaggcaagagaaagaaataaagggtattcaaaaaggaaaagaggaagtcacattgtctctgtttgcagatgacatgactgtatatttagaaaaccccatcatctcagcccaaaatctccttaagctgataagcaacttcagcaaagcctcaggatacaaaatcagtgtgcaaaaattgcaagcattcctatacaccaataacagacaaacagagagccaaatcatgagtgaactcccattcacaattgctacaaacagaataaaatacctaggaatcaacttacaagggatgtgaaggaccttttcaaggagaactacaaaccactgctcaaggaaataagagaggacacaaacaaatggaaaaatacttcacgctcatggataggaagaatcaatattgtgaaaatggccatactgcccaaagtaatgtatagattgaatgctgtccccatcaagctaccactggctttcttcacagaactggaaaaaactactttaaagttcatatggaaccaaaaaagagcccatattgccaagacaatcctaagcaaaaagaacaaagctggaggtatcacgctacctgacttcaaactatactacaagaatacagtaaccaaaacaacatggtactgataccaaaacagatatatagaccaatggaacagaacagagccctcagaaataacaccagacatctacaaccatgtgatctttgacaaacctgacaaaaacaagcaatggggaaaggattccctatttaataaattgtgttgggaaaactggctagccatatgcagaaagctgaaactggaacccttccttacaccttacacaaaaattaactcaagatggattaaagacttaaacgtaagacctaaagccataaaaaccctagtagaaaacctaggcaataccattcaggacataggcatgggcaaggacttcataactaaaacaccaaaagcaatggcaacaaaagccaaaatagacaaatgggatctaattaaactaaagagcttctgcacagcaaaagaaactatcatcagaatgaacagggaacctacagaatgggagaaaacttttgcaatctatccatctgacaaagggctaatatccagaatctacaaagaacttaaacaaatttacaagaaaaaaacaatctcatcagaaagtgggcaaaggatatgaacagacacttctcaaaagaagacatttatgcaaccaacaaacatatgaaaaaatggtcatcatcactggtcattagagaaatgcaaatcaaaaccacaatgagttgtcatctcacaccagttagaatggggttcattaaaatgtcaggaaacaacagatgctggagaggagatgtggagaaataggaatgcttttacactgttggtgggagtgtaaattagttaaactgttgtggaagacagtgtggcgattcctcaaggatctagaactagaaataccatttgacccagccatcccattgctgggtatatacccaaaggattataaatcatgctgctataaagacacatgcacacgtatgtttattgtggcactgttcacaatagcaaagacttggaaccaacccaaatggccatcaatgatagattggataaagaaaatatggcacatatatacaccatggaatactatgcagccataaaaaaggatgagttcatgtcctttgcagggacatgcatgaagctggaaaccatcattctccacaaactaacacaagaacagaaaaccaaacagcgcatgttctcactcataagtgggagttgaacagtgagaacacatggacacagggaggggaacatcacacactggggcctggcaggaggtggggggctgggggagggatagcatcaggagaaatacttaatgtagatgatgggttgatgggtacagtaaaccaccatggcacatgtatacctatgtaacaaacctgcacattctgcacatgtatctcggaacttaaagtattaaaaaaaaaaaaaaagaaccaaaagtagaactaccatttgatccagcattcccactactgggtatcttcccagaggaaaagaagtcattatatgaaaaagacacatgcacacgcaggtttacagcagcacaattcacaattgcaaaaatatcgaaccagcctaggagcccatcaaccaatgagtggataaagaaaatgtggtataggctgggcgcggtggctcacgcctgtaatcccagcactttgggaggccgaggagggcagatcaccaggtcaagagattgagaccatcctggccaaggtggtggaaccccgtctctactaaaaatacaaaaattagctgggtgtggtggcgcacgcctgtagtcccagctacttgggaggctgaggcagaatagcttgaacctgggaggcagaggttgcagtgagccaagatcgcaccactgcagtccagtctggtgacagcgagactccatctcaaaaaaaaaaaaaaaaagaaaatgtgctatatatacagcaaggaatactactgagccataaaaagaacgaaatagtggcatatgcagcaatctggatggagctggaggccattattctaagtgaagtaactcaggaatagaaaaccacttataagtgggagctaagctatgagtatgcaaaggcataagaatgatataatggactttggggactctgtggaaaggacgggatgggggtgagggatgaaagactacacattggttacagcatacactgcttgggtgatgagtgcaccagaatctcagaaatcactactaatgaacttttgcctgcaaccgaacaccatctgttccccaaactattgaaataaaaaataaaatgtgaaaaaaattgtccttgattaaaaaaaaaagtgtttttgttaacttcatggggctaaagaaatgttaagatataattttctttttttcttttttgagatggagtctccctctttcgcccaggctggagtgcagtggtgcgatctcggctcactgcaaccaccgcctcccgggttcaagcaattctctgcctcagcctcccgagtggctgggattacaggtgcccaccaccacgcccggctaattttcttgtatttttagtagagacggggtttcaccatcttggccaggcggatcttgaactcctgaccttgtgatccacccgcctcggcctcccaaagtgctgggattacaggcgtgagccaccgtgcccggcatgttaaggtataattttgtaactgttaagatccttagttttgctcagctgtctggggttattgatattggtcagaagtatttttgattatgtagagaagaaaaagtagtatcttttactcacccatgcaaggtttacaactgacaaccctataacaaaacacaggttaacaagagaaaaccataacaaatttatttaacaaagttttagatgacatgggagcctccagatatgaagacgcaaagaaccagggaaaaccgtatttttgtgttaagtctgatgaaagaagtggatagttgtggagaaatatgactggacaaaagtatatgttccaatgtaataaactgagtgggaaacccagcaagcctgtttgttcagtagcatttctttcttccaggtgatagatcacatgagggccccatgacctactttcagaggtagtaggtcagagaggcgacctttctagattttatatcttgctttggggagaaagaagggtagaagacaggaagtcagagtaaccttccttctgaggccctcctgtcttctgcaagtgaaaaatattcagcataccaagccaccataattgggggtattgtgttctgagccccagtaattacctttggtgtttaataatagttacacgactacctggaatttaggaatataagaattggaaggcactagatatgaaagttcatgactttcatttaaccatgaggaaagtgaagtcctggaaagatgggaagttacttgctcagagtcaaacaatttcaacagacattctacagagtaagatagagagatgactattaatcagaggaaaaatgcgtaacctcacttattgtcagggaaatgcaaatgaaaaccatagtagatgttactaaacacctatcaggtggctctaattgaaaagattgtcaataccaaatattggtgaggatatagagcaacagggactcatattttttgttaatgggagtgtaaaatgatacagccactttagaaaaaaacctggccgtttcttttaaaataaacatggatttatcttatgagccagtggtttcactctttattatttccccatgagaaagaaaaacttttgtccaaaaaagacttgtaaaagaatttcctagcaactccattcatggtggtccaaagttggggaaaaagacattcattaacaagagaatgaagaaacaatttgtgttatataatgaaatgctactcaacaataagaagaaagcaaccactaacgtatgcggtaacatgaatgaatctccaaaacatgcttagtgagagaaactttacactcaagaggacatcctgtatggttccattaacataaagttctaggataggaaaagctaatcattggtgaaaaaaagaatctaaacagtgatggcctctgcagggtgggttggcagtggatttgactgggaaagagtatgagggtactttttgggttgaaagaaatgttctgtattttgataggtgtttgggttacatgaatgtatttattcataaaatctctttgaacattggctcacacctgtaatcccagcactttgggaggtggaggcgggtggatcgcttgaacccaggaattcaagaccatcctgaccaacatagtgaaaccccatctctactaaaaacaaaaactagccaggcatggtagtgcacgcctgtaatttcaactactcaggaggctgaggcagaaggctcacttgaaccaaggagacagaagttgcagtgagctgaaatcgtaccactgcactctagcctggatgacagagtgagactctgtctcaaaaaaacaaaacgaaaaactccttgaacagtacactaaagatttgtgcattctactagatgtacattttatctgtaaaaaaataaaactatattacattctaattaatgatatacatgctgaactatttaggagtgaaatgtcctgatgtttgcaacttgctttgaaatgcataaaatgtatgatggactgctgggtggataaatgaatgcatgcattgaaggatggatgaatatctgataaagcaaatatggcaaaatgttaacaatcctagagtccaggttgtagatatatggatgttcactgcacaatactttcaactttctgtgtttttaaaatttttatagtgaaatgttgagggtagtgtaaaaagcctaatgcagttatgagataatcccataacaatggagagaacagggggtgtgacaagagagaaaattttggaagctggaaagcaaatggatgaggaataactgagttagagagatgttaaaatcctaagtcaggagtggggaaaaccgaaagagaaattcttagtcaaaaggcttataaactggaagcaccagataccattggaattatgtatgggagtagcagtagtgagtaaaataagtagggttagatgaaagctgtttgagaggcagataggtccttagatttccttccaagagcatgctactctgggattacttaagaattgctagtggaagtcaggaggtttaatccctggagatggcgaaatagagtcttttgactggcaaaaccaggaagattctgaatgctgaatattgaggagccattccttccagcttccctttaattaattaattaattattattattacttttagagacagagtatcactttgttgcccaggctggagggcagtggtgtggtcatagctcagtgcagccttgaactcctgggcttaagccatcctcccacctcagcctcctgagtagttaggactataggtgtatgccaccacacgtgactaattaaaaaaaatttttttttgtagagactaggtcttgccatgttgaccaggctggtgtcaaacccttggccacaatcaatcctccaagcttggcctcccaaaatgctgggattacacgtgtgagccaccatgctcagcccccagcttcctttatatattgacttccccaaaagctaacacctggatttctacactctatgccggatgttggaggactcttttgtgtatcacctgaccaagctgatatagtttggctctgtgtcccctcccaaatctcatcttgtagctgtcataattcccatgtgttatgggagggacccagtgggagatgattgcatcattggggtgggtctttcccatgctgttcttgtgatatgggtctcacgagatctgatggttttaaaaatgggagtttctctacacaagctctccttttgcctgctgccatgcatgtaagatatgacttgcttctccttgccttctgccatgattgtgaggcttccccagccatgtgaaactgtaagtccaataaacctctttcttttgtaaattgcccagtctcaggtatgtctttatccaaaaaaacagacgaatacaaagccaggaggaagaacctaatgatactgatgttggaggtttcccaataaatgagccatccagatccttctccagcgaagactaaagttgttaacgtccaccttgaagctcagattctaggtggtgggtatattagtgtataaactgtattacatttatagtttctaacttttaatgagagtagacaaccaagagttaccagatatatgaggaaaccctttaaaatggagagaagaaatcaacttagaagaaacagaggctctgcagggagaacatttaaaagaagtagcattaatttcctcagatctgaaagaatatatttcatctatgaagtaagaaccaggtgttataaaagatgaaatctattagaaattaaaaatatgaggccaggcgcggtggctcacgcctgtaatcgcagcactttgggaggccgaggcaggtggatcatgaggtcagaagttcaagaccagcctgactgatatggtgaaaccctgtctctactaaaaatacaaaaattagccaggcgtggtggcaagtgcctgtaatcccagctactcgggaggctgaggtgggagaatcacttgaacctgggcggcagaggttgcagtgagccgagattgcgccactgtactccagcctgggtgagagagtgagactctgtctcaaagaatttaaaaatatggaagcagtgggaagaagaggcaagaaggacccccggactgaccaaagcccacacgccattgcatccctgcatctggtgctacgtcttagcagcattaccaccatgcccaagagaaagcctgaaggggatgctacaggagataaagccaagctacagagaagatctgcaaggttgtctgctaaacctgctccttcaaagccagagcgcaagcccaaaaagccttctttgcccctgcaaagaagggagaaaaggtacccaaagggaaaagctgatgcttacaaggaggggaagaatcctgcaggaaatggagatgccaaaacagaccaggcacaggaagctcagcgtgctggagacgccaagtgaaatgtgtgcatttttgataactgtgcacttttggtgactatacagtttgaaatatttttcaaccaagttttatgaagatgcagactttttttttttttttttttttttatgagacggagtctcactctgtcacccaggctggagtgcagtggcacgacctcggctcactgcaagctccacctcccgggttcacgtcattcttctgcctcagcctcctgagtagctgggactacaggtgcccgccaccacgcccggctaattttttgtatttgttttggtagagatggggtttcaccgtgttagccaggatggtctcgatgtcctgaccttgtgatccgcctgcctcggcctcccaaagggcttggattacaggcgtgagccaccgcacccagccgtgttttttttttagagctatgttgttgccccacagaaaacgtcgttgttttttgaggaagggacatgtgttactactagaatgtctctgaagtggattgatggggggaaaacacgtttcccttctagttttgagagacttcttcttggcttccaggaggagagattccctgatattgacacacatagccaccttggcacaaacaccttgtggtgtggaaaaacaaatttgtttttatgtcctcttctcccttccatcctcagcatagacttaactcccttaagcccagacatctcttgggattgactcccagtaattggttgccagtgtatcaggcaatctggactttccaatgacaccactgagatggcactcctcaaaatagcagcccttctgtttctagattgtagatctttagataaatcctgccattttcatttcacttcctaaaagtcagagtctgcttgtgaaaagttgttaaacaacatgttaatgtgaaatgtcaacccccactctaaactctctgttgagaacatcaaatgaggacttcattgggtttatagtggctttctgattttggtagtcctttgaagaagagggtttgaaagttgtatactgttaattgaaatacctgcctacaataccattattgtttgtgaaaaatataattaataaagttggatacagtttggcttgaaaaaattaacaaattaaaaatatgaaggcagaaatgaaaaatgtccctagaagcactggaagatgaagatggaagaaacctcccagaaattagaattaaaaagacagaggtagaaaaataggagagaagagatgaaaaaatttgaggaccaatttgaataatagggaatagtgaaagacgtaagagagaaaacagaaatgtatgataaatcatcaatgaaaataactcaagataacatctcagaactaaaggacatgaattaccagattgaaagagtctattgaatatttaccgttatggaaagaagtagacctactgcaggcatagcattatgaaatttcagaaaaataaagacagagaagattctaaagctttcacgagaaaagaaaaataggtcaaatgcaaaggatcaggagtcaaaatggcctcaaactactttcctgcaatgctggatgagagaccatggaagaatgtcttctggagatggcagctgaatgggagggggacttttaatgtatttccttttgtaccttttatacctttgtattttgaacattttgaatgtatgattgattcaaaatgcaaagaaatataatttagaaatactgctaatatagctgtggcatcttttaacatgtgtttttataaacatttcctcattttatcttcacaaaaacttaactagggacattcttatttctagtgagaatcagagaatcagggaggtttaataagtggcaggtgatggagccagacctggaagcatttccttcttttctaggtgctgaaacagagcagcagtgttagtgtgttgataggtgttggttattgttgaggtaatcgggtaggaggtgagttgcacctaaatctggcaaagtaaatagttacagttctaagggttggggtagtggtttccagcctcagctttgtgacccttgtgtaagatgtgttacaactagtttgttgtcaatagtcaaatataaaaatttgtaatctactctttttaaaaacttgccctatatatcacagtcttaaaaatagatttttttcttctttctttctttctctttctttctttctttctttctttctttctttctttctttctttctttctttctttctttcttcttctttctttctttcttttttctttctttctttctctctttctttttctttcttttaaatctgagaggaggtctccctatgttgttcaggctggtcttgaactcctaggctcaagtgatcctcccgcctcagcctccagagtagctgggattacaggtgtgtaccaccacactcagctggtttgttttcttgaataggacaaaaaccaatagagttgcagctggtgctagaagtgcacctaaacttggatatgccttcagaaatatgtcacactgtttcatagcaaaatcatcattgtctgaaggggaagaagagatcgaaaattatagaatagattgatttagagactgtgagcttttcaagaatttaccggaatggaaaggttttcaagagtttactgtaatggaaaggttaaatgttttatcctaagatcatgctgtaaatgatgtcaactccaatgcctaggttttggggctccttgttatttaattcatggttgtaaatgtacctattattctattcttaatagcacagaattcagaacttcaagcaaagacaaatgagactgagaaagcatttcagacttctcagcaaaaatggaaagaagaatgcagaagatttgaacatgatttggaggaaagagacaatatgatccaaaattgcaatcgagaatatgatttacttatgaaagaaaaaagcagactagagaaaactctacaggtaaaatagtttttataaaggaattttccgatatgtaatattcaccgagatgtgttgtacattacttgaagttatcctggatttccttccttcctttttccttcctccttccttcctccctcccattttttcttttttaggggcatatttgctggtctcttttggagtatattaataggtatactttttggggtgaaaaacggtttgcggtcgctaatcaaaatgttaaaagccaacaaagcacttatatgggcatattgtaagaagctaagaatctacagctctttttgtctagcaatatgaacatttggaattttagaaatatgggccctggattttggtctgaatatacaataaatatagaaaaatatttgtatgtttgatatgagcttcattatctatgtagagcatgttttgtataaacatgatatgtaacatatttaacttctcctaaaattgtgagctatttattccctcattttttgttctctttttactccctaaagtaaaagtgatataaggttgaagttgccagtgacttaaaaggtagattttgagttgtctatatttgccattttttttgaagtaacagtttaaatgaaaaaaaaaaaaaattacatgacaaagccaggtatggtggtgcaggcctgtagttccagctagtagggaggttgaggtgggaagatcacttgaggccaggagtttgaggccacagtataccatgattgggcctatgaatagccactgtactccagcctgagcaatatagtgagaccctgtctccccccaaaaaagcaaaaaaacaaaacaaagaaaaaaaaacggtgataaaaatgttctacctttaccattggtgtaaatggcttttttgaattctggaaatgtgtctttactaaaattaattacacaaaagcatttaaaaactgtaaaagttttcgcacagtcattcccagatgttgtcattgtcagcaaatttacttttgatttcttccacatcagtagtcatagtttgtttcttttgtttactactgtattcttagaccctggaacagtagctggcatgcagaagggctccattagtgtgtgaatgggggaggtttcggtggtaactgatattacaagtccttggatgggcctgtataaccttccccacataaaatgttttggagttatgtggagaggagggtgatggtggcagtatttcttcagccagtcagcttgcacctgaaggtagaagattttgatctgatctcaattagctacttaggagaattgtggtttgattttaggctattggctttttttgtttttatttttatttttattattattatactttaagctttagggtacatgtgcacaatgtgcaggttagttacatatgtatacatgtgccatgctggtgtgctgcacccattaacttgtcatttagcattaggtatatctcctaatgctatccctccccactcccccaccccacaacagtccccagagtgtgatgttccccttcactaatctgcacagagacccttgggacagtttggagttgaatctgagtcactatttagcccttgggggaaaaaaaagcctcaaggctctttgtgaaagctttctttctataagttaggagggtagtatttgttatacagatccatgctaccattgtgtggacatgagaggctttctttctctcgcatgtaaactatagactttttcttctgttaatgggaacttaattttaaaccctatagttagaaaattgggcttctcagcaaattgcattttatgtttttaagatactaaaccgaattagatcttgcagtacacctcagaaaacccaaaaggaaagcattttttcaagtattgtttatctatagaactagaaattaaagtccatacttaaatttcttgtttttttgcttttcaaatttttaacattctagagtttccttatcctaatttgttgcacagaattcttttctttgcccctttttcccttttggaaatacattgctcgtgtcaaatttatatataaattatcagggataatccaaatgttttgatcacaggtagagatttccatattaaatggaatctactttgtttatatctatcatatgatatcatatattgatattttgttcaaacctctgaagttaacatttttcagaaaaattgggtcaaatatatccctatataataaacaggtatatacagcctgttgcttatatatacatattatatataggtaataggtaaatatatgcctatataaacaaggtataatctgttgtttaaataaacatagtttctcagatctacattctattgatcaaattatagttttattaatgattttaacatgaattatgatgagttttaacatctataggtaaggagagcctctttgtacatttaaactggggatgaaggaagataacttttattgatctaacagtaaagcaagattttatttatataaaggaagcgttggaaaaacatcaacgggagaagaatgagatggagtctcatatcagggagacagcattggaggagtttagattacaagaagaacaatgggaagcagaaagaagagaattacaatttatagtacaggtattttaaaaataatcagttccttaaatatatatttttaatgcttatgatattcaaaattacattagtgggataactgactcgctcaaagggaaaataatttctagttttgattctggaaggccacatttcatttgctgttacatgacaatagggcaactgttaccaacagataccattagtgtttagagttcagtgatttccattgcataccttatgtgatttttaagaaggatgtatatatatttggtattttatttttccaatttaaaatttgagactaatagctgttttgaataggacaaagaaatagaataataggattctggatgttaaagaatccttacaaatcatatagtgtagtaatttttgaactctttttaagaagtacaaattcttaattatcctctattcctccacccctgaaatacgcagaatccccgaggcttctatagtccaatttgaaaattactgattacatctaatcccctttatacatgagcagatggagatttggaagttactgacttaggttatagactgaatgattaatctgggaaaaggctgcaggtctctgaattctcactccagtgtactttgcattttttcaggagattatatgtatttattttgaaggagaggtaggagaaactcaaactagtgtgttgtgtgttttaaaggaaatttgtgaaggtaatcctctttaagaaaaaaacccatgaatcaactaacttaaaacttcaaatacattttcagcacatcttctagttattttgtgataacacaatgtgttttatgtattttttcgacacagaatgacaaattgaaataacctttctatagatgtcaaagatatgcatttttcacaagaatgaaaaatatccacatataatacattttggagtaattatgtctcacaaacaactttgtaacacagaagttgaccaaaaatatgcagagaatagaagccacttaatttttttttttaattatactttaagttttagggtacatgtgcacagcgtgcaggtttgtttcatatgtatacatgtgccatgttggtgtgctgcacccattaacttgtcatttaacattaggtatatatcctaatgctatccctccccgctcccctgaccccacaacaggccctggtgtgtgatgttccccttcctgtgtccatgtgttctcactgttcaattcccacctatgagtgagaacatgtggtgtttggttttttctccttgcgatagtttgctgagaatgatggtttccagcttcatccatgtccctacagaggacatgaacttatccttttttatggctgcatagtattccatggtgtatatgtgctgcattttcttaatccagtctatcattgttggacatttgggttggttccaagtctttgctattgtgaatagtgcctcaagaaacatacatctgcatgtgtctttatagcaacatgatttataatcctttggtatatacccagtaatgggatggctgggtcaaatggtatttctagttctagatccctgaggaattgccacactgacttccacaatgattgagctagtttacagtcccaccaacagttaaaagtgttcctatttctccacatcctctctagcacctgttgtttcctgactttttaatgattgccattctaactggtgtgagataggtacctcattgtggttttgatttgcatttctctgatggccagtgatgatgagcattttttcatgtgtcttttggctgcagaaatgtcttcttttgagaagtgtctgttcatatccttcgcccacttgttgatggggttgtttttttcctgtaaatttgtttgagttctttgtagattctggatattagccctttgtcagatgagtagattgcaaaaattttctcccattctgtaggttgcctgttcactctgatggtagtttcttttgctgtgtaggagctctttagtttaattagatcccatttgtcaattttggcttttgttgccattggttttggtgttttagacatgaagtccttgcccatgcctatgtcctgaatggtattgcctaggttttcttctagggtttttatggtttcaggtctaacatttaagtctttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatggttgtagatgtgtgctattatttctgagggctctgttctgttccattggtctatatctctattttggtaccagtaccatgctgttttggttactgtagccttgtagtatagtttgaagtcaggtagcgtgatgcctccagctttgttcttttggcttaggattgacttggcaatgtgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttattttgttgagcagtggtttgtagttctccttgaagaggttcttcacatcccttgtaagttggattcctaggtattttattctctttgaagcaattgtgaatgagagttcactgatgatttggctccctgtttgtctgttattggtgtataagaatgcttgtgatttttgcacattgattttgtatcctgagactttgctgaagttgcttatcagcttaaggagattttgggctgagacgatggggttttctagttatacaatcatgtcatctgcaaacagggacaatttgacttcctcttttcctaattgaataccctttatttccttctcctgcccgattgccctggccagaacttccaacactatgttgaatgggagtagtgagagggggcatccctgtcttgtgccagttttcaaagggaatgcttccagtttttgcccattcagtatgatattggctgtgggtttgtcataaagagctcttattattttgagatacgtcccatcaatagctaatttattgagagtttttagcatgaagggttgctgaattttgtcaaaggccttttctgcatttattgagataatatgtggtttttgtctttggttctgtttatgtgatggattacgtttattgatttgcatatgttgaaccagccttgcattccggggatgaagcctacttgatcatggtggataagctttttggtgtgctgctggattcagtttgccagtatttttttgaggatttttgcattgatgttcatcagggatattggtctaaaattctctttttttgttgtgtctctgccaggctttcctatcaggatgatgctggcctcataaaatgagttagggaggattccctctttttctattgattggaatagtttcagaaggaatggtaccagctcctccttgtacctctggtagaattcggctgtgaatccatctggttctggactttttttggttggtaagctattaattattgcctcaatttcagagcctgttattggtttactcagagattcaacttcttcctggtttagtcttgggagggtgtatgtgtccaggaattcttccatttcttctagattttctagtttatttgcatagaggtgtttatagtattctctgatggtagtctgtatttttgtgggatcggtggtgatatcccctttatgattttttattgtgtctatttgattcttctctcttttcttctttatgattagtcttgctagcggtctatcaattttgttgatcttttcaaaaaaccacctcctggattcattgattttttgaagggttttttgtgtctctatttccttcagttctcttctgatcttagttatttcttgccttcttctagcttttgaatgtgtttgctcttgcttctctagttcttttaattgtgatgttagggtgtcaattttagatctttcctgctttctcttgtgggcatttagtgctgtaaatttccctctatacactggtttgaatgtgtcccagagattctggtatgttgtgtctttgttctcgttggtttcaaagaacatctttttttctgccttcatttcattatgtacccagcagtcattcaggagtaggttgttcagtttccatgtagttgagcggttttgagtgagtttcttaatcctgagttctagtttgattgcagtgtggtctgagagacagtttgttataatttctgttcttttacatttgctgaggagtgctttacttccaactatgtggtcaattttggaataggtgtggtgtggtgctgaaaagaatttgtattctgttgatttggtgtggagagttctgtagatgtctattaggtccacttggtgcagagctgagttcaattcctggatatccttgttaactttctgtctcattgatctgtctaatgttgacagtggggtgttaaagtctcccattattattgtgtgggagtctaagtccttttgtaggtctctaaggacttcctttatgaatctgggtgctcctgtattgggtgcatatatatttaggatagttagctcttcttgttgaattgatccctttaccattatgtaatggccttctttgtctcttttgatctttgttggcttaaagtctgttttatcagagactaggattgcaacccctgccttttttgttttccatttgcttggtggatcttcctccatcgctttattttgagcctatgtgtgtctctgcatgtgagatgggtctcctgaatacagcacgctgatgggccttgactctttatccaatttgccagtgtgtgtcttttaattggagcatttagcccatttacatttaagattaacgttgttatgtgtgaatttgatcctgtcattataatattagctggttattttgctcattagttgatgcagtttcttcctagccttgatggtctttacgatttggcatgttttggcagtggctgttattggttgttcctttccatgtttagtgcttccttcaggagctcttttagggcaggcctggtggtgaccaaatctctcagcatttgcttgtctgtaaagtattttatttctccttcacttatgaagcttagtttggctggatatgaaattctgggttgaaaattcttttcttcaagaatgttgaatattggcccccactctctcctggcttgtagattttctgccgagagatccgctgttagtctgatgggcttccatttgtgggtcacccaacctttctgtctggctgcccttaacattttttccttcatttcaactttggtgaatctgacaattatgtgtcttggagttgctcctttcgaggagtatctttgtggcattttctgtatttcttgaatctgaatgttggcctgccttgctagattggggaagttctcctggataatatcctgcagagtgttctccacttggttccattctgcccgtcactttcaggtacacccatcagacgtagatttggtcttttcacatagccccatatttcttggagactttctttgtttctttttactcttttttctctaaacttctcttctcacttcatttcattcatttgatcttccatcactgataccctttcttccagttgatcgaatcggctactgaagcttgtgcattcgtcacatagttctcttgccatggttttcagctccgtcaggtcctttaaggacttctctgcattggctattctagttagccattcgtctaatcttttttcatcttctttgccatgggttcgaacttcctcctttagctcggagtagtttgattgtctgaagccttcttctctcaactcgtcagtcattctccatccagctttggtcttttgctggtgaggagctgtgttcctttagagggggagaggcactctgatttttagagtttccatttttctgctctgttttttccccatctttgtggttttatctacttgtgatctttgatgatggtgatgtacagatggggttttggtgtgggtgtcctttctgtttgttagttttccttctaacagtcaggacccttagctgaaggtctgttggagtttgctggaggtccactccagaccctgtttgcctgggtatcagcagtagaggctgcagaacagcagatattggtgaacagccaatgttgctgcctgattgttcttctggaagttttgtcgcagaggagtacccggccgtgtgaggtgtcagtctgcccctactcaggggtgcctcccagttaggctactcgggggtccgggacccacttgaggatgcagtctgtctgttctcagatctccagctgcatgctgggagaactgctactctcttcaaagctgtcagacagggacatttaagtctgcagaggtttctgctgccttttgtttggctatgccctgcccccagaggtggagtctacagaggcaggcaggcctccttgagctgcggtgggctccacccatttcgagcttcccggccactttgtttacctactcaagcctccacaatggcgggcgtccctcccccagcctcgctgccaccttgcagttggatttcacactgctgtggtagcagtgagcgaggctccatgggtgtaggaccctccgagccaagcgcgggatacaatctcctggtgtgccgtttgctaagactgttggaaaagtgcagtattagggtgggagtgacccgatttacaggtgccatctgtcacccctttccttggctaggaaagggaattccctgaccccttgtgcctcctgggggaggcgatgcctcgccctgcttcgactcacgctcagtgcactgcacccactgtcctgcacccactctctgacaatcctcagtgagatgaacccggtacctgagttggaaatgcagaaatcattcgtcttttgcatcgctcttgctgggagctgtagactggagctgttcctatttggccatcttggctccacagccacttcatttttttgagagtaaaagctggtagtgaacattggaaattctgaatttgttatatatgtcattattgaaaataccaatgaaaccacagcttttccaaaccttcagtctttgtgcagtgcttttcttcccattacctcttctgtagaatctggaaggacagtacaaccacgctttagacctcttgtattctgtttgtagtttgtgtagttaattagttcattagttcatttactcgttcattcattctctaagtacttactgagttactgctctggatactgaggctgtaaaactgattaagacctggtttctgtcctcgaagatatttcagcgcagagacatgtaaagggagaaaatattgtttgataaaattttaaataaaatgctgtagtgccacagaagagaagttgattagctgtctgggagactaaggaagactttgcagagcctacaggatatttaagttgttgataagtgtcttaaaggctacttggaataaacaagcaaaataaagtaaattaaaatagctcttttatttctaaacactcagccagaggtctaaatttataaaatataattcaaaggcctgtgtataaatatgtggatgatgtgattttggtctcatttccagatcagtcctgtaaatcctaaatgaaacattgtggttataccaaagtttatatgtgaagtactaaaagaatttaaaattaggcatctgtctttcattatgaggtgtacagaaaaatgtgggaatatgctccctagttactacgaacagtaacttgctttgctgcttttgtaaggtaaattttactgtaatttgtaactggaatgtttagaactctgtttctcaatttcttgtcctttttttaattaacaaaagaaaatagcttttccttttatacatcaatcttaagaaactgttgtgactttatgttaaaaaaagttttttaaaaacaacctgagggatagagtgaaattttcttctctgttggctgttgatgggtttagttttacatactataattaggtgttagtatctcatagtgttctctttgtgtagctctctaagagaattcagttttttaaataagttatttttaaaccttctcagtgaaaccccatctttaatagacaaaacttgttataatatttctctcatctgggctttagaattcagacccaccataaaaagaaaatctcaattttatgccatattctttttctttcttggagattggagcactaaatagaggtgtccttctctggaatattaacatgagtgaattcttattggtgttacccaaaaagttacctcattttaagatagtgtttctcatttcttttttttttttttcttttttttttttttttttttttttttgatacagagtctctctgtgttgtccaggctggagtgcagtgatgtgatctcggctcactgcaacctctccgcctcccgggtttaagcgattctcctgcctcagtctcctgagtagctgggattacaggcacgcaccaccatgcccagctaatttttgtatttttagtagagacggagttttgccaggttggcaaggctggtttcaaactcctgacctcaggcgatctgcctgcctcggcctcccaaagtgctgagattacaggcgtgagccatctcgcctagccttatttaatttttttaatttttatttatttatgtatttttttgagacggagtctcactctgtcacccagattggagtgcagtggcgcgatcttggctcactgcaacctccacctcctgggttcatgctattctcctgcctcagcctcccgagtggctgggcctacaggcgcccgtcaccacgcccagctaagttttttttgtatttttagtagagacagggtttcaccgtgttagccaggatggtttcgatctcctgaccttgtgatcttcccgcctcagcctcccagagtgctgggatttattttaagtttttgggtacatatgcaggatgtgcaggttagttacataggtacacatgtgccatggtggtttgctgctcctgtcaacccatcacctaggtattaagctcagcttgcatagctgttttttctaatgctctccctcccttcactccacccttgacaggccccagtgtgtgttgttcccctccctgtgtccatgtgttctcattgttcagttcccacttacaagtgagaacatgcggtatttcgttttctgtccctgcattagtttgctgaggataatggcttccagctctatccatgtccctgcaaaagacatgatttcattcatttatggctgcatagtattctatggtgtatatataccacattttctttatccagcctatcatcgatgggcatttgggttgattccatctctttgctattgtgaatagtgctgcaatgagcatacatgtgcatgtgtctttatagtagaatgatttatattcctttgggtatatacctattaatgggattgctgggtcaaatggtatttctggttctagatctttgaggaattgccacactgtcttccacaatggttgaagtaatttacattcccaccaacactgtaaaagcattcctctttcactgcaaccttgccagcatctgttgtttcttggctttttaataattgccattctgactggcctgagatggtatctcattgtgattttgacttgcatttctctgatgatcagtgatgttgagctttttttcatgtttgttggctgcatgtatgtctttttttttgagaagtgtctgtttatgtcctttgcccactttttgatggtttttttttttcttgtagatttgtttaatttccttgtagattctggatgttagacctttgtcagatggatagattgcagaaattttctcccattctgtaggttgcctgtttgctctgatgatagtttattttgctgtgcagaagctcttaagtttttaattagatcccatttgtcaatttttgcttctgttgcaattgcttatggtgagtttgtcatgaaatctttgccctgccacaagcttttctattgtgggacaggcagtgataaagctttgtttctaaactatcatgcccctcctttgttatttttccagttaatttcacgtatactttatcagtgggattgaaaacatttagaagatgaatatatatgttttcatttttatttcatttccaaaattctatacctcaaccagggaatacagttatcctttccttattcatcgactaaatttggtgtatgtgtctagtgattgaagcatgggggagtttgtgacggtatgggaagtgtagcttgaaaataattccatgaactatagaaagaggaggaagagtagggaggcagtgaagaaagttatcagaccacccttagtaggcatggtctgataggccttaagacaatccagggattggggtgcaacatatcaaaagctgacccagtaagtatgattgtgatgtagtgacaactcggaggaagttacgtgaaaagaaagtgtttttaggaatatccacgtaacagaatagtatgcaaatacacacagaaataagatatgaacatcaacagatggatgcaaaatattaggaatataattttattttgttttattattttatatttttgagacaaggtctcactctgttgcccatgttggagtgcagcgggactatcacagctcactgcagcctttgcctacctcagcctcctttgtatctgggaccataagcatgtgccacgaagcctggttaatttttaaaatttttgtagagatgggggtcttcctttgttgcctaggctggtcttgaattcctgggctcaagtgatccttctgcctcagtctcccaaagtattgagattacaggagtgagccaccacacctggcttataattttatttatgtaacacattaacatatgttgacatgtatgacaggtaaacaccttaaggaagtttaccttaaataatcaagggcagcaaggagcatttcttttcttctggaaaactatgtactggtatcctattaacaaatggcatagaaaaggactctgacactgataactttgttataaaaatgcccctaatttggccgggcagagtggctcatgcttgtaatcccagcactttgggaggctgaggcgggcagatcatgaggtcaggagattgagaccatcctggccaacactgtgaaaccctgtctctactaaaaaaaaaaaaaaaaaaaaaattagccgggagtagtggcacgcacctgtaatcccagctactcaggaggctgaggcaggagaatcgcttgaacccaggaggtggaggttgcagtgagccaaggtcgcaccactgcactccagcctgggcgacagagcgagactctgtcaaaaaaaaaaaaagaaaaaaaaaagtccctaatttagggaaatttaaaagcaagaaagtaagggtcttgcccctttcacctctgatttcgctcctcatgtcaggatatagaagcattacgtttttacataaataaaatgatacacctcaataatattttgcctccatcttttgatgttcataccttattcttttagtatttgcatggcattctgtcatgtggattttcctaacatactgtagcctttcccttacctgtggggcatatgttacatgacaccagtggatgcctgaaactgcagatatgctgtgtttttttctatacacacacatacctatgataacgtttaatttataaattaggcgcagtaagagattaacgatgtaactaataatagaaccatcataacaagatactataataaaagtaatgtgaatgtggtctttctcccactctaaatatcttattgtactgtattcacttatttttggacctaggttgactcagggtaactgaaagggaagatgaaaccgcagataagagggaatattgtatttcagtaatctcttattgatgcacattttatttctttcaaaatttttagctctaattaatgattcactaacattcttgtccatatctttgagcagtcatacaaatgattcttcgtgtaaatgcctagaaatataattgtttcattttcaagcttatggattcacaattatgataaatgttatacaaagcaccagtttatgctctatagcaacaaacactttgtaattgtagaactttgctagccttggggacttagagaggaggaacttgttctgggtctttcaggagataataatgtaatagattaaggttgtagttagctatattgatatattttataagctagaaaagaggagtacatttaactctgatacttttctaactagtgtaattcttcagaattggaacggaactgtattttggattctgagaaatgttgtttatatgagtatatataaagaattatactttttgggctacgtttctggaagatgtggaaagaaagcaagtttattttctaacagccaaatgtagtttcctgtgatattaaatgtcagttcaaaaacaagcctcattttaaaatattttaagttcaacagccccctctagtggaaaaaagaagaacttccctcaatttccagtgtccttaatatgattttatttcacacacacagacacacataataaagatgcaggtagcttttggtgtgattggaaaatatgttctgtaacaaaaattttaaagttacatttatttgggatgaaggcaagtttttctgtaaattgcatgaggtatttttgtagtttttttggattttcttgagtgttacattgcatctcaggattggatgatattgataaagccataaacttaaagcaaatatttgaacatacaacccccccagggatttatatatactcaatgcccaatataacccagcaataccattaatgtaacaaatgctacctagatcatgttagtgtgtgttatgtttactggaactggaaacaaacagtaaattgttatatcattgaagacaattctgagtcacttccccatcctgccacaacttcagccccaaaagaataactgccattctgaagttggtgtttaattttctgtctgtatacattgacagtatattgtattattttagtatttttgttttaggatatatattagaatatcatacaggatgcttctttgtcaaacttatatttttcacttttttttttcttttagacagggtctcactctgtcacccaggctggagtgcagtggcgcgatcttggttcactgcaacctctgcctcctgggctcaagcaatcctcccacctcagcctcctgagtagctgagaccacaggcacgtgtcaccacacctggctaatttttgcattttttagtagagacggggtttcgccatgttggccaatctattcttgaactcctgagctccagtgatccacccgccttggcctatcaaagtgctggtattgcaagtgtgagccaccatgcctggcctgcttgtatttttgaggtttgttaaagttaataaaatagcttctgttcattcagtttaactgctgtataatattttatcttgtgcgtgtgccataatttactcattacctgactgccttgtccattttctgttgtttataacagaatatatgaagctggttaatttataaagaaaaagaatttattcttgcagttctggaggctgagacatctaatgtcaagggactgcatctgacgatggccttcttgctgatgggaactctgcagaggtccaaggctgcacagggcattgcatgctggtgggctgagtgtgccagctcaggtctctctttctcttcttgtaaagccaccagttctactgccatgataacccattaacccattaatccatgattggattaacccattcacaagggcagagctgtcatgacccagtcctctcttaaaggccccacttctcaaaactgtcacatgggggattacatttcaacatgagttttggaagggacacacattcaaaccataacactgacattgagatttaagttctttgcaagtttaaattattacagacagtgattccatgaacatcacatctttttatgtgggtatgtatttagtgcgtataaaatatgtgccaaattgttctcttaagtgggtgtaacaatttcaaagaagagtttctcttcctttacagcctcttggtatttttcagatttaatttcttttgaaataggatatgtgtgaaattgtatctcattcttgcttaaatttccacttccttgacattgaccatgttacgtttattggccattcacatttcttttttgtgaagtgccagcttatattttttgccttttttcttttggatttttgggtatatttttattgattaataggaacttttggctgggggtggtggctcctgcctgtaatcctagcattttaggagtctgaggtgggagaattgcttgagcccaggagttcgagaccagcctgggcaacagagacactctctctatgaaaaaaaaaaaaaagtatatatattagccaggcgtagtggcatatacctgtgatcctggctactagggaggctgaggtgagaggattgcttttgcctgggaggtcaaggctgcattgtcctatgatcacagcccgggctacagagcaagaccctgtctcaaaaaaaaaaaaaaaaaaaaaaaaaaaagagtggtttttttttaaaaaatatatttagtaactaacccttggttatgtatattccttttgcaaacatctttttcttctttgtagagacagagaggcaatttacattatgtatgatgaacagtttaaaattttttttttttttggacacggagtctcgctctgtcatctaggctggagtgcagtggtgtgatcttggctcactgcaacctccgcctcccgggttcaagcgattctcctgcctcagcctcccgagtagctgggattacaggtgcctgccaccatgcccagctaattttttatttttttttatttttagtagagacggggtttcaccatgttggccaggctggtcttgaactcctgacctcaggtgatccacccgccttggcctcccaaagtgctgggattacaggcgtgaaccaccgcacttggcctagttttaaattttaatgtagttgaatttatcagtatatttttttatagttgtgattgttttgtcttagataacccaaagtcataaagataatgcgtatatagcatgagatgggatctaattttgtttttccaaatagatagccaagtgtccctgtactagttattcaattgtctgttcttttaccgcatattgatttatagtgtcatttccatcatacatcaagttcttttatatctaagattttgttcttgggtactctgttctgtttcacttacatgtttgtttctgcatcagtactaaattgctttattcattatacctttagaataagtcttgatatctggtagagaactttcctctgtctttattcttaatattttttaggggtgagggaggggttattcttggctttttacttccctatgtgagtttcaggaatggcttattgtattccatcaagagaccttcctgtaattttgattaaaattggattgcatttatagatcattttgacataaagttgacatccttataatgcttatctcttctattttccatctttttatatttttactcttattttctgagagattttctcaattttatattgcagcctttctattacattttatttcatcttttgggtttttaatttctaagctcattcttgttatttgatgatacctttcttagtatattctccttgtttcatgtttgtaatgtcttaatttaactctttgaggatataagtcatacttattttgaaggtgtttctccccccacccctcccttgatggtcttgtcttcttttcttttctttcttcttgtttttgagactggatcttgctctgctgcaaaggctggaaatgcagtggctcgatcatggctcactgcagcttaaacctcctgggctcggctgggcgcgatggctcatgcctgtaatcccagcactttgggaggccaaggcgggtggatcacctgagatcaggagttcaagaccagcctggccaacatggtgaaaccccatctcaactaaaaaaaaaaaaaaaaaaaaaaaaaaaaaaaaaaaaactgggcgtggtggtgggtgcctgtaattccagctacttcgggaggctgaggcaggagaatcacttgaacctgggaggcggaggttgcagtgaaccgagctggtgccattacactccagcctgggtgacaagagtgaaactctgtctaaaaaaaaaaacaaaaacctcctggtcccaagccatcttcccacctcagcctctcgaatacctgggactacaggtgtgcacgaccatacctggctaattttttctgttctttgtagacacagggtctcactgtgttgcccagtctggtcttgaactcctggactcaagtggtcatcccgccttggcctcccaaaatcctgggattacaggtgtgaaccactgtgcccggcctggtctttattttctctgagtgtttggcttcattttgtagtagcctctgagtttcacatgagaagtgatatattttggatgtgtgtctctgcccaaatctcatattgaaatgtaatcaccagtgttggaaatagggcctggtgggaggagatcatgggggcagatttctcatgaatggtttagcaccattcctcttggtactatcctcatagtagtgaatgagctccacgagatctggtcatttaaaagtgtgtagcgcctccttcctcctgctcctgatctggccatgtgacgtgcctgctcccccttcaccttctaccatgattgtaaatttcctgaggcctccccagaagccaagtgatgccagcatcatgcttcctgtacagcctgcagaactgttagcctattaaacctcttttctttataaattacccattctcacatatttctttatagccatgcaggaacagcctaatacaagaacctttccgcaaatgtccggtgattctagactgtgtgtttatatttaagaatgaggcactaaaaagatgagaagaagctctttggatgtggagcccttgcattgaattagggaaccttacgatgtcttttttcttggcctggtagtttccctagaaagaaatctttccgtctcctccttatattgctatgagtgtaggagtcagtgctcagggcgctgtgaggtctaactgcccactatgcagatgttgcttaatctccttatttttaataaggtgtcttaccccaacccccagttgtgtttgcttttcatatcgtcagaacctcttttgatcaacctctagtttgtaaactccttccttttaccaggatatggagggggatttttcagggagggagctggcagaggcaacccgagagtgtaaagtactggttatagaggcttccaacaatgctcctgtattcatttttactatatagcttggcttcaaggttagctgttttgctagggtctggatgtttgtgtccctcctaaatttgtatgttgaaacctaattgccattgtgatggtattaggaggtggggtcttcaggagattattaggtcttgatggtggaaaccttaagtagaattggtgcctttataagggactgaagaaccagagttcttgccttccaccatgttaggacacagatagaaagcatcctctataaactagaaagtaggctcttgccagacattgaatctgccaacaccttgatcttgtatttcccatcttccagaactgtgagaaatacatttctgttttttataaactgcctagtttatggtatatcttgttatggcaggctggatggactaagacattgtgcctccaaattctgagcttttgtggctgtaaatcagcttgctactaggcttctctttttttccgcatttagaaaagatgaaaaagctgaaacctaagtcattatcacttgtcagtttgctttctgtcttccaaatttgctcctgacatcttttgttggctatcattttctccaccattcattgtttctgccatttgtttttattttttactttcatttaagtggtgttttaggagagatgattagctatgtttaatcatatctgtttagtggtcccctcttggtgttctttttaacttatgatcttctgatagaactgcagtctcacttttcatctcatatttgaattctggttttaccaaatgtttttagtattaaaagtattttgtagtgtgaaactgttgtgttgagtgtgcccctgttcttgagttttgactattttcttggttgggcacattgccttttgtgtgctttgttcatttctacctttgttattttttctttttcttacttttgaatagtttgcatatttgcatagtttccatgccattctttgcaatttcctgatactttggtggctttattttgatcttctatttataaaaagagttggagttcttacctgtcttactagtttgtttttcccactgaacatctgtttgaggactgaacttctgtatttcttaacacttttctgcaggtttatgtaatggtgacaggatggtagatactcaactgatgtagtgggtggtcctaggctctgtcgcctatttgagatttattaaatgccatagactgttttgttgggggttctatatacaaatttttgtgttgacatagattttctgttctcttgggtatatactcagtattagaatttctgggtcaaatagtaactttatggttagctttttgaggaactgacggactgttttctaatgctgctgaatgacagtatgagtaatgtttgagagttccagtttctctacgtctttgccatcacctgtcatcatcagtctttttgatgataaccatcttagtggcatgaaatagaagtcctcatttaacatcattcataggttcttgggaattgtgactttaagtgaatgacgtagaatgaaaccagttttagcataggttaattgatataaatgagttaagttcttggagcatatttctggtaaaaaaaatcactaaacttctaaataaagactcaaaacactcatattaaacattgaaataaatgttatctatacatacatttaagaaagcttaataaaaacaaatggttttgatttgcatttttctttttttcttttcttttttttttttttcagatggagtctcgctctgtcgccaggctggagtgcagtgacacggtcttggctaactgcagcctccgccttctgggttcaagcggttctcctgcctcagcctcccaagtagctgggattacaggcatgcgccaccatgcccggctaatttttttgtatttttagtagagacagggtttcaccatgttggccaggctggtcttgaactcctgaccttgtgatctgcccgcctcggcctcccaaagtgcggggattacaggcgtgaaccaccgtgcctggaccttgatttgcatttttctaatgactaatgatgttgaatacctttttatattgttgattgtgacttttctgtctaaatctataaagtgtgtattctttgtcatgtgtggccaatgaaatctctacttggtttgtagatggtcagctaatgaatggacagaagattttcttaaatgccgtgaacaaataagtcttctagcctttgctgagtggttctttctttatgttggagtatgcattcaatgcttttgtgggctgatcaaaactctgccttagcctttgcttcctacttgcacagagccttaaggtcagccagagatgagagactgaggccttctcagggactaggcttatatatagacttgcacttgcatggttttctgatgccaggaatatgtcagagcttttcaaaggctatatatgtgcctggttctctgtggctggggcttttggggagctccaactctgttcttctctccttccccacagtgctggctaggctgctggattccataagctactactattctgaggcaattgatttttgaagcaatcaggagctggtggggtggggatgagaatagtacaagttaaaatgccacatatctcactattcttattgagattcaattgatttccctgaataaatgctttttggattactgcaagtttttggttaatttaaagagttaacgagaaattagattcagataatttttgccagcattcttgttgcttttacgaaggaaaggatttttggtgctaccccattctggagctgcttatgttctttgaggatattttgaagttttcttgtttttaaatacccatttctcttaggttgcccctccccctttaacattatttgatttagattttatcttcatgttggataatttttaaaaatatcatgttttctcattttaagagtgaaggactaaaaagtttcctagaaactttgagtgtctgggtgaggcttttcagccatgatctttactataggattgtttggctagatataatccttcccccttccccatctaacttaagaagtagaaaatagaaaagctgaatactatggatcattaaatagattgagtcaatgtcaaaattgctggcccatattgttttaccaatgaataaaaagaaacattaaaggagctaataattccagttttatgtaaactcctctacagaatggaaacatcttgatagcataatcttgataccaaactgacaaggatagaagaaaagataattatagctaatctcagttatgaatatatatgcaaaaatattatacaaaatattagctaaccaaatgtagcaagattttaaaaagataaaatataaaagactttatacaattaatgtcaggcgggtttaacattagaaaatcaatcaatataattctaactcaatgtagtcagttaattaatgtaatataacttttcttcatatagaatttctaagtatctctactcttgagtagaattcctaaacatctctactattttaggaaaacatctttttccgtgaaaacatgtttgtgtgtttgtatgtgtctatatctgtgtgtgtatttatattcatatccaagaatacaatagaaattatcatataatattaagtgactaccagacctctgcattgaaaatgtgattgttaggtcagaattttatctaaatcttgaaatactcttaaataaaagccatttggcaagtaatattaaatatagatcaactatcatagcagtaatatagtaatatatcaccaaaataaacatcataagctctaactgattggcctttgattttccaggttcttttttttaaaaaaggattaaatttaaacttggtggaatagtgggcatactctttgtttattgcaatgggatttaagtgattatgtgttgtgtttctacatgatttgtcagtaaaatgggaatcacgtgtgattttttttttttttttcttcagacagggtctcactctgtcacccaggctggagtgcagtggcatgatctcagcttgctgcagcctctgcctcctaggcacaagtgatcctcccacctcagccctccaagtactgggaccacaggcatgcgccacaacgccagctaatttttgtttatttatttattattttgagatggagtctcgctctgtcgcccaggctggagtgcagttgtgtgatcttggctcactgtaacctccacctcctgggttcaagcgattctcttgcctcagcctcccgaatagctgggattacaggtgtgtgccaccacacctggctaattttttgtacttttagtagagacaagtttccaccatgttggccaggttggtctcgaactcctgatctcaagtgatctgccccctttggcctcccaaagtgctgggattacaggtgtgagccaccacgcccagccatttctgtttattttttagggatgatgttttgccatgttgcccagtgtggtcttgaactcttgagttcaagggatctacccaccttggcctcaaagtgctgggattacaggagtgagccactatgcctggcctatgattttcttttataaataaatctcatgagacttcctaaataatttattttactattttatttattttactatataaaatactatataaaatagtttcgatcaactaggatataagcatctttttgttatagactccattttgttattatttcaaattatttggtttatggttaaccatgtaaattgctatttatttactttaaagtagacaagtatgtaagtcaatgactgaaagttggagattatgtatttgtaatttaagaaggcatataatttaacagtgactgaattaatactggggctattgagtgattgaaggaggaggacctatcatatagaataatagtcttttatacttaggtagtatagtgcataatgttcttaaaagtgctttcatatatgaaagtactcttatgaaaaaatgagattacataaggttgttcataatactatttgtatttggccattctcacattgctatgaagaaatacttgagactgggtaatttataaaggaaagagatttaattaattggctcatcattctgtatgctttacaggaagcatggtgctaacatctgctcggcttctggggaggcctcaggaagcttacaataatggtggaaggcaaagggggagcaggcatgtcacatggaatttatgttcctctctatactggttattctagttagcagttcctgtaataaccttttatcaacgttcttagcttctttgcattgtgttagaacatgctcctttagctcagaggagtttgttccaccttctgaagcctacttctgccaattgctcaatctcattctctgttcagttttgtgcccttgctggagaggtgttgcgatcattcggaggagaaaagttattctggcttttggaattttcagcatttttgtgctgacttttccttatctttgtggatttatctacctttgatctttgaggctgatgacctttggatgggctttttgtgggagggtttttttttttttttgagatggagtcttgcgctgtcacccaggctggaatgcagtggcgtgatctcggctcactgcaagctccgcctcctgggttcatgccattctcctgcctcagcctcccaagtagctgggactacaggtgcacgccaccacacccggctaattttttgtatttttagtagagacggggtttcaccatgttagccaggatagtcttgatgtcctgacctcctgatccacccgcctcggcctccaaaagtgctgggattacaggcgtgagccaccacgcccggcctgtggggggggttcttgatgttgatgttgatgttgttcctttctgtttgttagtttttcttctaacaggcccctcttctgatggtctgctgcagtttgctggacttctgcaggtctgctgcagtttgtaggccctgtttgcctgggtatcactagtggaggctggagaacagcaaagattgctgcctgctccttcctccggaagctttgtcccagaggggcagcagcctgatgccagctggagctctcttatatgaggtgtctgtcgatccctattgggaggtctctcccagtcaggaggcaggggggtcagggacccacttgaggaggcagtctgtccttaggagtgcgggtgcgctgtgctgggagaatcccccttgtcaggatcagccgctgtcttcagagctgacaggtaggaaagatttaagtccactgaagctgcgactgcagccgccccttcccccaggtgctctgtcctaccaggatgagagttttatctgtaagctcctgactgaactgctgcatatcctgcagagatgccctgcccagtgaggaggaatccagagaagcagtctggccacagccactttgctttgctgtggtgactgtgcccagtccaaacctcccagtctccttagcactatcaggagaaaaccacctacgaaagcctcagtaatggcggtcgctgcttcccccaccaagctcgatcatcccaggtcgactccagactgctgtgctggcagtgagaatttcaagccagtggttcttagcttgctaggctccgtgggagtgggacctgctgagctagacttcttgggttcctggcttcagctccctttccagaggagtggacggttgtcctttctcactggagttccaggtgccactggcatacgaaaaaactcctgcagcttggtgtctgcccaaacagccgcccagttttgtgcttgaaacacagggccctggtggcatagggtcacgagggaatctcctgatctgcggattgcaaaaatccatgggaaaagcgtagtactcagggcgggtagcacagtccctccccacttcccctggctggctgggggagggagttgccctagctccttgcacttccagggtgaagtgacgccccaccctgcttctgcttgctctccgtgggttgcacccagtgcctaaccagtcccagtgagatgaactgtgtacctcagttggaaatgcagaaatcacccaccttctgcgttggtctcgctgggagctgcagactgccgctgtttctatttggccatcgtggcccctccccgccctgtccagtggtctttacgttactgctattgtaattgttttggggcaccatgaaccatgcctgcataaggtgatgtacttaatttataaatatatgtgttctcactactcctctgtccagccgttcttccaactctccctctcgtctggccttcctactccttgagacacaacaatgttgaaatgaggccagttaactctacagtgtcctctaagtgttcaagtgaaaggaaggctcacacctgtttcattttaaatcaaaagctagaaatgattaagcttagtgaggaaggaatgttgaaaaccagtacaggccaaacgctatgtctttagtgccgaacagccaagttgtgaatgcaaaggaaaagttcttgaaggaaattaaaagtgctactttagtgaacacataagtgataagagagccagccattcttattgctgacatggagaaagttgtagtggtctggatagatcaaaccagccacagcattcccttaagtcaaagcctaatttagaacaagaccctaactctcttcaatttgatgaaggctgagagaggtgaggaatttggagaagaaaagttggaggctaggagagattggttcatgacttttagggaaataagacttctacataatataaaaatgcaaggtgaaacaagtgcttatgtagaagctgcagcaagtaatcccaaagatctagctaaaataatcgatgaaggtggccacactaaacaacagattttcattgcagacaaaacaatcttctactggaaggtgtcatctaggtgtttcagagctagagaggagaagtcagtgcccagctttaatgcttcagaggacaggatgactctctggttaggggctaatattgctggtgagtttaagttgaagccattgctcatttaccattctccaaatcctagggcccttaagaattatgctacatatactctgcctgtgctctataaatgggacaacaaagcccagatgacagctcatctctttacagaatatttaactgaatatttaagcccacggtacctgctgctcagaaaaaaaagattcttctcaaaatattgtttgttaacaatgcacttggttactgaagagcgctgatggttatgtaccagcaagttaatgttgttttcatccttgctaacacaacatccattctgcagcacatgcatcaatgaagaattttgactttcaagtcttattacttaagaaatacatttcataaggctatagctgacatagatagtgactcctttgatggatctaggcaaattaaattgaaaactttctggaaaggatttgccattctagatgcccttaagaccatttgtgattcatgtgaggaggtccaaatgtcatcattaacaggagtttggaggaagttggttccagtccttatggataactttgggggtgggggcaggtttagacttcagtggaataagttactgtaggttagaaatagcaagataattagaattagaagtggagcctgaagatgtgactgaattgctgcaatctcatgcattcataaaacttgaatgggtgaggagttgcttcttatagatgaccaaagaaaatagtttcttgagatggaaactcctcctggtggagatgctgtgaacattactgaaatgacagcaaaagatttagaatattacataaacttagttgctaaagtagccatagggtttcagttttgaaagaggttctactgctagtaaaatgctatcaagcagcattgcatgctacagagaaacctttttgaagaaagagtcaaccaatgtagcaaacttctttgttgccttattttaagaaactggcactgactgcccagccttcagctgctaccaccctcatcagtcagcagtcatcaacaaacattgagttaggaccttccaccattaaagatgatgacttcctgaagggccagatgatggttagcatttttttttttagcagtaaagtattttaattttatttatttatttttgagacagagtcctgctctctcgcccaggctggagtgcagtggcgtgatctcgactcactgcaatctctgcttcctgggttcaagcgattctcctgcctcagcctcccatagtagctgggattatagatgtgcgccaccacatctggctatgttttgtatttttagtagagatggggttttgccatgttggccaggcttgtctcagattcctgggctcaagtgatccatctgccttggcctcccaaagtactgggattacaggcgtgagccactgtgcctgacctcaataaagtatttttaaattaaaataaatatgtttttatatataatgctattgcacacttaatagattacactatagtgcaaacattactttcatttgcaattttttggaaaccaaaaattgatgtgactcactttattgcaatatatgctttatggcagtggtctggaactgaaccagccatatctctaaggtatgcctttgttaagaagtctgttacctgaaggaagtaattattaagagttcatatatagcctgctatagaatagtaatcttatgaataaggggattcataagaataagaataaggaattggaatctcagaccagtcagaatggctattattaaaaagtcaaaaaataacagatgctggcgaggttgtggagaaaagggaacacttatgcattattggcaggaatgtaagttcattcaaccattgtggaaaacaatgtggcgattcctcaaagaactaaaaacagaactaccttttgatccagcaatcccatttctgggtatatactcaaaggaatagaaattgttctaccacaaagacacgtggcatgcatatgttcattgcagcactattcacaatagcaaagacatggagtcaacctaaatgcttatcagtgttagactagataaagaaaatgtgatatatatacatcattaaatactatgcagccataaaaaagaatgaggtaatatcctttgcaggaacatggatggagctggaggccattatctttagcaaactaacacaggaacagaaaaccaaataccacatgttctcacttccaagtgggaactaaacaatgagaacacatggacacaaagaggggaacaacatacactgggttctgcctgagggtggagagtgggagaaggaagaggatcagaaaaaataacttttgggttctaggcttagtacctgggtgatgaaataatctgtacaacacatccctgtgacatgagtttacctatataacaaacctacacatgtacccatgaacctaaaaagttaaaaaaatagaaataagaaattggaaatatgaaataaaagttgaatttaaaatgtttcttcatctcttcactgtggacttaggatgctgggtgtttttcaaactagaatctttgatagagaattatatttgatgtttgtaacatactcagattctaatggtatcttttgagtggctaggtattcttggaagcatatataaatattcatgtgtgtttgtccatgaataacattactgtggtgagggaaatgtgggaaagagggctttgttaaaggccttaaatgacaacaatgaatctagattagttactgtggagaatgcctttgatatttgtgttaactttacttttgaactttttcaataaaattcaactcccatttctgtgtttagttgggaaaggggattgagagattttagtataagactacctgaagttatttctttttcaatagctaagcaaagatttgaaagctttttgaaaatccaagaggaaatgaaacacagccatctagtggatgcaattttaaaagctgtaagcatgtaatttaagtaccgtgagctcatgtaagcattataaacattattaggcattcaagttaatcatttcttattataaaaagggcaatatacatttaaaaattttaatgagaaggggaaacataatatatgatagttgaactactgcattatataaataccttcagaggtcagttaaactaatgtaactttctcatatgctataacattttccgttgtaatattaatcagagtttttgaattctaaaacttcagtattgctttttaaacacatggacattctgaaacattgatggaaaatatctaggcctcttttgcctatataaattaacctattattatagttgaagcacagatttagttactcactgtcttctattggagtgactcttagtcattgatggcttataaactttattgatgcaaaaatgaattattttccaggagcaagatactgctgtgcaaaatatgcataagaaagtagaaaaattagaaacagaacatatggactgctctgaccttttacggcgacaaacaagtgaacttgaatttagcactcaacgagaggaacgccttagaaaagaatttgaggtacattttctcattcctttataatatatatgcgtacaaactttcacatatgcgcgcgcgcgcacacacacacacacacacacacacacacacataaaacccattccgtgatttaagattggagagttttactctgtgataatatataaaactaattttaggggcacttatttataatgtatatttggcttctttgaaaatttttgtatctgagtattttctgttttgccctagtttaaaaaaatctgttcacttttgaacaattaactctcatggaatatttgggaagtttgagagtaattgtttacattattaggttgagaaagcaacacaggaaaagttttggtgtacataggttctaaatcataaaagtaattttacattttaattttgtagtttgaatcatgtatggttttgtggaatgcttttcagatgagactttacttgggaaaggagcatcaatttacagatgaaaaacaggatttttattcgtgaatgatactgaaaataacttttaatcttaagagaaatgtaattgatttgttagttcatctttttaaaatttctctttgctttgtgggaaatgaaatatttaaacagataaagaagttttgtcctaaacataatttgtaatctttattaggcaaataaatacttatgaagagtatttaatggcaaagtactagagttaacacttattaaactcactgtgtcacttaacactgttaagaacagcaataaggattataacttttgggaggaaggaagtgtgattcctaatatttttagatgatatgtaaataaaatgaatagtaaaatcaactttgaaattattgacactagtaaaaacattcaataaggaggctaggcagagaataatatatgacaattttttaaaattaattaattttttattatactttaagttctagggtacatgtgcacaacattcaggcttgttacatatgtatacatgtgccatgttggtgtgctgcacccattaactcatcatttacattaggtatatctcctaatgctatccctccccactcccccaccccatgacaggccccggtgtgtgatgttccccatcctgtgtccaagtgttctcattgttcaattctcacctatgagtgagaacatacggtgtttggttttctgtccttgcaatagtttgctcagaatgatggtttccagcttcatccatgtccctacaagggacataaactcatcattttttatggctgcatagtattccatggtgtatatgtgccacattttcttaatccagtctatcattgttggacatttgggttggttccaagtctttgctattgtgaatagtgctgcagtaaacatacgtgtgcatgtgtctttatagcagcatgatttataatcctttgggtatatgcccagtaatgggatcactgggttaaatggtatttctagttctagatccttgaagaatcgcctcactgtcttccaccatggttaaactagtttacactcccaccaaaagtgtcaaaaagtgttcctatttctccacatcctctccagcacctgttgtttcttgactttttaatgattgccattctaactggtgttaagatggtatctcattgtggttttgatttgcatttctctgatggtcagtgatgatgagcattttttcatgtgtctgttggctgcataaatgtcttcttttgagaagtgtctgttcatatccttcgcccactttttgatggggttgtttgattttttcttgtaaatttgtttaagttctttgtagattctggatattagccttttgtcagatgggtagattgtaaaaattttctcccattctatagattgcgtgttcactctgatggtagtttcttttgctgtgcagaagctctttaatttaattagatctcatttgtcaattttggcttttgttgccattgcttttggtgttttagttatgaagtccttccccatgcctatgtcctgaatggtattgcctagcttttcttctagggtttttatggttttaggtctaacatttaagtctttaatccatcttgaattaatttttgtataaggtgtaaggaagggatccagtttcagctttctacatatggctagccagttttcccagcaccatttattaaagagggagtcctttccccatttcttgtttttgtcaggtttgtcaaagatcagatggttgtagatgtgtgctaatatttctgagggctctgttctgttccattggtctatatctctgttttggtagcagtactatgctgttttggttactgtagccttgtattatagtttgaagtcaggtagcgtgatgcctccagctttgttctttttgcttaggattgtcttggcaatgcgggctcttttttggtttcatatgaaatttaaagtagtttttttccaattctgtgaagaaagtcattggtagcttgatggggatggcattgaatctataaattaccttggggagtatggccattttcacgatattgcttcttcctaaccatgagcgtggaatgttcttccatttgtttgtgttctctttcatttcattgagcagtggtttgtagttctccttgaagaggtccttcacatcccttgtaagttggattcctaggtattttattctctttgtagcaatcatgattgggagttccactcatgatatggctgtttgtctcatattggtgtataagaatgcttgtgatttttgcacattgattttgtatcctgagactttgctgaagttgcttatcagtttaaggagattttgggctgagacgatggggttttctaaatatacaatcacgtcatctgaaaatggacaatttgacttcctcttttcctcattgaataccctttatttctttctcctgcctgattgccctggccagaacttccaacactatgttgaataggagtggtgagagagggcatccctgtcttgggccagttttcaaagggaatgcttccagtttttgcccatttagtatgatattggctgtgggtttgtcataaagagctcttattgttttgatatacatcccatcaatacctagtttattgagagtttttagcataaagggctgtagaattttgtcaaaggccttttctgcatctgttgagataatcatgtggtttttgtctttgggtctgtttatatgatggattacgtttattgatttgtgtacgttgaaccagctttgcatcccagggatgaagcccacttgatcatggtggataagctatttgatgtgctgctggattcagtttgccagtattttactgaggatttttgcatcaatgttcatcagggatattggtctaaaattctcttttttttagttgtgtctttgccaggctttggtatcaggatgatgctggcctcataaaatgacttagggagagttccctctttttctaatgattgaaatagtttcagaaggaatggtaccagctcctccttgtacctctggtagaatttggttgtgaatccatctggtcctggacattttttggtttgtaggctattaattattgcctcaatttcagagcctgttattggtctattttgggattcaacttcttcctggtttagtcttgggagggtgtatgtgtcgaggaatttatccatttcttctagattttctagtttatttgcatagaggtgttcatagtattctctgatggtagtttgtatttccgtgggatcggtggtgatatcccctttatcattttttgttgcgcctatttgattcttctctcttttcttctttattagtcttgctagctgtctatcaattttgttgatcttttcaaaaaaccaactcctggattcattgatttttttcaagggttttttgtgtctttatctctttcagttctgctctgttcttaattttttcttgccttctgctagcttttgtatgtgtttgctcttgcttctgtagttcttttaattgtgatgttagggtgtcaattttagatctttcctgctttctcttgtgggcatttagtgctgcaaatttccctctacacgctggtttgaatgtgtcccagagagtctggtatgttgtgtctttgttctcattggtttcaaagaacatctttatttctgtcttcatttcgttatgtacccagtagtcattcaggagcaggttgttcagtttccacgtagttgagtggttttgaatgagtttcttaatcctgagttctagtttgaatgcactgtggtcttagagacagtttgttataatttctgttcttttatatttgctgaggagtgcttcacttccaactttgtggtcagttttggagtaagtgtgatgtggtgctgagaagaatgtatattctgttgattttgcatggagagtaccgtagatgtctattaggtctgcttggtgcagagctgagttcaattcctggatatccttgttaactttcgtctagttgatctgtctaatgttgacagtggggtgttaaagtctcccattattattgtgtgggagtctaagtctcttgggttagaccctaagaatcatgggtttagggaagccgtattgtgtagggtgataaggaaatgttaaaaggtttcactggggagggagccaagatggccgaataggaacagctgctgtctacagctcccagcgtgagcgacgcagaagacgggtgatttctgcatttccatctgaggtactgggttcatctcactagggagtgccagacagtgggcgcaggacagtgggtgcagcacaccgtgcaccagccgaagcagggcgaggcattgccttactcgggaagcgcaaggggtcacggagttccctttcctagtcaaagaaagggatgacaggtggcacctggaaaatcgggtcactcccaccccaatactgcgcttttccgacgggcttaaaaaacggcgcaccaggagattataacccgcatctggctcagagggtcctgtgcccatggagtctcgcttattgctagcacagcagtctgagatcaaactgcaaggcggcagcgaggctaggggaggggcggctgccattgcccaggcttgcttaggtaaacaaagcagctgggaagcttgaattgggtggagcccaccacagctcaaggaggcctgcctgcctctgtaggctccacctatgggggcagggcacagacaaacaaaaagacagcagtaacctctgcagacttaaatgtccctgtctgacagctttgaagagagcagcggttctcccagcacgcagctggagatctgagaatgggcagactgcctcctcaagtgggtccctgacccctgaaccctgagcagcctaactgggaggcaccccccagtagaggcagactgacacctcacacggccgggtactcctctgagacaaaacttccagaggaacgatcagacagcagcattaacggttcacgaaaatccgctgttctgcagccaccgctgctggtacccaggcaaacagagtctggagtggacctctagcaaactccagcagacatgcagctgagggtcctgtctgttagaaggaaaactaacaaacagaaaggacatccacaccaaaaacccttctgtacatcaccatcatcaaagaccaaaagtagataaaaccacaaagatggggaaaaaacagagcagaaaaactggaaactctaaaaagcagagcgcctctcctcctccaaaggaatgcagttcctcaccagcaacggaacaaagctggatggagaatgactttgacgagttgagagaagaaggcttcagacgatcaaactactccgagctacaagaggaaattcaaaccaaaggcaaagaagttgaaaactttgaaaaaaatttagacgaatgtatagaataaccaatacagagaagtgcttaaaggaggtgatggagctgaaagccaaggctcgagaactacgtgaagaatgcagaagcctcaggagccgatgctatcaactggaagaaagggtatcagtgattgaagatcaaatgaatgaaatgaagcaagaagggaagtttagagaaaaaagaataaaaagaaacgaacaaagcctccaggaaatatgggactatgtgaaaagaccaaatctacgtctgatgggtgtacctgaaaatgacggggagaatggaaccaagttggaaaacactctgcaggatattatccaggagaacttccccaatctagcaaggcaggccaacattcagattcaggaaatacagagaacgccacaaagatgcccctcaagaagagcaactctaagacacataattgtcagattcaccaaagttgaaatgaaggaaaaaatgttaagggcagccagagagaaaggttgggttacccacaaagggaagcccatcagactaacagtggatctctcggcagaaactctacaagccagaagagagtgggggccaatattcaacattcttaaagaaaaaaattttcaacccagaatttcttatccagccaaactaagcttcataagtgaaggagaaataaaatcctttacagaaaagcaaatgctgagagattttgtcaccaccaggcctgccctgcaagagctcctgaaggaagcactaaacatggaaaggaacaaccggtaccagccattgcaaaatcatgccagactgtaaagaccatcgaggctaggaagaaactgcatcaactaatgagcaaaataaccagctaacatcataatgacaggatcaaattcacacataacaatattaactttaaatgtaaatgggctaagtgctccaattaaaagacacagactggcaaattggatacagtcaagacccatcagtgtgctgtattcaggaaacccatctcacgtgcagagacacacataggctcaaaataaaaggatggaggaagatctaccaagcaaatggaaaataaaaaaaggcaggggttgcaatcctagtctctgataaaacagactttaaaccaacaaagatcaaaagagacaaagaaggccattacataatggtaaaaggatcaattcaacaagaagagctaactatcctaaatatatgtgcacccaatacaggagcacgaagattcataaagcaagtcctgagtgacctacaaagagacttagactcccacacaataataatgggagactttaacaccccactgtcaacattagacagatcaactggacagaaagttaacaaggatatccaggaattgaactcagctctgcaccaagcagacctaatagacatctacagaactctccaccccaaatcaacagaatatacatttttttcagcaccacacctactccaaaattgaccacatagttggaagtaaagctctcctcagcaaatgtaaaagatgagaaattataacaaactgtctctcagaccacagtgcaatcaaactagaactcaggattaagaaactcactcaaaactgctcaactacatggaaactgaacaacctgctcctgaatgactgctgggtacataacgaaatgaagacagaaataaagatgttctttgaaaccaacgagaacaaagacacaacataccagaatctctgggacacattcaaagcagtgtgtagagggaaatttatagcactaaatgcccacaagagaaagccggaaagatccaaaattgacaccctaacatcacaattaaaagaactagagaagcaagagcaaacacattcaaaagctagcagaaggcaagaaataactaaaatcagagcagaactgaaggaaatagaaacacaaaaaacccttcaaaaaattaatgaatccagaagctggttttttgaaaagatcaacaaaattgatagacagctagcaagactaataaagaagaaaagagagaagaatcaaatagatgcaagaaaaaatgataaaggggatatcaccaccgatcccacagaaatacaaactaccatcagagaatagtataaacacctctacgcaaataaactagaaaatcttgaagaaattgatagattcttggacacatacacccacccaagactaaaccaggaagaagttgaccttctgaatagaccaataacaggctctgaaattgtggcaatagtcaatagcttaccaaccaaaaagtccaggatcagttggattcacagccgaattctatcagaggtacaaggaggaactggtaccattccttctgaaactattccagtcaatagaaaaagagggaatcctccctaactcattttatgaggccagcatcattctgatacgaaagccgggcagagacacaaccaaaaaagagaattttagaccactatccttgatgaagattgatgcaaaaatcctcagtaaaatactggcaaactgaatccagcagcacatcaaaaagcttatccaccatgatcaagtgggcttcatccctgggatgcaaggctgtttcaatatatgcaaatcaataaatgtaatccatcatataaacagaaccaaagacaaaaaccacatgattatctcaatagatgcagaaaaggcctttgacaaaattcaacaacccttcatgctaaaaactctcaataaattaggtattgatgggacgtgtctcaaaataataagagctctttatgacaaacccacagccaatatcatactaaatgggcaaaaactggaagcattccctttgaaaactggcccaagacagggatgccctctctcaccactcctattcaacatagtgttggaagttctggccagggcaattaggcaggagaaggaaataaagggtattcagttaggaaaagaggaagtcaaattgtccctgtttgcagacaacatgattgtatatctagaaaaccccatcgtctcagcccaaaatctccttaaactgataagcaacttcagcaaagtctcaggatacaaaatcaatgtacaaaaatcacaagcattcttatacaccaataacagacaaacagagagccaaataatgagtgaactcccattcacaattgcttcaaagagaataaaatacctaggaatccaacttacaagggatgtgaaggacctcttcaaggagagctacaaaccactgctcaacaaaataaaagaggatacaaacaaatggaagaacattccatgctcatgggtaggaagaatcaatatcgtgaaaatggccatactccccaaggtaatttatagattcaatgccatccccatcaagctaccaatgactttcttcacagaattggaaaaaactactttaaagttcatatggaaccaaaaaagagcctgcatcgccaagtcaatcctaagccaaaagaacaaagctggagacatcatgctacctgacttcaaactatactacaaggctacagtaaccaaaacagtatggtactggtaccaaaacagagatatagatcaatagaacagaacagagcactctgaaataatgccgcatatctatgactatctgatctttgacaaacctgagaaaaacaagcaacgcggaaaggattccctgtttaataaatggtgctgggaaaactggctagccatatgtagaaagctgaaactgggtcccttccttacccattacacaaaaattaattcaagatggattaaagacttaaacgttagacctaaaatcatagaaaccctataggaaaacctaggcattagcattcaggacataggcatgggcaaggacttcatgtctgaaacaccaaaagcaatggcaagaaaagccaaaattgacaaatgggatctaattaaactaaagagctcctacacagcaaaagaaactaccgtcagagtgaacaggcaacctacacaatgggagaaaagttttgcaacctactcatctgacaaagggctaatatccagaatctacaatgaactcaaacaaatttacaagaaaaaaacaaacaaccccatcaaaaacggggcaaaggacatgaacagacacttctgaaaagtagacatttatgcagccaaaaaaacacatgaaaaaatgctcaccgtcactggccatcagagaaatgcaaatcaaaatcacaatgagataccatctcacaccagttagaatggcaatcattaaaaagtcaggaaacaacaggtgctggagaggatgtggagaaataggaacacttttacactgttggtgggactgtaaactagttcaacccttgtggaagtcagtgtggcgattcctcaggaatctagtactagaaataccatttgacccagccatcccattactgggtatataccgaaaggactataaatcattctactatacagacacatgcacacgtatgtttattgtggcactattcagaatagcaaagacttggaaccaacccaaatgtccaacaatgatagactggattaagaaaatgtggcagatatacaccatggaatagtatgcagccataaaaaatgatgagttcatgtcctttgtagggacatggatgaaattggaaatcatcattctcagtaaactatcgcaagaacaacaaacgaaacaccgcatattctcactcataggtgggaattgaacaatgagaacacatggacacagggaaggggaacatcacactctggggactgttgtggggtggggagaggggggcgggatagctttaggagatacacctaatgctaaatgatgagttaatgggtgcagcgcaccagcatggcacatgtttacatatgtaactaacctgcatattgtgtacatgtaccctaaaacttaaagtataataataaaacaaaagaaagcagaacccaaacacacaaaaaaaagaaaaataatttaaattttttttaacttttaaaaaaattaaagatataatttgaataataaaaaaagtttctttggaaaatttttaaacattacaatctataggtcttttctctgtatttcttttatttctacaaagggatatctgctagtttcaggtttgatggttagaaaatggaagaaggaaatggaggaagaatctggttatgatgctgtttaatgtgcagacatccccctgattttggtctggtgcacccctcttcctctctctccatgtgtatttctgtgttcagcttctggttcagatttatattcttcagataataaacctttgtgtgagggctagggtagggtatttgtttggctacttggggtaagggtggatgccttgaagtctaacttcttacagcgatgagtaaaaaaaacactttatagagatgtaatttgcatattataaatttgtccatttgaagtgtacaattcagtggtttttagtgtattcacagcattgtgcaaccattactataatccattttggaacattttcatcacacaataagaaaccctgctcattagccatcactttcctattcccctttcctctcatccctaagcaaccactactttctgtctttatagatttgcctattctagacattccttacaagtggaactacaatatatggtcttttctgactgacttctttcacttagcataatgttttcaaggtttgtccatgttgcagcatgtattagtgcttcattcttttttatgcctgaatgatattctgttgtgtaatatatattttgtgtctctgtccatcagttgatggacgtttgtgtttgtatttgtcagggttctctaaagggacagaactaatagtatatatgtatatgtgaaggggagtttgttaggagaattgacttacactatcacaagttgaagttccacaataggccatctgcaagctgaggagcaaggaagtcagtcgaagtctcaaaatctcaaaagtagataagccagcagtgcagccttcagtctgtggtcgaaggcctgagagcccctttttatcattttatgtgcttattagccattcatatatcttctttggagaaatagctatttacacccttgtcctttttaaaaatggattgtttgtactgtatatatatataaatcacagtgtaagtccaagagtctaaaaattgaagaacttggagtctgatgttccagggcaggaagcatccagcacagagaaagatgaaggctggaacactcagcaagtctccccattccactttcttctgcctgctttattctagccatgctggcagctgattagatggtgcccacccagactgagggtaggctgcctctcccactgcactgactcaaatgttaatttcctttggtaacaccctcacagacacacctaggaacattacatcctttaatccaatcaagttgacactcggtattaaccatcacagtgttgtttccactctttcagccataatgaataatgccaccatgaacattcgtgtacaggtttttgtgtggatatgttttcagttgtctttatgatatatctaggagaggaattgctgggtcacatggtaactatatggttaacattttgaggaactgtcagtttgttttgtacagtggcagcattttacattcccaccagcaaggtataagggttctagtttctctagatcctcaccaacagctgttattgtcactcttttatattacaaccactgtagtaggtgtgaaatggtaccttattgtggttttgatttgcatttctctgatgattgatgatgttgaatatcattttatgtgcttattaggcattcatgtatcttctttggagaaatagctatttagacccttagacccttctcttttttaaaaatggattatttgtactatgtatatatatatatatctataagatgctaacgatggaggaaactgggtatggagtaggtagatggacttaccaacagaaatgccaaatatgaacttggcaaggataaacttcctcatactctaaccacacatgggttattttttacaagattacagaaggaataaaaatatgaaattatatttgaaatagtattttaacatattgtcttgtgctgaacatctttttaggccaataaattcaggaattcattatattttatatcatcatttttaatactatggtttgtagatggcttactaaaaaaggattaagggccaggagctgtggctcatgcctgtaatcccagcactttgggagacagaggtgggcagatcacttgagaccaggagttcaagaccagccttggcaacatggtgaaatatcatccctacaaaaaatacaaaacttagccaaacatggtgaaatgtgcctgtagtcccagctgcttgggaggctgaggtgggaggatcacttgagcctggggagtttgggcctgcagtgagctgtgatcgtgctgctgtactctagcctgggcaacaaagtgagaccctgcctcaaaaaaaaaaaaaaaaaaaaaaggtttaggatagagttaatgttctgaatattagaatttaaaagatcacttagaagtcacttaaggatgctagaaaactctatcatcactaaaaacattttattaattgtgttatagttgtgaggctgtactatgtaataacgaatttttttttgtttttagggttcttggtaaggcagttttgactcagttaagaaaatatcggctgggcgtggtggctcatgcctgtaatcccagcactttgggaggctgaggtgggcctatcacttgaggtcaggagtttgagaccagcctggccaacatggtgaaaccccatctctattaaaaatacaaaaattagccaggcatggtggcgctcgcctgtaatcctagctgctctggaggctgagacagcaaaatcacttgaacctgggaggtggaggctgcactgagccgagattgtgccactgcactccagcctgggcaacagagcaagactctatctcaaaaacaaaacaaaagaaaaagtaataaaatgcacacaaaaaagaaaatatctaaacctaaactttaaggtgtggttgtgcacaacccggtattgacttttttctgtaaaatacttaatttcctcaatatctgtttttattggttgatgttataggtataatattattatagactggttttatttttactttttaaaatttttttgtttattttattattattattattatactttaagttttagggtacatgtgcacaatatgccggttagttacatatgtatacatgtgccatgctggtgtgctgcacccattaactcgtcatttagcattaggtgtatctcctcatgctatccctcccccctccccccaccccacaacagtccccagagtgtgatgttccccttcctgtgtccatgtgatctcattgttcagttcccatctatgagtgagaacatgcggtgtttggttttctgtccttgcgatagtttactgagaatgatgatttccaatttcatccatgtccctacaaaggacatgaactcatcattttttatggctgcatagtattccatggtgtatatgtgccacattttcttaatccagtctatccttgttggacatttgggttggttccaagtctttgctattgtgaatagtgccgcaataaacatacgtgtgcatgtgtctttataacagcatgatttatagtcctttgggtatatacccagtaatgggatggctgggtcaaatggtatttctagttctagatccctgaggaatcaccacactgacttccacaatatttttactttatgtttttttctttactgctgtgtaaatacttttgataataccaggtctctgcttttggagaacttgaagctttgaaggtagtctagatagtctttatttttcttctatttgtaagaattttacaagtggagagctttagtcttctaagttacctatgatttctcatatttagattctttttaaaagctttgctttatattatatatcatgtgttgtatattagttagtatattttatgttggctgtttgaccacatagtgacataatgaacaagaagttaaatttctggagagcattttatgttagttttacactcaattgcggagacaatcactaccagtaatactaggtacttaagtaattgttagtggtatttttaagagaattaaggtaagatgggataataataaagaagaagttgttaaaattttaatttaataaagtacattatttaatatcagcaatatcaaactaaagcaactaataaaatagacatttagcctaatgaatgttttaaattctagtgaagctttttaacagttgcatttcttgaaaggtgatttttttatgtgcctgagccaaagaagtttttatatatatgaaacataaatataaaagaatttaaaaatcttataagctttatatcactgtgtcttaatcatcttaacatggatcaatgctttcttagattaaaaaaaaacaaacaaactcccaatccaattttataaatgcagtactggataccatagaatcaagggaaaagcaaactggaaaaagaaatatccatggcttttataaacctctttacaactaggggagtttattatcatgggaaataagcttaactcaataagaaaagagaaaagagaagatgcaaacctaattctgagagaactgaagaatcttctgaagattatggtagagagagaacagtctttgcaaataaattctgaattgcttctgtcagtcatattctatattatagtaacataaaaaagggtaaaaggtagcatctttctctaaatgcgtactatcttcaactgaaaatggaaaagttgtattttacctttcataattgttgataaagaccaccttgtatgattcatctttttaaagccatcatgtgtttgtaggaatcattttcaaaggtccatttgcatagattactaactataaaataggtaaatgatgaaatcacctgtgttatacagtcataggtattacacatttaaatgcagcattttatgtttataataaattttaagattggaacttcagttaaaaatttggtaaatactcaagttttttttgccagaaaaggtagagataatttttaaagaaggtaaatcagtttattatcatgttaatcagaatttgcgaccacaaattctgttcctgatatttcttatttttattatctgtgggttttttgattatacctagaagtaataaaactttttcttcattaaactcttttataatctgagtggtatacttcatttcttgctgaataaaaaaattacagtgttctccagtttatttctattgtcagcctattgtcctcatatatcccttctgaaaccgttaaggctctgttaccatcctcagtgactttaactttgaattttctaccttcagaactgcatagttaatcatgatcaagatgactggcacagagaactctgaatctttctatgttctgctatgctttatatgagcctgtttatgtaaaataatctaggggattctggaaaacaaatatgttttggccattaataaaacagttacagatgaattgtagttcagagaagtaagtagaaggaatatcctttagcgacaaatgaatttttgtctacaacacaggtcttttgcttactcctaatggaaatgcttatagatgtgtcaggactcgttttggcctttgggccaaggacctagtatggcatctggcatatagtaggtactctataaatgttccattctgctttttagttgacctatatagtaaaataagtatcaatgagatcatcatgaaaagttataaacctattcatttgtttttaataatcttttgtttttatgcagtcacatttgtttaatgggattgaatataaatgtaaaatgtttggacttctatgagggtacaataaagtggataggacttcctgaccaattcacttccaagaccagttggacttccttcctcttctcttttacatggcagttcccgtgttctgagtcacaaagcagcattaattttgtctctgagttgtttttctaatgtactgtgctggccacatggaaagtaggagagctacttaaaaaaaaacaccaccttcaaattagaatgccttattaagatttaaaatattatgtatcatacgaggccccttatgtaaaatatatcatgttattttaaaagtcaaatgagaacatacacgagagttctttgaaaactgtagcatattaatatttaactctaggcataatctcctcagtgacattaatgtaaatacactctgtcatgtagaagtgacattagaaatataaatgcttacatttaaaaagccaacattgaaggtcagactaattgaataatattattgtttcttaacatgtttgattagaacaaggatgataaatagtaaagggcttatagacagttcttaattatgacccttcaatatatgactctagcgattaagtgatttaatactgtgatgcctgttttacaaatacttatcaaatacttggagactctgaccctctgaggcatcttttttggtaataaaaatcctttgagaccttctgtttaagggctcaaaagatagtattaacaagtgtgccccccttccctgcccaggtaaagaataagtgttatatttaaatattaacatgcatataataaaatattaacagctattaaaatgtaacaaaataaaatacacttatcattaaaataagcatcgtagaattaatcagtctatgatgattcagtcccttggaatcacctttttgtagatggattattactatatttattacttatgaaaacatctattaaagggaattatcaggtgataaaatctggaaaaataatcattttctatttatacaagttattgatacgtttggggtaaactttgtgcaactaatgaggaaactaacatacaacacactcctgaggaaatcattaactagtatgtactcatgataattcatctcatttttcttgatgtctattttggtggactaaatttcatatctcagtttttcttcttgactaattgttttaagttcaaatcctctaagctgaatatatttggggataacagaatgtagtagaaactgttttgtttactcaatctttcagcacattcattgtacacatatgttttcataacttttgtgaaacttttggaagaggcccatggaaaccatagaaccaaatgtgacgtggagaacatctgggtatgtttggttagttctgctgctgaattggagtcttcagctcattcctggtttataataaagtaacatgtatcaaagggttggataggagacattcttctctatattgccctcttgaaagactgaaaacccccttttcttaagtgtactagatgatctaattgggcttaatatgatttagtgagatataaattacaccaaaaaagaggtagagtaacacctactatttactaaaataaaaatctcttggcagtacattgctgtaggaaaggacatggcagtcagcttataaatgacaaaatatgtgataactttgtgttacatacagaactgttgtttggctaggcgtagtggctcacgcctgtaatcccagcactttgggaggccaaggtgggcggatcacttgaggtcaagagtccgagatcagcctggccaacatggtgaaaccccatctctaccaaaaatacaaaaagtagctggtcatggtggtgtgtgcttgtggtcccagctactcaggaggctgaggcaggacaattgcttgaaaccaggaggtggttgcagtgagctgagattgcaccactgtactctagcctgggagacagagtgagactctgtctcaaaaacaaaaaaaaaggactgttgttcgtagtgtatagtacataatacagtgtaatacctgtattataggcaaagctgtatatagttaaattaacctgtagtatatatatgaacatatatgtgtgtgtgtatatatatacacatatgtatacacgtatatatatatatacacgtgtgtgtgtgtatatatatatatatatatatatatatatatatatatatatgcattttaaccagaattttgttccgctttctgccctttctttgttgattacattaggattggatgcctatgaaacagtttatgaatgttacactagttctcctaggtggtattggaaaaaatttttttgagcagcatgttgatgttcctctagcaccctctgctggatttgagaattaattcattggactagaagatttaaaaaaattattaagaaggcttaaatttcattatgtctatcaacaaaccctactcttggaaggagtttgtttaaagatttgaagattttttgctgtccttactgagtaattgatagtttcagtaataataagcaccttataattttctgacatttcatttaaaatgagaagttgtgaaaataaagacatgatctccagtttattatttcaaccccctgtgttttgctctaagcaggaaaaacagaacctctttttgatttttggagtgaaaactagatcattaattaactaattaatatatatacaagaagtgaaaacttgaattttcgattcattatagaatcactgaatattctgcatttaacaaaatatatgactatcattttgataaagaagcatatatgctttttggaatctgagaaaatattttaaaattgttagccttgttttttttctctctgtgccctttatttgctttttttttaaaaaaatttatttccataggtttttgggaaacaggaggtgtttggttacatgagtaagttctttagttgtggtttgtgagattttggtcctttgctagcttttaaaatcatttattctcaatcctatgggctatttccttgtgactggctagacttttttttgacttacagaaactaaaatgagtatactaggtactgagaaaactgacttcagttctttaagggcaagaaccttatcctttatactttcttaaagaaaaaattagcattgggcccatctgggataatgctcattctggtgtgggctaaacataataatttctctgctacagtatgcatcatgctttatacctacaacctctgggggacccttgttctaaggcttcaaagtcagcatttagaaataactttttttccacaatgagaatcagaagtttaatttaggtggctgccacttcttgacattccaatcagggattctttatttttcaattgagatatacttcacatatcataaaactcaccctttaaaagtatacaattcaatgcttttaatatattcactatactgtgcaactattaccactatctaattccagagcgttttcatcaccccactaagaaatttcatatacattagcagctactgcccttttcgttctctccttcttccctatcctcctgcaaccacttaatatactttttgtctctggatttgcctattctggacaattcttatcaatgaaatcatacagcatgtggtcttttgtatttgacttcttttactttttttatatatgctttcaaggttaatccatggtatcacatttattggtacttcattccattttcttgctggataatattccattctatggattcacaacatcttgtttattcattcattggttgatggacatttgggtgcattccatctttggctgttataaaaaatggtgctataaacttttgtgcataattttttgaatctgttttcatttctcttgggcaaatatataggaatgtaattgctgggtcatatggtaactctatgtttaattttttgagcagctaccaagctgttttccacagcagccaaaccattttacattcctatcagtaatgtatgaggtttctagtttttccaattttcttccagtattttctgttatttaaattatagccatctggttttggtccaagatggccgaataggaacagctccagtctacagcacccagcgtgagtgatgcagaagatgggtgatttctgtatttccaactgaggtactgggttcatctcactggggcttgtcagatggtgggtgcaggacagtgggtgcagcccagtgagcgtgagcctaagcagggtgaggcatcgtctcacccgggaagtgcaaggggtcagggaattccctttcctagctaagggaagctgtgacagatggcacctggaaaatcgggtcactcccaccctaatactgcacttttccagtggtcttagcaaacggaacaccaggagattatatcccgcacctggctcggagagtcccatgcccacggagcctcgcttattgctagcacagcagtctgagatccaactgcaaggcagcagcgaggctgggggaggagcgcccaccattgatgaggcttgagtaggtaaacaaagtggcagggaagctcaaactgggtggagcccaccgcagcccaaggaggcctgcctgcctctgtagactccacctctgggggcagggcatagccaaacaaaaggcagcagaaacctctgcagacttaaatgtccctgtctgacagctttgaagagagtagtggttctcccagcatggagtttgagatctgagaacaaacacactacctcttcaagagggtccctgacccctgagtagcctacctgggaggcatcccctagtaggggcagactgatgcctcacacggctgggtacccctctgtgacgaagcttccagaggaacgatcaggcagcaacattggctgttcagcaatatttgctgttctgcagcttccgctgctgatatccaggcacacagggtctggagtggacctccagcaaactccaacagacctgcagctgagggtcctgttagaaggagaactaacaaacagaaaggacattcacaccaaaaccccatctgtatgtcaccatcatcaaagaccaaaggtagataaaaccacaaagatggggaaaaaacagagcagaaaagctgaaaattctaaaaatcagagctcttctacctctccaaaggaactcagctcctccccagcaacagaacaaagctggacagagaatgactttgaggagttgagagaagaaggctttagatgatcggtaataacaaactgctctgagctaaaggaggatgttcgagcccattgtgaagaagctaaaaatgttgaaaaaaggttggacgaatggctaactagaataaacagtgtagagaagtccttaaataacctgactgagctgaaaaccatggcacgagaactacgtgatgcatgcacaaggttcagtagccgatttgaacaagtgaaagaaagggtatcagtgattgaagatcagatgaatgaaatgaagtgataagagaagtttagagaaaaaagagtaaaaagaaacgaacggaacgtccaagaaatatgggactatgtgaaaagaccacatctacgtctgattggtgtacctgaaagtgacagggagaatggaaccgagttggaaaacactcttcaggatattatccaggagaatttccccaacctagtgaggcaggccaacattcaaattcaggaaatacagagaacgccacaaagatactcctcgagaagagcaattccaagacacataattgtcagattcaccaaagttgaaatgaagataaaaatgttaagggcaaccagagagaaaggtcgggttacccacaaagggaagcccatcagactaacagtggatctctcagcagaaactctacaagccagaagagagtgggggccaatattcaacatgcttaaagaaaagaattttcaacccagaatttcttatccagccaaactaagcttcataagtgaaggagaaataaaatcctttacagacaagcaaatgctgagagattttgtcaccaccaggcctgccttacaagagctcctgaaggaagcaataaacatggaaaggaaaaactgatacgagcccctgcaaaaatatgccaaattgtaaagaccatccatgctaggaaggaagaaactgcatcaactaatgagcaaaataaccagctaacatcataatgacaggatcaaattcacacataacaatattaactttaaatgtaaatgggctaaatgctccaattaaaagacacagactggcaaattggataaagattcaagacccatcagtgtgctgtattcaggagacccatctcatgtgcagagacacacatagccttaaaatgaagggatggaggaagatctaccaagaaaatggaaaagaaaaaaagtgggggttgtaatcttagtctctgataaagctgactttaaaccaacaaagatcaaaagagacaaagaaggctattacataatggtaaagggatcaattcaacaagaagagctaactatcctaaatatatatgcacccaatacaggagcactcagattcataaaacaaatccttagagacctacaaaaagacttagactcccacacaataataatgggagactttaacacctcactgtcaacattagacagatcaactggacagaaagttaacaaggatatccaggaattgaactcagctctgcaccaagtggacctaatagacatctacagaactctccaccccaaatcaacagaatatacattcttctcagcaccacattgcacttattccaaaattgaccacatagttggaagtaaagcactcctcagcaaatgcaaaagaacagaaattttgacaaagtgtctcttagaccacagtgcaatcaaactagaactcaggattaagaaactcactcaaaaccgctcaactacatggaagctgaacaacctgctcctgaatgactgctgggtacataacaaaatgaaggcagaaataaagatgttctttgaaaccaacgagaacaaagacacaacataccagaatctctgggacacattcaaagcagtgtgtagagggaaatatatagcactaaatgcccacaagagaaagcaggaaagatctaaaatcaacaccctaacatcacaattaaaagaattacagaagcaagagcaaacacattcaaaagctagcagaaggcaagacataactaagagcagaactgaaggagatagagacacaaaaaacccttcaaaaaatcaatgaatttagcagctggtttttttaaaagatcaacaaaattgctagaccactagcaagactaataaagaagaaaagagagaagaatcaaatagacacaataaaaaatgataaaggggatatcaccaccgattccacagaaatagagactaccatcagagaatactataaacacctctatacaaataaactagaaaatctagaagaaatgcataaattcctggacacatacactctcccaagactaaaccaggaagaggttgaatcccaaaatacaccagtaacaggctctgaaattgaggcaataatcaatagcctaaccaaccaaaaaaagtccaggaccagacgattcacagccgaattctgccagaggtacaaggaggagttggtaccattccttttgaaactattccaatcaatagaaaaagaaggaatcctccctaactcattttatgaggccagcatcatcctgataccaaagcctggcagagacacaacaaaaaaagagaattttagaccaatgtccctgatgaacattgatgcaaaaatcctcaataaaatactggcaaaccgaatccagcagcacatcgaaaagcttatccaccatgatcaagtgggcttcatccctgggatgcaaggctggttcaacatacgcaaatcaataaacgtaatccatcacataaacagaaccaatgacaaaaatcacatgattatctgaatagatgcagaaaaggcctttggcaaaattcaacagcccttcatgctaaaaactctcaataaattaggtattgatgggacgtatctcaaaataataagagctatctgtgacaaacccacagccaatatcatactgaatgagcaaaaactggaagcattccctttgaaaactggcacaatccagggatgccctctctcaccattcctattcaacatagtgttggaagttctggccagggcaatcaggcaggagaaagaaataaagggtattcaatgaggaaaagaggaagtcaaattgtccctgtttgtagatgacatgattgtatatttagaaaaccccatcgtctcagcccaaaatctccttaagctgataagcaatttcagcaaagtctcaggatacaaaatcaatgtgcaaaaatcacaagcattcttatacaccaataacagagaagcagagagccaactcatgagtgaactcccattcacagttgctacaaatagaataaaatacctaggaataaacttacaagggatgtgaaagacttcttcaaggagaactacaaaccagtgctcaacaaaataaaagaggatacaaacaaatggaagaaccttccatgctcatggataggaagaataaatatcatgaaaatggccatactgcccaaggtaatttattgattcaatgccatccccatcaagctaccaatgactttcttcacagaattggaaaaaactactttgaagttcatatgaaaccagaaaagagaccgcattgccaagacaatcctaagccgaaagaacaaagctagaggcatcatgctacctgacttcaaactatactacaaggctacagtaaccaaaacagcatggtactggtaccaaaacagagatatagaccaatggaacagaacggagctctcagaagtaataccacacacctacaaccatctgatctttgacaaacctgacaaaaacaggaaatggggaatggattccctatttaataaatggtgctgggaaaactggctagccatatgtagaaagctgaagctggattccttccttacaccttatacaaaagttaattcaagatgaattaaagacttaaatgttaaacctaaaaccataaaaaccctagaagaaaagctaggcaataccattcaggacataggcatgggcaaggacttcatgactaaaacaccaaaagcaatggcaacaaaagccaaaattgacaaatgggatctaattaaactaaagagctcctgcacagcaaaagaagctaccatcagagcgaacaggtaacctacagaatgggagaaaatttttggaatctactcatctgacaaagggctaatatccagaatctacaatgaactcaaacaaatttacaagaaaaaaacaaacaaccccatccaaaagtgggtgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcaatcattaaaaagtcaggaaacaacaggtgctagagaggatgtggagaaataggagcatttttacactgttggaaggactgtaaactaatttaaccattgtggaagacagtgtggcaattcctcaaggatctaaaactagaaatacggtttgagccagccatcccattactgggtatacacccaaaggattataaatcatgctgctataaagacacaggcacacgtatgtttattgcggcactattcacaatagcaaagacttggaaccaacccaaatgtccaaccatgatagactggattaagaaaatgtggcagatatacaccatggaatactatgcagccataaaaaaggatgagttcatgtcctttgtagggacatggatgaagctggaaaccatcattctgagcaaactattgcaaggacaaaaaaccaaacaccgcatgttctcactcataggtgggaaatgaacaatgagaacacttggacacaggatggggaacatcacacaccggggcctgtcgtggggtggagggatgggggagggatagcattaacagatatacctaatgtaaatgatgagttgatgggtgcagcacaccaacatggcacgtgtatacatatgtaacaaaccttcacgttgtgcatatgtaccctagaacttaaagtataataaaaaaaagaaaaaaaataaattatagccatgtagtgggtgtgaaggtatctcttcatgtttttagttttcatttccccagtgactaatagttttgagcattatttcgtacagttattggtcatttacatatcttttttagacaaatgtctaagtcctgtactcatattttgagttgtccttttatcgtatgatttctttttttattctggatactagaacgtgctcagatatatgatttgtaagtattttctcccattctttaggttatcttttcattttcctaataaagtcctttgatacacatgttttttgtcttttagttttaattttgtattgttacataaaatttatatatatttatggggtacatgtgttttttttatgtgcatagaatgaaattatcaagtcactagttaggctattcatcatcttgaacattgatcatttctatgtgttaggaatatttcaagatctctcttccagctattttaaaatatacaatacattgttgttaactgtagtcaccctactctgctatctaactttaggacttattccttctaactgtatgtttgtacccattagtcaatctgtcttccctgccacccacaccctgacaccctttccagcctctgataactatcctaactgtcattctactctctacctccttgagattaactttttttacttttattttttaattttttagaatttttttttttttgagatgaagtctcactgtctcacccaggctggagtgcagtgtgcaatctccactcactgcaacttccacctcccgggttcaagtgattctcctgcctcagcctcctgagtagctgggattacaggtgcccgctacgacacctagctaatttttgtatttttagtagagacagggttttgccatgttggccagcctggtcttgaactcctgacctcaggtgatctgcctgcctcggcctcccaaagtactgggattacaggcgtgagccaccgtgcctggcctatagttttttttttttaatagagatgagatctcacttttttatagagattttgctcagactggtcttgaactcctgacctcaagcaatcctctcacctcagccttccaaagtgctaggattacaggcatgagccaccatgcccagccgagattaacttttttagctctcacatacgagtgagaacgtgcgatatttgtctttttgtgcctggcttattttacttaacataatgacctctagttccattcatattgctgcaaatgacagcatttcactcttttttttatggccaagtagtattccattgtgtatatataacccactttctttattcatttgttgatggacacctaggttgattacatacctttgctattgtgaatagtgttgtaataagtttttaatttctatgaagttgtttgtttgtttgtttgtttgtttatttatgcttgtgcttttgctatctgagaatccattgccaaatctaaggtcatgaagatttttggattttttttgagacagggtcttgctgtattgctgaggctggagtgcagtggcatgatctcagctcactgaagtctcaacctcctgggcccaagccgtcctttccactttagcctcccaagtagctgggaccataagtgtgcctcaccacacccggctaatttaatttttttgtagagaccaggtttgactatgttgcccagactataaagatttacccctatgttttcttctaagagttttatggtttttagctcatatatttaggtcattgatccatttagaatttatttttttatatgatatgaggtatgggatccaaatttattcttttgcctatttatatccaattgtctcagcatcatttaatgaaaagatgaatcttttccattgagtggtgatggcaccattgtcaaaaataaattgaccacccattcatgagtttatttctggactgtcagttcctttctgtggatctatatgaatctatatgtgtatccttttgctggtaccacattgttttgattattgtagcttttttttttttttgagacagagtctggctctgtcacctggctgaatctttgcttactgtaacctctgcctcccaggctcaagccattctctcaccttagcctcccttgtagctgggtttacaggtggccaccaccacacttggctaatttttgttttttgtttttgttttgatagagacagggttttactatgttgcccaggctggtcttgaacttctgtgctcaagctgtccacctgtcttggcctcccaaagcactgggattacaggcgtgagccaccatgctcagctgatcactgtagctttgtagtgagttttgcaattatgacatatgtcttccatctttattcttctttttcaagattgtcatgttaacgttttgataagtctttagtaaagaaaattgtttggcttaattttgtgtttctcacatgcttctgatgatgtaattgcttttttatataatagctaagaacatcctgtgggactggtattctgtggaaacattttttgagaagggtgggaaaaaagtgactatgtggggaatattttctttgccttatcttatcacgtcagcaatatatgtaggaatagtttgagttaaactcccacttcccatttactttttctgtttagtcgtgaaagtcttaattcattctagtggttttttgttgttgtcattgtgaaaatatatacctatatatttttagctggggtctcgttcctcttgcctaggttggagtgcagtagcaccatgacagctcactgcagccttgatttcctgggctcaagtgatcctcccacctcagcctcccaagttgctgggactacaggtgcacatcaccatgcctggctaatttttgaattttttttgtagaattggtgcttcaccatgttgcccaggctggccttggactcctgggctcaagtgatctccctgagttggccttctgaagtgtggggattacaagtgtgagccactgtgcctggcctaattttgttaattgggtaaataatgataccattgccatactacccccttaactttaataactttgcttttgttgtttaaaaaatgtttctcaatatggaaaatttcacacatacatgaaagtagaaagaatattatagtgaaccaagtgcctatgatttagcttcaacagttatcagcttatgaccaatcttattttatgaacactaacccccacccctaactcccagtttgattattttaaaccatatctagacattatatagtttcatccctgaacactttagtatgtattttttaaaagataagggtttattttatttattaattaaaaaaatttacttagttaattcttttatagagatgcagtttttctctgttgcccaggctggtctcaaactcttggccccaagcagtcctctcacctcagcttcccaaagtgacgggggccactgtgcctggcccaaagattggggtttaaaaaaattctaatcattatcacacctaaaaagtaataataattccttagttacatcagatatccaaatgtcctcatttcttggttttcagagtgttttgagtcttcagacaaaactgtgaatatttactagtttcacctttcagcggaatgcctgttatttttaaatactctagtagtataaattataaatgtcagattttattcaaagtattattttatcctttggatttaaattaccttgagacccaaaaggatcatatttggatttattgctttctgtaaaaaaaaaaaaccaaaactattttctagtataatagctcattaagaaatattttccatagggttgtagaatctaaataaagcaaatagttcattgtaaaagaatattttgtgattttcatgtttgcaaaacacagagtgattatatcctgaagcaggattactccatgactgtgaaggccatcagaaccaggtgcatctacaaaggcctctagagaagaagggatgtttgtgtttatgctctgcactatgatagtcattatgggaatgatttgcccagaaagaagtatagtcatttctaagttattcacagactgcttgattagtttgtggattattcagtttttatttctatttcttttcattgtgatccattaccatctttgtctgtaaacaaaaagaaatggtgggagagaaggaaagtcagattaatcaagttgaacattaataaaaacttggctaagggggtggagccaagatggccgaataggaacagctccagtctatagctcccagcgtgagcgacgcagaagacgggtgatttcagcatttccaactcaggtactgggttcatctcactggggagtgttggaaagtgggtgcaggacagtgggtgcagtgcactgagcgtgagccgaagcagagtgaaggatatgaacagatgagttcatgtcctttgtagggacatggatgaagctggaaaccatcattctgagcaaactattgcaaggacaaaaaaccaaacaccgcctgttctcactcttaggtgggaattgaacaatgagaacacatggacacaggaaggggaacatcacacaccggagcctgttgtggggtcgggggagcagggagggatagcattaggagatatacctaatgttaaatgacgagttaatgggtgcagcacaccaacatggcacatgtatacctatgtaactaacctgcacattgttcacatgcaccctcaaacttaaagtataaaaaaaaaaaacttggcttagggtaaatggtttagtaaatataatgaatattaatttattttttcgccaaatttcatctaggaagggaaatcaaattagtaatgcctttttctgtccctattgaactaccccattgacagataggactctaggcatggcttttctttgctactgttatgttgagacatgctggatgttcccatagttctgtttttctgtcccgaacagattcttggtcatgaccgattccctttttgggactagtaatccgctacttcccaggggtgcattttctgaacaaaaattgtattcaaaaataaagatcttgacttctgcttctgtccagaaactgactcttgcctgaaaaactgataaattagacttcatcataatgaaaagttttggtttgcaagtgatactgttaagagaaggagaagacaggacgtagactgggagaaaacatttgcaaatcatgtatctaacaaaggacttgttttcagattgtataatgaacttttaaagctcagtaatacgaaaataaacagctcaattaaaaaatggtgaaaatatttgaacatatacttcttcaaagaagatacacagttggcaaataggtacatgaaaagatgctcagtgtcattagtcattggggcaatgcaaattaaaactaaaatgagataaccactacatgcctatttgattgtctataaaacctcaagaaaccaaaaacagaaaatgaccgtagcaagtgttggtgaggatgtggaacaatggaaaatttcaaaaattggtgttagtaatctaaattggcaccatcgctttggaaaacagtgtggcagtttcataatattcaatatggctgggtgcggtggctgacgcctgtaatcctagcactttgggaggccgaggcgggcagatcacgaggtcaggagatcgagaccatcctggctagcacggtgaaatcccgtctctactaaaaatataaaaaattagctgggcgtggtggccggtacgtgtagtagtcccagctacttgggaggctgaggcaggagaatggtatgaacccgggaggtagagcttgcagtgagcctagatggcgccactgcattccagcctgggtgacagagcgagactccgtctcaaaaaaaaaaaaaaacaaatcaatatgtacctgtcatttcacccattcattccattcttcactatttaccccagagaaatgaaagtgtgtgtctctacaaagtcttgcacacaaatgctcatagcagctttatttgtaattgcctaaactggaaacaagtcaaatgtccatcagtaggtgaacagataaaccaattgtggtctattaataaagtggaacactatttaacagtgaaaatgaatgaactattgatgcatgcaaccacatggatgggtctcaaaataattatgtaaggggaaagaagcctggcaataaaaagcataatatatgattcaatttatatacaactccagaaaatgcaaacctctctgtagtgacaaaaagcagattcgtgattacttgggtatgtggtggggtggtgagggctggaggaaggcattaccaagagacataaggaatcttttaagagtgatggaaatgtttcctgtattgattgtggcagtgatttaatggatgtgtacgtgtttgtgtgtgtgtgtgtataaaaatttatcaaaaagtatattttcactatgtgtaggttattatatgtaagttatacctctataaagtgtaaagaaaaaaaagcaggctctggaagcattcttcctgagcatgaattttacattccattcttgcaaagaaaaaaaaaaatgaggctgcaagtccactaatctaaagtgttaattataatgctggactgtagtgatccatatcttctttaaataccaatgtttatgaatttaaacttttaatttgttttcaggcaactactctaagagtgaggaaattagaagaaaacattgaagcagaaagagcagcgcatttggaatcaaaatttaattctgaaattattcaggtaaaatgtaaacaaatattttggcctgcattttcttaatttgtgttataacagctgggaaaaacagcactgtgttcagagaacgaaggtgtgcattgagaatgggtaacatattgttatgacactcattattgtatataaggttaggatacagttgagatatgctaccttagtggaggagttggcacactatagcctacaggccaggtctcacccactgtctgttcttgtgaagttttgtcttgtccatagctacttttgtggcagagtggagtagttgtgacagagaacttacctggcagtctgcaaagaaatttgcagattggagtgttcttttacggctgtgggatggatttctttttgagaacgttgaaaaaatgtgcatgttatttattgagtgcatatcctatgcatatcactgtattaagagctgaaggtgtaaagatgaatgagctccttttgtaacttacattttgttgtcagagatactatatatctatctccagatatatagatgcttacatagaagtacaaaatactgaaatacaatgggaatataataaagaaaaggattaaatctgggaggggaattaaatggaggcctcctaaggaaattatcctttttgctatgctttagagaatgagaaggaatttctaagagaagtgagagcagggcattttattaggggttggcacactactgcccatgggccaagtctgacctgcagcctttttctgtaaagttttattagaagatagccatgcccatttgtttacatattgtttatgggtgcttgtcgagacagaccttatggtccacaaaaactgaaatatttactctgtggccctttacagaaaatgtttactgaccactgttctgaacaactgcttggataaagccactaaataaaatgtacttgtttatttttgaggaatacttgcagtgttgagtggtagagcttagggaaaagtttggagataatggtgggaaggcatgatgaagactaattatggaagtcctttttcgtgctaagaaacttagacttattttgaaagcaatggaaagccactgcagcttttgggacagacagatatgaaatctaagtttaggaaaataactctggtgccatattggtagataaaggaagggagtgaagataggaggctgggtgaagagatgatgaacacctgaatcaagacaacgactgtagcaatggaaaagagggctcctgtggcagaataacagtccctcaaagatgtccacatctgcccttatcctcagaacctgtgaatatgttaccttacatggcaaatgggactttgcagatgtgatttatttgaggatcttgagatgggagtttgtcccagtttatctagttgagactgatgtaatcataagagtccttataacagggaggcaggagggtcacagtcagaggcagagatgtgatgacagaagcagaggtcagagtaggtcaccatgaacccaggaatgtgggtggcctccagaagttagaaaaggcaagacaagatttcttccctagagtctccagaaggaatggagtcttgctgacacgtgactttagccccagaagacccatttcagaattttgacctccacaactgtaagataatacatttatgttgttttaaattgccaatttgtggtaattggtaatagcagtgattggaaaggtacaggggacaaactgagaatgcatgattttaggtaactaatttgcagtgtgaggggagggaaggagcaatagaagagaacaccaaggtttgcagtatgtgtgaaagtgggcagatgcagttgactgtcaaactctgaagtctgaagagagacaatggtaagttttgaacatgttgactttgaggagcagtttaagaggttcatagtgccctttgaggatatggtcatgcaaagttacctgaacaatgtacatttactcttgacatcctgctttttgtgaacagatcctttctttatattctctcaagcaactgccggtagcttatcttggatcagccagtttcccaggtgttaggaaagttaaggaaattacataggaggagatttgttggacctgctactttcttgattttaatattttatagacagttatgacttttcgcttaaatgttttctcagcatttgataatatgctttaaaatctaataaatatggtatttgttatgcttctgttaaagagattaactttaatgaagattgtatacctataatagtatttttgtttgcttaaatctaggaaggtagaaagtatctttatgaacttagattctcagtataaactgttaagatgttcttatttcatgttatttagctggtcagttattacatttgagcactactttgtgaacaaatgtaatagactgtatgaaaataaaatatatgcacttatttccagaagaaaaagtagttttaagcttatttggctttagcaagtttgaaaatcatctcactttatttgtgctcttgaatttcatatcaagtaggatggtgggattgccaaaatcagtaaatgaaaagtagctataagcagatagattaaaactagtttagactaaaaaagttattgccttgatttaggtgtttattatcttttcacccaacctcctatcaccactccgttactttatttgccaatgttagttaccagaattatttttctaaaacttagatttgatatctacatcaaaggctacttatattaaaagctactgctttcaatatgtctaaattacttaatttaatttacatttttaaagacttacacttttttcctatcttgttttaattaatgcaatttatagtgttttaccttattgtttaaagaactcccaatgtaagatacaactgtatttgtaaagatttggtattaaaatttatgtttttacttttgactttaatgaaatgttctttttacctaaaaattctcagatccctatatttgagcatgtctgtttgttaaagcaaacttacatacttttctttaagatcaggtcactaaagtggcatcaataagtaataagactgaagttttctttttcttttcttttctttgtttccttttatgatttcagcttttatttagattccgggggtacatgtgtagtttgttacctgggtatattgcctgatgctgaggtttggggcatgattgattttgtcacccaggtattcagcatagcacccaattgttaatttttcaactcttgcccccttcctgcccttttccctctagtagtccccagtgtgtattgctgtcgtctttatgtccacaagtatccagtatttagcttctacttataagtgagaacatgtggtatttggttttctgttcctttgttaatttgcttaggataagggcttccagctgcatccatgttgtagcataggacatgattttgttcttttttatggctgcgtagtaatccatggtaagtatgtaccacattttctttatccaatccatcattgattgatgagcacctgtgttgattccatgtctttgctattgtgaatagtgctgtgatgaacataaaagtgcatgtgtttttttggtagaatgatttattttcttttggatatatacccagtaatggggttgctggatcaaatggtagttctgagttctttgagaaatctccactccactttccgcagtggctgaactaatttacattcccaccaataatatataaacatttccttttctcagcagcctcaccagcatcttaacatgctgtttttttgccgggcgcgggggctcacgcctgtaatcccagcactttgggaggccgaggcgggtggatcatgaggtcaggagatcgagaccatcctggctaacacggggaaaccccatccctactaaaaatacaaaaaattagccgggcgtcgtggcgggcgcctgtagtcccagctactccggaggctgaggcaggagaatggcgtgaaccaaggaggtggaggctgcagtgagcagagattgcaccactgaaatccagcctgggcgacagagcgagactccgtctcaaaaaaaaaaaaaaaaaaaaagtaacatgctgttttttgactttttagtaataggctgaagttttaaattcatgaaaaaaatgtaatttcaaaattaggtttttcattgtagttgtgatacatccctgggaatatatagttaattactataaataagaaaattattacctattttttacttatatggtttaaaattaatatttgatatctcagtgctatgacttagaaaaagtgaaaagtttatatttgaatcataaatctataaatatttacaagtattttcaatgaggtacatctactacctttcggtttcagagcagtttaatggaaagtagagtactaagtagctataactaatcaccatcttataaactactgttgaatatgtatttgaaatttgttattgtttgtatattttggcataaaaatgagaaagcagacttaaaagagttgactcaaatttgttattttgtagtctatttttctttcaattgattggtttaccatttgtgattgagtgtgcttattttctaaaagaaggtagcaatgtagacaagaagaaaatattccccagatttactgtttggcttacaaacattggatttagacaaaataacaaagaaaaatagagtttaagaggtacaattaaaaaatttaaatcgagttgtatctacctattttactcccttagtttagtataagaataaacgtttcatgccaggtgcagtggctcacacctgttatcccagcactttgggaggctgaggtgggcagatcacttgaggccaggagttccagaccagtctggccaacgtggcgaaaccccgtctctgctaaaaatacaaaagttacctgggtgtggtggcgcatgcctgtagtcccagctactctggaggctgaggcatgagaattgcttgagcctgggaggtggaagttgcagtgagccgagatcgtgccactgcactccagcctgggtgacagagtgagactctgtccccatcccccctcccccccaaaaaagaataaacatttcaattattccagaaattttggataattaaaaataattctggtgattatcatttttatggattaatgttgaaacattttcatagtgtcttaggcttcatttcctggtgagtttatctttcttaactcaggttgtgtgttgccattcctgtgacgcttgcctcacacagagttccgtaacttttctctgaattcaggacctttgtgcatgcatctgtcacaggaagcatataccatattatttcgcagtctatgttctcttaaaacctatcagctcctcaagatctaagactgtgtagtttcattattgtatgtatcttgagcattaggatattgactggcatatattaagtacttaataaatattgattaaataaacattgccagttggacacggtggctcacacctgaaatcccagcactttgggaggctgaggtgggcaaatcattggaggtcaggagttcgggaccagcctggccaacatggtgaaaccccatctctactaaaaaaaaaataccaaaattagctgggtgtggtggcaggcacctgtaatcccagctactcaggaggctgaggcaggggaatcgcttgaatccagggggcggaggttgcagtgagctgagattgcaccactacactccagcctgggggacaacgcgagacttcgtctcaacaacaacaacaacaacaacaacaacaacaacaacaacaacaaattgcctgattagatccttgtagccaccccgcaaagtagatagtctagttgacattattattattcactatttatagatgagaagcctcaaatatttggagttttagtaatacgcccaaagtcgcattagttaattttgtagatctgggattcagcctgagttttgttggtttgtttgttttattctaatatctgttatgtttgcacagcgtcaaacccaagttttatggttctaaagcccattttctgtctaatgtgaagcattttttttctatccccaccccgtctttaaactattttctaaaaagaaactatttttcttttaaactttattttctgaaaaggtaaactatctacagagttaaaaaattaaaacaatattagatcaagagttcttgctttattcttgtccctcccattcctctaccctcctgcctgcttatttttattcttttcacttatttacgccaaatgtagcatactatatacgctgatgtggaacctgctattttcaacatatgttagcaatacattgttcttgaacactatgtggagaactacatagagaattttctttttttttctttttttttttttttgagagggagtatcgctctgtcacccaggctggagtgcagtggcgcgatcttggctcactgcaagctctgcctcccagattcatgccattctcctgcctcagcctcctgagtagctgggactgcaggcgcccgccaccacacctggctaatttttttgtacttttagtagagatggggtttcaccgtgttagccaggatggtctcgatctcctaacctcatgatccgcctgcctcggcctcccaaagtgccgggattacatgcgtgagccaccgcgcccggctgagaattttctttttagtagttgttttgaaaaaagaataaactcatgtattttacagcaacatggatggaactggaggccattatcttaagcgaaacaactcagaaacagtcaaataccacatgatctgacttagaattgggagctaaataatgtgtacatatggacatagagtgtagattaatagtcactggagactcaaaagggtgggatgctggaaatggggttgagggatgagctattacttaatgggtacagtgtaaactattgggtgttggttacactaaaaatccagacttcaccactatgcaatatatccaggtaacaaaactacacttttacaccttaatttatttatttttgagacaggttcttgctctgtaacccaggctggggtgcagtggtgcgatcttggctcactacagccttgacttccccagctcaagtgatctgcccgcctctgtcccccaagtagccggcattacaaacgcgtgacaccacgcccagctgatttttgttttttttgtagagatggggtttcaccatgtttcccaggctggtctcaatctcttgagctcaaatgatctgctcaccttggcctcccggagtgttgggattacaggcatgagccactgtgcttggcctgtaggcccttaaatttatacacacacacacacacacacactcacacgagttgttttgtagcctttttacagctacatataattattttgttggaatctcttgtttattcatcctatggttggtggacacagggaatatagttttgtttttttttttttttttttttgagacggagtttcactcttgttgctcaggctggagtgcaatggcgtgatctcggctcactgcaacctctgcctcccaggttcaagtgattctcctgcctcagcctccctagtggctgggattacaggcacgcaccaccacgcctggctcattttgtatgttttagtagagacggggtttctccatgttggtcaggctagtctcgaactcctgacctcaggtgatttgcccaccttggcctgggagtatagttttaaaatgtctttttatgtagaatttcaagtatatgcaaaagtaaaatagtaaaatgaacttcccacatacccatcgcccagcttcaatactttactcacgtcaatggtgttttatctcttacctcctggaactctcccagtttcagacctaaacatttttttttaaattttttattttgagggaaggtctcactgttaatcaggctggagtgcagtggtgcaatcacagcccacggcagcttctgactccctggctcaaacgatcctccctctttagcctcctgagtagctgggactacaggcgccggctgcctccagactattttgaagtaaatcccagatatcaaataacgataaccataaatatttcagtcaaatagtattgtttgacaataagaagatcacttttctatagtaagaaatctcaggaataaaaagatctgttaaatttcttaggcttataaagatactcatgtaataatgtttcttgtaagagaggaagaatacttccctttagttttcaaaaaccaggccaggagcagcggctcatgcctgtaatctcagtgctttgggaggctaaggtgggaggatcacttgaagctaacagtttaagaccagcctgggcaagatagcaaggccctatctctacaaaaaataaaacaattagctgggtgtggtggtgtgcacctgtagtcccagctacttgagaagctgaggtgggaggatcacttgagcccaggaattcaaggctgcagtgagctatgatcacactactgcacttcagcctgggtgacaaagtgagaccttgtctcttaaaaaacccaaacatttaatttattatattttataaaagaagtatctgaatggattagtaggtaaaaatttgaaactttgaaaatttagattgagttgtatctacatatctatttttctttgatagaatgggttatattgtaccagcctatctttcataacacagttaactcttcattcttctactctttctcctttcatttaaacatattgagaaagggaataaactgtcttttatttatttttcttttttaagccaaagcagaaagaaagaagtgcttggatgaatgataatctgttactgacaaagtattctactcaatttaagattgatgctagcatttcttagcttgatttaattacttgtctgtcgtccggtagttacggattcgagaccttgaaggagctttgcaagtagagaaggccagtcaagcagaagctgttgctgatttggaaattatcaagaatgaattcaaagaagttgaaagtgcatatgagcgagaaaagcataatgcacaagagagctttgcaaaactaaatttgtaagtattctattgtaaaattctctaaattaacataaagattttaaaagagctatataaaatatgaatgtatactatgtattttagatatagctcccattaatgtcagtggtagactggggcaagtgacttcataaaacataactatactttcctgtataggtaaaaatggaaatgctcttttggatattgaagtatattccaagtagcccaagaaattgagtaataaactagaaagtaaatacattaatgtagtttgtattatatgagtgatgtaacgcaatatctttaagtatcaagaccagcttgggcaacatagtgagactttgtctctacaaaaaaaataaaaaaattagccaagtatagtggtgtgcacctgtagtcccagctactcgagaggctgaggtgggaggatcacctgagcccgggagttcaaggctgaagtgagctatgatctaaggctaagatctggggctaagatttctaagtcacataaaatggtctatatgaagatggataatatttgacattttctcaaactacagaaataataataatagcagtaacactactactaatagtggccaacatgcattgtggctcacttcatacctagcattgcagtttcatttgtctaacaccgtatgaggaaggtattttaaaaaatctcttttacagatgtggaaattgaggctaaacaagagtaaggacatacagctcctaagtggcagaattagaatctttctgactcctactgattttaacctttttcagtttaaaagcctttcatcttcaaaattctgtgaaatgatttaagaagtttataatgcattaatatgtttccaaaaataagtcaatagtagacattttaaaccatttccccccccagagggtgaaattcatactaccattagtatgtggcatgataatacattggcatattagaattatattttaatcttagtttctatttatggcaagtagataatggttttccatttatagccacaatataaagatcccttttaaaatgctttattggctgggcacggtggcttacacctgtaatcccagcactttgggaggctgacgcgggtagatcacctgagttcaggagttcgagaccagcctggctaacatggtgaaaccctgtctctactaaaaataaaaaaattagccaggtgtggtggcgggcacctgtaatcccacctacctgggaggctgaggcagaagaatcacctgaacccgggaggcagaggttgcagtgagctgagatcgcgccattgcactccagcctgggcaacagagggagactgcatctcaaaaaaaagagaaaagcttcatttattataagaagtgagttaacttaagtgaaagtgtgatttaaatagcggtaatttttgtgagtgtgacaaaaatcacgaagattgcacctgaaagactgaaaacattaaaaactcttaaactgtttgtttctttaattaataatgcttataatattttaaaccaataattcttaactgaatttccttgcttccctctagtatgacttaaatgacattctgtgaatgttattctaaggacttatttatcctttatgttctttgaaccattgcttgaatgcatacatttaatacatttgaatgtattcaaatattattcaaatatgtattcaaatattattctgcatataaatctatttgaaaggcttttatgtagaatatagtgcagatttctttacttttgctttaaggtaatgattaggacctacaagtaaaactgtaagaagtcagaatgagctcccaataattaaagctttctagcaatgaaataatagacatctttcagggaactagtgagttccctgccttgggaaattcaaaacacagagtggatgattctctgtcatggatgttgaagaagagagtcttataaagattggactggaggaattttaacctacttgctaacacttaagctctgagtctaacctatatactttcctaattggaccccaaagcagtttttttccttaagttttgttttgctgttatttgtattttggtacttgaaaatttttactcaaatttagtattccagtaagcaccaactgacaattctaaacattagttacatattccaactaggcactagctaactaacactcctaatgctttaacataatgtcccttatatcttcttcatctgtatataactgtcataataatacaagttaaataataataaataaataatgacaagtaataactaaacccaataatcactgaaaatttctgtgactttccttttccatcccatcttccttttccgtgtatgtgaaatgaaagccacttccatccctactatctgtagtataagaaggaatgatgtgacttgagggatctacctgtacttccattttccattttctgcctgtacttctgaccatacttcagaatcatctttaaaaaaccttttttaaagatgattctgaattttttaaatattttttaaagaagattctgaatttctgaaaaaaattctgttgtttcaaagtagttctaagttttggttaatgtattccaaatagagaattgatagattttaggtctttaaggtaaataatacctttaacttacaactttgagaatgtggagttttggagcagtatattgttttacctgttgtgaactgacgtagcagtttatcatgcttgaacctgccattggttaaggttctttaagcttctgtttcttgccaggcagacctcggcaggatctcactaaaggcaggagaaaaaaagctgtgtgtatattgcagagttatagttttggtccatagtttcataacagtagacattcctacatgaaattattttagatggaatgtatatattccataattctataatcaaaatttcttagaataaatttttttccatctaaaacttgcagtatgaaaccaaagcttttcaataatcttttgttttctttttaaacattttttatttttaattatgggtaaataatagttgtacatatttatggggtatgtgtgatatttttatacaagcatacaatgtgtgatgatcaaatcagggtaattgggctatccattaactcaggcatttatcatttatttatgttaggaacattccaattccacttttttagttattttgaaatatgtgatagattattgttaactatagttgccctgttgtgccaccaaacactagatcctgttccttccatctaactgtatttttgtacccattaaccatctgaattttcaaatatagtaaagtcttcattagctgtgacaactgattgctgggcaatagtagggagaaagagatcatagtaatccttaggtatagttgaaacataaatttaatttgaaacatcattagtcaaatatatcatgctgaatggactgcatctaaatttatttcttagactcaatatttaggaatttatttttctaaatatatcacccaaaaggataaacatatcaacggtattgtaacttagtagcattatttttgtttacattatatgtaaaacatagtccaaagatggctatttgttaaaataccctgttattgtcaaattcttagctgaagtcttaaaaaaaaaaaaaaaaaaaaaagaatgggactccagtaggaaagaagggatcctagctacaaacttacttctcctctcttccctttcttgcctaaatcctccaccttttaagtcctggccctttcccatcagaattcagagacaaggcatctccttaacctgccctactcttgctccacttactccttcttggttgggagtttagcagcatggtaggagccagcttttttgtccgccagaatgctcaacagcaaggtgtgttcccccatttcagtggacacagtttggcctttatttataaaatagtaccaaaaaaaaagctgtgtgtgtattgtgtgtgtaatgacagatgcacttaattatctattttttgagtaacagcagtttttaactaaaatcttgattttatcaaattaatacatgtacacagtctaatgaataaaatggtactgttaggctcatgaaaaacagcagtttcatgccccattgctctctactatcagtttctactcctttgatgcatctactttcaaatcttattgctggttcttctgatatttgatttcatatttctaaataacaggcatagtatgccatttttttcagtttctacctttaaatatctattggcttctacttatatatctctattatatgcttctcccacaccacagacactccttccctcttcccatcctttccatagagttatatttttgggttcagcatactttattttttctacagtttaatttttgttaacccatctttttttatagcacattttattgtgttctttgttatttattgtctgtcttatgtaacaagaaactttgttttgtttattgctgtcttgtcagtgcctagaaaggtacataagagctgctaaataaagatttatggaattgggctggatgtggtggcttatacctgtaatcccagcactttgggaggctctggtgggaggattgctggaggccgaggtgggggaggattgcttttggtggcgcatgtttgtagtcccagctacttgggaggctgaggtataaggattgcttatgctgagtagttcgaggctgcagtgagctatgatcatgccactgtacttcagtgtgggcgaccaagtgagacgctgtctaaaaaccaaaacaaaacagaaaatacttgcagaatcaacagatgagaatagttaataattgcctcattttaaactgtattagttcatgtgattaaccaatcacttattaaattatttgtaaacactaacagaaccgaaagtctctcatgttcctacacctcagagacgctatcattttaaatttcttctaagagatgttcctcctggactcttctgtctactttttccagtctggaaaagttttttttttaaatttatttttatctttattttttggccttaagttctaggatacatgtatacaacgtgcaggtttgttacataggtatacatgtgccacgttggtttgctgcatccatcaactcgcttacattaggtcttcacattaggtctttctcctaatgctatccctcccccagccccccaccccctgccaggccccagtgtgtgatgttccctgccctgtgtacatgtgttgtcattgttcaattcccacctatgagtgacaacatgcagtgtttggttttctgtccttgtgatagtttgctcagaatgatggtttccagcttcatccatgtcgctgcaaaggacgtgagctcatccttttttatggctgtatagtattccatagtgtatatgtgccacattttcttaacccagtctatcattgatggacatttgagttggttccaagtctttgtgaatagtgccgcaataaacatacatgtgcatgtgtctttatagcagcatgatttataatcctttgggtatatacccagtaatgggatcgctgcgtcaagtggtatttctagttctagatccttgaggaattgccacactgtcttccacaatggttgaactaatttacactcccaacagtgtcaaagcattcctatttctccacatcctctccagcacctgttgtttcctgactttttaatgatcgccattctaactggtgtgagatggtatctcattgtggttttgatttgcatttctctgatgaccagtgatcatgagcgttttttcatatgtctgttggctgcataaatatcttcttttgagtagtgtctgttcatatcctttgcccactttttgatggggttgtttgtttttttcttgtaaatttgtttaagttctttgtagattctggatattagccctttgtcagatggataaattgcaaaaattttctcccattctgtaagttgcctgtttactctgatgatactttcttttgctgtgcagaagctctttagtttaattcaatcccattttgtccattttgacttttgttgccattgcttttggtgttttagtcatgaagtctttgctcatgcctatgtcctgaatggttttgcataggttttcttctagggtttttatggttttaggtcttacatttaagtctttaatccatcttgagttaatttttgtataaggtgtaaggaagggatccagtttcagctttctgcatatggctagccaatttctgaacaccatttattaaatagggaatcctttccccgtttcttgtttttgtcaggtttgttgaagatcagatggttgtagatgtgtggtgttatttctgaggcctctgttctgttccattggtctatatatctgttttggtaccagtaccatgctgttttggttattgtagccttgtagtatagtttaaagtcagatagcgtgatgcctccagcttgctttgttctttttgcttaggattgtcttggcaatgtgggctcttttttggttccatatgaactttaaagtagttttttccagttctgtgaagaaagtcattggtagcttgatggggatggcattgaatctataaattaccttgggcagtatagccattttcatgatattgattcttcctatccatgagcatgtgatattcttccatttgtttgtgtcctcttttatttccttgagcagtggtttgtagttctccttgaagaggtccttcacatcccttgtaagttgtattcctaggtatttgattctctttgtagcaattatgaatgggagttcactcatgaattggctgtctgtctgttattggtgtataagaatgcttgtgatttttgcacattaattttgtatcctgagactttgctgaagtagcttatcagtttaaggagattttgggctgagatgatggggttttctaaatatacaatcatgtcatctgcaaacagggataatttgacttcctcttttcctaattgaatacgctttatttctttctcttgcgtgattgccctggccagaagttccaacactatgttgaattaagtgagagagggtctccttgtcttgtgctggttttcaaagggaatgcttccagtttttgcccattcagtatgatattggctgtgggtttgtcatatatagctcttattattttgagatacgttccatcaatacctagttcattgagagtttttagcatgaagggctattgagttctgtcaaaggccttttatgcatctattgagataatcatgtgatttttgttgttggttctgtttatgtgatggattacatttattcatttgcatatattgaaccagctttgcatcccagggatgaagccaacttgatcgtggtggataagctttttgatgtgctgctggattcagtttgccagtattttaatgaggattttcgcatcgatgttcgtcagtgatattggtctaaaattctctttttttgttgtgtctctgccaggctttggcatctggatgatgctggcctcataaaatgagttaaggaggattccctctttttctgttgattgaaatagtttcagaatgaatggtaccagctcctctttgtacctctggtagtatttggctgtgaatctgtgcagtgctgggcttttttttggttgagaggctattaatttttgcctcaatttcagaacctattattggtctattcagagattcaacttctttctggtttagtcttgggagggtgtatgtgtccaggaatttatccatttcttctagattttctagtttatttgtatagaggtgtttataggtgtttatagtattctctgatagtagtttgtatttctgtgggatcggtggtgagatcccctttatcattttttattgtgtctatttgattcttctctcttttcttgtttattaatattgctagcagtcttatctattttgttgatcttttcaaaaaacgagctcctggattcattgactttttgaagggttttttgtgtctctatctccttcagttctgctctgatcttatctatttcttgccttctgctagcttttgaatttgattgctcttgcttctgtaattctttaattgtgatgttagggtgtcgattgtagatctttcttgctttctcttgtgggcatttagtgctgtaaatttccctctacacacttccttaactatgtcccagagattctggtatgttgtgtctttgttctcattggtctcaaataacatctttatttctgccttcattttgttatttactgagtagtcatttaggagcaggttgttcagtttccatgtagttgagcagttttgagtgagtttcttaatcctgagttctagtttgattgcactgtggtctgagagacagtttgttataatttctcatcttttacatttgctgaggagtgttttatttccaattatgtggtcaattttagaataagtgcaacgtggtgttgagaagaatgtatattctgttgatttggggtggagagttctgtagatgtctgttaggtctgcttggtgcagagctgagttcaagtcctggatatccttgttaaccttctgtctcgttgatctgtctaatattgacagtggggttttaaagtctcccattattattgtatgggagtctaagtctctttgtaggtctctaaggacttgctttatgaatctgggtgctcctgtattgggcgaatatatatttaggacagttagtttttcttgttgaattgatccctttaccattatgtaacggccttctttgtctcttttgatctttgtcagtttaaagtctgttttatcagagactaggattgcaactcctgtttttttttttttttttttttgctttccatttgcttggtagatcttcctccatccctttattttgagcctctgtgtgtctctgcacgtgagatgggtctcctgtatacagcacactgatgggtcttgactctttatgcaatttgccagtctgtgtcttttacttgggacatttagcccatttacatttaaggttaatactgttatgtgtgaatctgatcctgtcattatgatgttagctggttattttgcctgttaattgatgcagtttcttcctagccttgatagtctttacaatttggtatgtttttgcagtggctggtaccagttgttcctttccatgtttagtgctttcttcaggagctcttgtaaggcaggcctggtggtgacaaaatctctcagcatttgtttgtctgaaaaggattttatttctccttcacttatgaagtttagtttggctggatatgaaattctgggttgaaaattcttttctttaagaatgttgaatattggccctcactctcttctggcttgtagggtttctgccaagagatccgctgttagtctcatgggcttcccttgttggtgaactgaactttctctctggctgcccttaacattttttccttcatttcaatcttggtgaatctgacaatcgtgcatcttgggattgttcttttcgaggagtatctttgtggtgttctctgtatttcctgaatttgaatgttgtcttgtcttgctaggttggagaagttctcctggataatatcctgaagagtgttttctaacttggttccattctccccgtcactttcaggtacaccaatcaaatgcaggtttggtcttttcacatagtcccagacttcttggaggccttgttcatttctttttactctttttttctctaatcatgtcttctcacttcatttcattcatttgatcttcagtcactgatatcctttcttccacttgatcgaattggctattgaagcttgtgcgtgcatcacgaaattctcgtgctgtgtttttcagctgcatcaggtcatttaagttcttctctacactgcttattctatttagccgttcgcctgacctttttgcaaggtttttagcttccttgtgatgggttagaacatgctcctttagctcggagaagtttgttattaccgaccttctgaaccctacttctgtcaactcgtcaaactcattctccatccggttttgttctgttggtggtgaggagctgtgatccttagttgcaaatgcagaaatcacccatcttctgcgttgatctctgtgggagctgcagactggagctgttcctatttggccatcttggaagcgctcgagctggacaagttgttttttaggttccctgtacacagtcacccaaggacttccctttaacatcatccttggaattccctctaattctcttgtattttggatctctttttgataatcttgtgccttattctttatttgattttctccattggaaagtagctatttgagaaattatttatcagaggaaaatttaaaacttgcattctgaaagtttttgatctttatcctttttcatagttcagctggccgttcattcagttttagtgtttgagaagtctgaagtcagttgaatcctgatcttttgtatgtagtccacgttttcctctggaaacttaacacagagtggccatcaagtctggaatctttaggtgattatatatgaaatggtttacttatgttacattattatacatgataaaataataatacgtgtgtttccatacttgatgggcactctgtagaatcattttttgttcccagtgttctgaaatttcatgatgatgggcctcacatggattgtttttctttcattttgctaggttcttgtcgagctctttcaattttagagactggagtaattaatttttgggaaattctcattgctttgtttattctttgcaccttattcatctttctctggactcctttatatgttgggactcctggattgattttcttatctttttctacttagactcatttttatagtttagttctactttgagagatttacataaatgtagcatccaatccttttacacgtgtttattttaaattcaagctactctgccttggaatattcctaatctaaaggagaatatacaaaaaaagttaacactagaattgtctgtgttccaccccagagaaaataatgttgattgctcagagtaaggtcatgtgctactcaaaaattacctctttatttgattatagtagtaatttagactgcattatactgagccaccctgtctcctgcaatataatttaatcaggggaaacaggtctactacatttttaggaagatctcagatttaaaacagtgacaacatttaaatttgaattaaaattattcctttggtagattatctatagaaaattttaaatgaaaatacttcgaagctacctttcattatatgttcatacagaatgtaaacacagtttaatactaacctgaacaatatacatatatattttttctcccatatatatgtggtgtgtatttatatacctatatgtgtgtgtgtgtgtgtatatataccccatctcatatatatacacacacacacgcgcacacacacaaatggctgtgtgtgtgtgtgtatgtatatatatatgtgtgtgtgtgtcatatatatatatatatatatatatatatatatatatatatatatataagagatgtggtctcattctgttacctagactggagtgcagtggcacaatcatagctcactgcaaccttgaactcctgggctcaagcaatcctcctgcctcagcctcctgagtatctgggactacagacacacaccactgtgctcggctgatatttaaattgttttgtagagatcgagtcttgttttgttgcccaggctggtcttaaactcctgacttcaaatgatcttcctgctatggactgccaaagtgctgggattacaggtgtgagctgctgcacctggcctatctgagcaaaatttaaataggaaggcgaatcctttgaaaagaaattcgtatgtcttcaaagtgaatgtgaattatttttgattatttttccttttggattttccatgccaccacactggttctacttgcatggacattcagatgtgagacatttgttccatttctaatgttgtattttaattttaaagttgtttggtactactgttttctcagtcttgagatagtctctgagctaattgaactacggtaggtgggttttgctcgtcaaaaatgatggtgaatccaaatcaacagtaaccaaatctattttgcttatagccttgggcatactacaaatacctactatcaaagggaaagtaatattgctttgaagtttttcatttaagaatattcagtactttttgtttgaaaaaggagttagccttaaaaagtcttttagcatgaacacatgatatgtagtacatctgccatatgtattaaaggtgtgtaatatcagttgatgtaagcatgtttgaaaaacctgctctgacactttaacttttcagattagaaaaagagtatttctccaaaaataagaaactaaatgaagacatcgaggaacagaagaaagtaattatagacctttcaaagagactccagtataatgaaaaaagttgcagtgaattacaggaagaactagtaatggtaaggataaaaaagaaaaccctatggaaatcactttattaggtcatattggatgtatagcagggtttttcctcaccacattccatgagataatagtatgcaagttattttagtgacattgataacaaaatttccaaaactggaaatgctgattacatcaaagatacacataatgaaacctctctgatttggaataattgggggaaactaactgaactagtaaaaactgaattatagaattttcaaaaatgtattcaaatgttttttttttatcgtgcataaaacagtattacttagattaagggtgattagggtttgtaattaatacatctgatgatttcaaagacttccttttgtaattgttttgtacctgatcactctctctccattccccagtaatctagcttttacaccatcaccaagtttatctttgtaaaatattgatctgtttttgttaacctctctttatttaaaactcatcagcatctcgatgtctccctgttgttttcagaataacggccagcttcttgttgtataatctcaggaccttttccttttgtcttcatattaacttttctaccctcttattttgcctttgccctctgtctgtcttgctttagccatattagagtgctccttgttttctacacacatcttttcttttctttttgaagatgaggtttcactctgttgcccaggctagagtgcagtggtgcaaccctagctcactgaaatctgcagctcctgggctcaagcaatcctcttgcctcagccccccgagtagctgagactgcagatgtgccaccttgcttggctagtttaaaaatttttttacagagatgaggtctcgctatgttggccaggctggcaccaaacaagtggcctcaagtggtcctcctgtcttggcctcccaaagtgctgggattaaggcatgaagcactgcattgacctaaacacatcttttcatatattcttatttttattcaggttattcatttcttttacctgcaatgactaaaatgctccttttcttttccattaacagatttctttacatcctgtgatgcccagctctgatatcttgcaatctgtgaagctttctgtgattctatcttctccactctcatccaccttaagttaaaattctgtgcctcctcaacagtatttctttagtacttagttcagcatctttatcataatactcaccgaaatttgatgtgtattatgtctcccaagaggatatgaatgcattgaggttaacttacttcattttacatacctagattccactatagtacttggctcaataaacatttgttcgatggatttatttggttgatgcagaatcctcttctcagcagtttgctggggaccccaccatggagggtgtaaagtttatggtaatactgtattacttctttgttttgttctatacatacatactttcctcagaggcttgactacttcactttcagttatattccaaaagttttagtgatttagttattgaggacaatggatattattttcctcaaaaaaggtggaccctgggttatactaggaattggtcaccaaatcagtgctgcccatatcgaaagctaataataggatatagttaaaactcttcagtgttttttcagatgatccaatattatatacattttccatttatctaaagatgtttgctgtgttctgattcagggaactgatatcattgcttgttctagaaatcagtttgcagtttggtattttgaatgtgatgttttagaaagttaagagccctctgtgtagtctactgtagcatctgttcactgtaatgttatcttaaatttcatgggctgttttaactcttacctcctagttcaggaggttgaatcagtagtggagaaaaatatatcagggtcattgagctgagtactgcatttggttcgcttgcttattagatattgtactcagtagtttggaaaataagccagggttataactaaaaatgcaagagttaagacataatcaccaatataggttgcatgaattttcctaattctggttttctagcactttagtgagtagatacaaaataaaatgagactggtttaactcaccacagagcatattcatatttagtgattaaaaaattttacttggtaccaacagatttttttttctaaaacatttacagagtgatatatggcctaaaataatgcaagtggcagctcaccagcaacctttgttttcctgttgggaccgtctgcactcgttgtattcattgtattaacccattaaacactactgttttgataatgatgctgaaaattgtaggctaattgtttcttcaaagcttgatggattgctaaaagcagttgcagatctgtaaataatctaatagttccttgccgaatgggatgttcgaaaaacttactcaggttgccagattaagtgatgtacagttgatgtggctcagactgttaatatgttcctcttaattttttcatctctcttaaactcatagctttgcgtcttattttcttccatcttcctcttctttcttcttccctgttagctttcttttaactttttctgttttatgcttattagagctgctgttctctatttctttacctgaccataatatgaaatttaagacctgtttaatgaaaatgtctttaaatagtaagtacaatgtttttctttttataaattactattctgtcacttttcctaaatatattcttttcttgtacatattcctttattgacttttctcggtagattagtggcctttgggggaaagaaggcttgcaaagtttctcttgaaagatgtttctcccaaattaaaattttaagccataagaaatgaagtttttctagttctgcattcacagtctggctgttatttgtgctttcaattcataattgttgttgactgaagacagaatgacttatgaggaagattttcccttttgcttttggaaacgaaattgttttaatgacatgccatgattttacataccctagtgtgtcttttccacaattatatttcttttgagcataatagtttcagtattttacagactatggatgggaagcataaattactaacaggtaatttttcttcccttttgaggtaccagattgttttctagtttaggtcatgttcatggtcattatttaaatcttggtctttattttctctgttacattggaaaagaaagttaaagtcactatcctctataggtttactcgtgagatcaaggtgttattaataagatacaaagacttgagcaaattttgagacttacaaataactttgtatgtgttagtacagcatagccttatgctgtatcctgggctagatacagcagcagagctgttagaggctttagagatcatctagcccaggatacagaaagtcttaataaaccagttggaaagtgatagctcccctgttttgagagagatattatataaatataaaacataattttggaaaagtctaaactgagtatgttgtcttttgggggtatttaataaatataaaccagctaaatttaattgtactttatttatttttaattgacacaaaataattgtattaatacatatttatatggtacactgtgatgttttgatatatacaacataaagtgatcagatgtgggtaattactatctcaaacatttatcatttctttttattctaattatacttttatattaatgaaattacttcaatttatagatttaaaagatataactaataaattaatggtatataattattgttttgaatgtcattgaattagtaggttttcaacataggacatccaaggacttaacaaatttattttcatgtttacatgaagatgtgaacacagaatatgaaacttgacagaatttgactataaaaagttttgattggaaattgagcttttagtttcaaaatctatgaatttaataatgatttaatcaactactaaataaaactgaatttctagtttaagatgctgactgatcatgcttattaaagtccatctgaggctcaacagatccagctgggtcttttagacattactgtgagtttttatatctgcttctcttgaagcaggggagctttcattttcaaattggtattattagaacttgctctgtgctttcttcaatgaaattttcttaagtccgtcatttcttgagatttgttttcctgccactcagtaatatttagttacagctctaggagagactttatattgaaaagggaattctagttctcaggaggttttggtcaaagaatgttttattctctaaagaacttgtgattgaaaatggtcaagtgtatattttttccccaatacttttgggggtttaactgattatataatagtaatgattgctagcattaaatatgattttggaaagtgctttgatggttatgctttgtggtgaaggtaatatttcttgataatatttttacttccaatgaactattaggtttgctttagaagaacatgtttctgattttgtaggaggttttcaaaactaatgggctaataaatattctattctgattttttactaaaaaaagattgattcttgtttttcaccaagaataggagtagtatttatacatgggcattgtttttgctaatataaatatcactttccgtttctcttagtggcccttaaattttagttctagtaaataatattcatcgcgtaagtgtctttgtgtatttaaatattccttttaggaggctgacttcctaaatttatggtataggcataaagcttttgcattaagccttttgaaatttatttctatgcaaattagtaaattttgaaaatccaaatctcatttttcacctgggaaaaataaaatggtattgtgtatgtatgtgtgtgagagagacagagagcaagagattgcgagagagatgtttatatgttaaggcccatgttcagattgaaaggtagcgtctactgaaaaataaactgattgtcaaagctaagtaaagaagggtaacatttcattatgtgagataagcaagtggggtcatggaatactgacatccgtggaagtggcataggtaaacaaggtggtagggaactaagagactagctatcattaatatgattagggaaaagctgctgatggtgatgataacaaaagctactcagacctccttaagcccatacaaatgcattgtgcatataatggtaactaggtacaagatatgatgaaaaggtgagctgtgagggtaaaagtatgtaatgaagattataggctttgatgcttcctcgtttttacttagaatttcttcataattgcttaacatatatttaaataaaaaacttaaaagttttacttgagttcaaaaatgttcagaaattataagaactatatattagttgcaaaagttcaacctatgtttaaaatgcttatttcattaaaaaaacccattgactaaaggctttttttaaacctgtttgttttttctattatttttaaccttattaaaattggccttcatggtttttattgttatttatgacttgagtcaactttttccatagcagatcagcaagacccatttaccaattttcagatataaatatttatatatagtttttatatgtttcttcaaggctctcaatcgaaatttttatttacgtgcctttctatttgtggtactcatgttgagtgagcaaaaaagtgagcatgaggttttgaaggatcataaaaaagagaagatgattatgaaacaaacaaaaaagaatgacatgttagattaagccagaaatgcattcagttcagcagtgtgagaggtatagtatcccaaggtgcatataaaggtagtttgttatctcatttttctttctggttaaagatattttttaaccaacattgactcctctttcataatacattaagatttgtcaatcacaacattttctgaactttctttgaatattttgatatttttagtcccctgtttacactggttgtagattcatcacagcatttaaagtagtccgtgggtcatgttgggtgatgagtaaatgttcacctaaacatcatctgcttagccaacatagcattaagggacctttaatcctagggcaacaaattccatatgtgagttttgtcttgaggcaaataagtgagtccctttatcttacaattcttttaaatttctggggatgtttagaattatagcgtttgttgagtcaacaatttatcattaacctaaacttattctttatgtcacatgacaaaatatgttaataaaaaattagaaacaatattttatcttcagttagtactttgttttcagctcaacagttttgtttatttagctaatggattctgttttcattctcaaattccttgtatattaaaaggttgttaagagaactaccagctttggaaacaaaatttgaatataagcatagaccagatatggtggctgacacctataatcccagcactttgagaatctgaaacgggaggaccattgagcccaggagtttgagaccagcctgagcaacaaacgtagtgagactcccatatctacaaaaaaatttaaaaaaaatgagctgtgcgtggtgacgtgtgcctgtagttctagctacttgggaggctgagatgggaggatcacttgagtctgggaggttgaggctgcagtgagccatgattacaccagtgcatgctagcctggggcacaaagtgagaccctgtctcaaaaaaaaagataaatgcaaccacaatccagcatttaaaaaacaaaacaaaatcctgacacttttactgtgtgaatgaagagtggaatcttcattaataaaactgaaacaatttgttaggaaaaaaaacttgtcaactgtaaaacaagttaataatgtaattattaaatttaagctaactttctactggctatattatttgtaagactattagccagacatctctgtagaatgatgtgaaaattataatattaataattacaaatgtaatagtaattttcaggtagatgaacattagcttctttttaagcctgatgagtgagtaaatctcttttttgctctttgaaaaattttacactattcaatcttttctgcctaatttgaccctaattttgatctcatattgtaatagtgtggaaatattagctcatattttagttaagattgagctctatacttgaaagagaattatttttgaactaggaatttaattgaaccttgatattaagctcactccaagtatgcagtttatctggctttctatagatatattcctgtaaatttttataccttgatattaatggggacttcagtcagctggcataatagaaacaacataaattttggaggcatattgatctgggttttaatcccagaccctatctcattttagttgtgtgactttagtgatattcttcctctggatccatttgctcatgtgtaaaatggtgctaacaatcttggtcatgcagggtttttgatgatcattaaagataatatatgtatcgggagaatggcgtgaacccgggaggcagagcttgtagtgagccgagatcgcgccactgcactccagcttgggcaacagagtgagactccatctaaaaaaataaaaaaataaaaaaaagataatatatgtatcaaaatagcagaggatggaaaaaatataccatgcacccaataaaaaaaaactggagtggatatactgatgatagacaaaatagactttagaataaaaatgttactagagataaagagggacatctcatgttgttaaaagggtcaatccaccagaacgatctaacatttataaacatgtgtacacctaacaacagacctccaaactatttgaagcaaaacctgacataattgaagggagaaatagacaacaataatatttcggggcttcagtaccccacttgcagtaatgggtagaacaatgaggaagaatatcaccaaataaatagaagactcaacagtactgtaaacaaattagaccttacagatatctatagaacaccacacccattagcaaaagaagatacattcttctcaagtgtacgtgaaatattcttgtggatagatcatatgctaggccatgaaacaagcctcaataaatttaaaaggattgaaatcatacaaagtgtcttctctgaccataatgaaattaaattagaaattaataacagaaggcaacagaggaaacattcacaaatatgtgaaaattagataacacactcctaaataaccagcaagtctaaaagaaatcacaaaggaattagaaaacactttgagatgagtgaaataaaaagacaacataccaaactttgtgggatgcagctaacactatgcttaagagggaaacttacaaccatagtcatctatattcaaaaaaaatactggggcatggtggtccatgcctgtagttcctagctacttggaaggctgaggtgggagaagtttttgagtccaagagtttgaggtcagcctgggcaacacagcgagaccccgtctcttaaaaaaaaaaaatcctcaaatcaataacctaacatttcacggtaagaaaagagaaaaagaagagcaaactaaacccaaaacaagtggaagaaaataaacagtaaagactaacaaggaaataaaagaaatagagaattttaaaaaatagaggaaatcagtgaaaccaaaagttgattctttgaagagataactcaattgataactttagctacactcatcaaaaaaggagaagagattcaaattactgaaatcatgaacgaaagggggatataactactgaccacgcagaaatagaaataattgtaagagaatactctgaaaaactatatgccaacaaattagataatttaaaatggacaactttctagaaagacacaaattaccaaaactggttaagaagaaatataaaatccgttgggcgcagtggctcgtgcctgtaatcctaacacttgggaggccaaggtgggcagatcatgaggttaggagttcacgaccagcctggccaacgtagcgaaaccccgtctgtactgaaaatacaaaaattagctgggcaaggtggcgcatgcctgtagtcccagctacttgggaggctgaggcaggagaatcgcttgaacctgggaggcggaggttgtggtgagctgagatggcgccattgcactccagcctgggcaacagagcaagactccatctcaaaaaaaaaaaaaaaaaaaaagaaagaaagaaatagaaaatcaatgcaatagcaggatgtcttagaatatcaaaatacaaaataaatcaaaagagattgaattagtaatcaaaaaaactcccacaaagaaaagcccaggcctagataggttcactggtaaatttatttaaatgtttaagaacaattaccaccaattcttcataaattctttcaaaaatagaagaggagataacacttcccatatcattctgtgaaatcagtattattaccttgatacaaaaaccaaatatactgaaagaaaagaaaactacagactagcctcccttttgaatgtagatgctaaaattctcaaaactatactagcaagctgaatccagcaagatataaaaaagatattacaccatgatcaagtgggatttatctcaggaatgtaatactagtttaacacctgaaaatcagctaatgtaataaatgatggaagcctaatgattatctcaatagacacagaaaaacatttgataaaatgcagcatccttttatgataaaaatgctcaacaaactaagaatacaaggaagcttcctcctcaacctcaagaagagcatctatagaaaacctacatctgacattacatttaatggtaaaagactgaatactttcaccataagattaggaataatacaaggatgtacactctcaccatgtctgttcaacattttactggaggttctagccagtggtattaggcaagaaaaagaaataaaaggcatcagttttggaaaggtagaagtaaattatctatttgcagttgacataatcctgtatatattagaaaatcctaaggaatccacacatgcagagaaaattattagagctaataaagtagtttagcagagttgtaggatacaatacaatatccatttaggaaagcagttgtatttctgtaactagcaatgagcattccaaaaataaaattaaggaaacaattctattgacaataaaataataaagaatataatacttaggaataatttgacaaaagaagcataaaacttgtctgctgaaaactgcaatttatcatggaaagaaattaaacaaggtcgaaataaatggaaaaatatctcatgttcatgtaatagttaatactgatgttagtactccccagattgatggtttaatgcaatctccatcaaaatctcagttgactttttggaagacagctatgcttaccactgtaccaccaatgaacttttagttgtctttttgcagaaattgacaagcagatcctaaaacacatatggaaatataaggaggcccagcacagtggctcatgcctgtaatcctagcactttgggaagccgaggcgggcagatcacttgaggtctggagttcgagaccagcctggccaacatggtgaaaccccgtctctactaaaaatataaaaatttgccaggtgtgatggcgcgtatctgtagttccagctattcaggaggctgaggcatgagaatcacttgaatccaggagccagaggttgcagtgagccaagatcacactactgcactctagcctgggtgacagagtaagactcagtctcaaaagaaatataagggactatgaatagccaaaataatcttgagaaagaaccataaagttggagtagtaacacgttccaattttaaagctaactacaaagctacagtagtcaagatagtatggtactagcataatgatttacatgtatatcaatggaccagaattgagaatctagaaaaaaatccttcatgattatgtttagttgattttcaaaaagggtgttaagtcaattcagtgggggaaagaataatatttttcaacaaatggtgctgagagaactggctatccacatccaaacaccaaagaatgaatttacctcagcctgggcgacagagggaaactccatctcaaaacaacaaaaacaaaaagaaatgagaatggtgattctttaggcctggggatagtggtgggagaatggggagtgagagccagtgggtgtggcacatcttttagtagggacaacactgttctaaatctagattgtggatatgcttgtacaacctcgtgaaaatactaaaaacattaaacactttaattgggtgagctgtatgttatgtcaattatgtctcagtcaagtttaaaaaaaatataaagttaccacaattaagagtttggtactgacaaaataatgaagaaagcaatgaaacagtaaggagttcaaaaatggctatcagtatgtatgagaatttagtatatgataatgtttgtatgccaaatcaatgtttagagatagattatctcacaaatagtttttagacaacttgttatgttataatgataagtaatatgactaaaatttactaaacaaattttagattgatcaaagagccataaaagaagaaaatgaaaaagcactggaagaaaaatggaattgttttgtcatcttggagtaaaaggaaaatatgacataaaaatcagaagtcctaaagcatactattgatttgcacacttgatcacttgaaaaatataattttgttttaagaatatattatagtcagatggcaaatagaaatgagaaaaaatgatttgcaacatgtaacaaaaagagattgcttttataatttatggagcgcttttataaaccactaaggaagaaatgaatgatataatataaaaatgggcacatgatatgaacaggcaatgcacagaaaaaaatacagatggctagtgaacatgaaaggatgctaatcttaattaaaatgaagtaaatgcacattaaataagttgataatgcctactattggatagatattggcaaatggatgctcataccgttcatggtagtgtacattggtataactgattagagagtaatttgttaacaattgtctgaaaacagtgtgtttccttttgcctcattaaatctatttctaggaatttattgagtagatatacttaacgtacatgcaaaatataaaaagaacatatgtaagaatgtatattgtagtgtcgtcactaatagcaaaaaaaactgccagaaacctaaaaaatattaacagtaggggggactggttaagttaatttatggtacatctgaccaatggagtactatacagctaaaaaagtttctgacgtggagagatgtgaaacatactatgagtggaaaagaaagtaatataatagtatgtattttatgatcctatttgaattaaaaaattatagatagatatttcctataattataaaacacattgtgaataaaacttacctgtgagaattgaattaccttttatttttctctatttgtttttttttactctgagcataatatactcaaagaatttaatagaatatttaaatatttaatgattaaaaatacctgtaaatatatgttttttatatatatatatatatatatatatgtacacataaacttggtgctttataaatactgtgttttttaaggtagactttgattgccattagcaagaatatattttatttagacttatttatgttgtattgtatttaccttattttatttttgaggcaaggtcttgctctgtcgcccaggccggagtgcagtggcacaatgatgctcactgcagctttgacttttcggactcaagcaatcttcccacctcaacctgctgagtaactgggacctacaggcatgtgccaccatggctgtctggtttttcatttttttgtagagatgggatctcactatgttgcccaggctcaccttgaactcctgggcttgatcctcttgccttggcctcccaaagtgctgggattacaagagtgagccattgcacccagcctttcactgacctgtgagtctgtgctttgctaatttccagaagtctctatctggacttcttgagtattttataacacagcaacaacttgcatgtatatctgctatggaaaagtgattttttggtcaggtgtggtggctcacgcctgtaatctcaacgctttgggagaccaaggtgggtggatcacttgaggccaggagttcgagaccagcttggccaatatggtgaaaccctgtctctaccaaaaacacaaaaattagctgggcatgggcacacacctgtagtctcagctctcaggaggctgaggcatgagaatcacttgaacccaggtggtggaggttgcactgagccgagattgttctacaacctggatgatggagcaagactctgtctcttcaaaaaaaaaaaagacaagtcattttttgtttgttggcttatttactttttactcttttttaaaaatctaactttttgatgatagaaaaaggttctacaatgaaaaatgaaatctctctcttaatcatccagattctcttctcagagacaaccatcattactactttttttttttttttgagacagagtctcactctttttcccaggctggagtgcagtggcgcgatgtcggctcactgcaagctccgccccctgggttcacgccattctcctgcctcagcctcccaagtagctgggactacaggcgcccgccaccatgcccagctaattttttgtatatttagtagagacggggtttcactgtgttagcccgtatgatgtggatctcctgacctcgtgatccacgcgcctcggcctcccaaagtgctgggattacaggcgtgagccacagctcccggccatagttactccttttaaaaatgattctaggccgggcatggtggctcacccctgtaatcccagcactttgggaggccgagacgggtggatcacttgaggtcaggagttcaagaccagcctggtcaacatggtgaaaccccttctctactagaaatacaaaaattagtcgggtgtggtcgtgggcacctgtactcccagctacttgggaagctgaggcaggagaatcgcttgaacctgggaggcggaggttgcaatgagctgagatcatgccactgcactcccgcctggatgacagagcgagactctgtctcaaaacaaaacaaaacaaaacaccaaaaaaacagatgctgtgtagaaattctctctgcgtttacaaataggtacacacagacacacatgcacacacacacttcacacatatggcagtatattaaacatactgtcaacccacttccctttttgtttttagctgaacaagataacttagatatgttttcattgatgaagggcatcctcctaaagtctgtgtggatgaatcctaattgatttttctgttgataacatgctataattaactaaactacttaacacttattttagaaactaggtgttgcctaggggaaacactggggatacactggtgaggacaaaaaaaaaaaacagacatttactcccttcatggagcttaaattctatgagatgggcacattaataaaagaccaactcaaataaaagtgaatcataattgtgataagtgctgagatgaatgtgatagagagttgatatagtcagggaggtaaagaacagtttttctggggaagtgatagttgagctgacatgtaaacaaacatcaattaattttacatattttaaggatgtaagtttgtcttataatatctattcttccattttttctgtatctataaacatacctttaacatcaatctttaaatgtgcttaagtttctcatatattaaataaaaacaaaactcttctctgacccttccctcctttccaactactgccctttatctcaccttccttcttaccaagagagttgtctaaacttcctgtttctatttactcatctctcactcaagaaaaaaaattcaggcttactccttctttaacctattccagtctgtgttataattattataacacagtgaaacatctcaccaaggtcaccaatgacttccaaacccaggagacactttttagtctccattttgcttcaattggcatgattgacaactctcttactgaacttcttgaaatgttcccacatcttgtatccccttctgtttttcttcttctttttttagttttgtttgctgacttcttttctaactattaaattgctggagttccataagacttgtcctaggctcttttcatttcccatcaaacactttaaggcaagtttcagacagtatctgtagatgattcccaaacctatacctgaccctgcttctaagatttacaccaattatattcagccacctcccatatttttctactttatttgtcatttgttcattcacatatatttatttgggacctgttatttgacaggcattgtgctggtgtagagtgtcttaggtatctctagtggaatatgattaaaatagaattcatgattgatacctcctgccaaaaagaagcaagcaagtaaacaaacaaaaatagccaaaacgagaccctctctaccatcattattctgattcaactactgaaatccacccagttcatctaacttaaatcttgggatcagtctcaactcttctttttctgcgtacttcccttatcctcatccaatccaatccagttcaatccagtccaatcagtgtggtctaacccaatgcagttttactaaagtctggccattctaccatcttagtctctgtccagtgcttccattccctaccccttcttcccctttcactgtcaataccctagaccaaagtactgtcacttgactgctgcagtaacttcaaattggtcttaactgtcttcacttttgactgccatctggcaacttgccatatgactgtagtcatgattttttaagtgttccataattcctctgtctcagttttcttgtctctaaaattgggataataatagcctttccatcatagggttattgtgaggataaaatgaattactatatataaaacacttagaatagtgccaggcactaactcctcagtaaattgttaataagaccttgtacagtgttacattaagccaagtaaaaggtatgattaagagagaaagatggtttattaataatatatttgaatggaatcattatcttgtttatacttgtgttatatatgttcacactaaaaatatgcagctcttataatacgtgaccttatgtgtaatttttttcttaattaaaaggctaagaagcaccaggccttcctagtagagacatgtgaaaataacgtgaaagaattggaatcgatcttggacagctttactgtgtcgggccagtggacatcaggttagttgaaggtataaaatgacagatgcatctgtcaatgttccaaagtcactacattttgggaattctgcagatgcctcttgtagtccctcatctcaacatgttttgatttgatgacatgataagagcagttctcacagcagtcagttggcctagctggctgagaaagggtgacggaatatggacctgctgttgtcctcccagaacttgatttacaagtgttggggtgtgtgtgattggacagacaagggctcacttgctgtgttctgaatccaactgagaaaaaagtccttacagtatacctgcaaggggaacagatgtttcgatcaaactgagccaaattctgaggcaaccttcagcaacttaaaggtcatgcatttaaaaggttatgtaggacacaggctgtagcatagcgcatgttctatactttccaagccggttttctaagctggttttcatttcctactaccatatacatatactgtccagataagaatgcttaggtagaatattttagttgtagttattagcccacttcatatgataaagagctataaaattatatattaattaggtagacatattttgagaactagcaaaagcaatggctggctaatgaattctgttcactatttctactttcttagtgttttgtgtttatgttattatgtgtgctatagtagctttgacataaatacttttctacctcagttttcttttgccctgctttcagccctgaattatttggtggtcttctaacacaattctattcttcaaaaggcacataaaattaaatttctcactcttaaaaattgagaaatttaagaaaacatttttaaaaggaatctaacagcaatttggcaaataagttctttagagagctcttaagttcaggaagtttttgtccttgaaaacttggaaggacctcatcaaggttcatattttgccttgtggatctgtagatttctcagttggtaagctattagaaatgtagtgtgctttgctattgtctatgttttaagtctctgtgtttttagcttttatgaaattaatgtgtaactatctttgtttttatgtaaacttttcccaaaagcattactgtatcataatcataatttgttatcatggacaaatcaaaagatataaaagtgtcataaaagtaggtgcaggtatccagtttcaattatatttgttacagctttggaggagaaaattttcctttgcactggtacttttttattattgagatgtatcagtggtgtttaatggtgttaggatctttaaaaattgttaaatattgtcgcagtatagcatatgcctcaatattattttaaatatttcttcagagttgaattagaaaagctaagaataatgtggtcatgtctcgtttgagttttaaagtaaaatagttggtaacaaagcaactcagaagttattactaagcctacagaattttctattaaaattttaatttttattcttttattaaccatccttttttatctttatcttcctaattttctgtatagatgcatactttgtgtattccagggaatgtgttcctgcgaaaggactgtgcactgaattagtgatttttggattgttacagagtggtaacatgtttccattttgtgctgatttttctctcctttacacccttctccccttgctgatccattctcctctgttctgttttgctgtgtgccttgggaggctgccttctgtggatctgggctcctttaccttctggcttctggttaggtttggacagtaggtgcacccacaggagattaagggaatgacagaataaagcagtcgaagtgtttatttcctctgcttcctctgctccactgcatttttggcagtggcttcatttttcagcagccacagtgcctgttgggtgggccctctttcatggctgtggctcttgttagactatggtgacattctctccacttgaccttttaagctaagacataatattagttttctactcttgcttgcttttggtgcctcatcataccttttgggatctgttaacctgtacacatttctgtagtctcgtcattaaactatcttgctgatgacctcttctgagtatttaatttacatcctgattgatttacataactccttgggatctggtttcattcctcctattggcttgcataaaacagctctgtgcctttataatggactctgtttctgctcagattgggtttttgttacataagcaaaaaagtgagtcacgagtttttcggcttcccagtatgtttgaatgttatgtttatactatagtgtagtccattaagttgtgagagcattatgtcaaaaaatccacataccttaattaaaaaatacattattgccaaaaaatgctgatgatcatctgagccttcagtgagtcataacctttttgctggtggagagtcttgccttgatgttgatggctgctgactcatcagggtggtggtggctgaaggttgggttagctgtggcaatttcttttttgttacctaaaaaatggatacagaataattttacatactttcatacacatttatggggtgcatgtgatattttgatacatgcatgaaatatgtgtaatcatcaaatcagggtatttaagataccagtcaccttgaacatttagcatttctttctattgggaacatttcaaatcttctggctattttgaaatataaaacgtattgttgttaactgtagagttcaatactgtgctattgaactctagaacttatttcttctaactatatgtttatacccattaatctacctctcttcaataccatcctccacactgccactagtaaccaccattctactctctacctctgtgagatctgcttttttagctctcatgtgtgagtaagaacataagggccaggcgcggtggctcacgcctgtaatcccagcactttgggaggccgaggggggtggatcacgaggtcaggagattgagaccatcctggctaacacggtgaaacaccgtctctactaaaaatacaaaaaattagccaggcgtggtggcgggtgcctgtagtcccagctactcgggaggctgaggcaggagaatggcatgaacctgggaggcggagcttgcagtgagctgagatcgtgccactgcactccagcctgggcaacagagcaagaccccgtctcaaaaaaaaaaaaaaaaaaaggaacataggatatttgtctttcagtgcctggcttatttaacttaacataatgacctccagttttatttacgttgctacaaatgacagggtttcattcttttttatggctggatagtattccattatgtgtctgtatgtgcgtgtatatgtatgtatatacacacacacatcatatactctttcttttatttttttagagacagtgtgttgctgtgttgctcaggatagcctagaattcctgggctcaaacaatcctcctgcctcagcctcctaaatagctaggactttaggtatggtagcatctggcttataccacattttctttatccatttatccattgctagacacttaggttgattctatatcttggttattgtgaataatactctagtttatatgacagtgcaggtatccctttgatatactgattttctttcctttggataaatatctgtagtgggattgctggatcatattgtgtccggaattggtggttacttggtctcactgacttcaagaatgaagccgtggacccttgcggtgagcgttaacagttcttgaaggcagcgtgtccagagtttgttccttctggtgttcagatgtgttcggagtttcttccttctggtgggttcttggtctcgctggttcaggagtgaagctgcggaccctcgtggtgagtgttacaggtcttaaggtggcgcgtctggagttgttcgttcctcccggtgggctcgtgggctcgctggctcaggagtgaagctgcagaccttcgcggtgagtgttacagctcataaaagcagtgtggacccaaagagtgagcagtagcaagatttattgcaaagagtgaaagaacaaagcttccacagtgtggaaggggacccgagcgggttgccactgctggcttgggcagcctctttttattctcttatccggccccacccacgtcctgctgattggtagagccaagtggtctgttttgacagggcactgattggtgcgtttactatccctgagctagacacaaaggttctccacgtccccaccagattagttaggtacagagtgtcgacacaaaggttctccaaggccccaccagagtagctagatacagagtgtcgattggtgaattcacaaacactgagctagacacggggtactgattggtgtgtttacaaaccttgagctagatacagagtgccgattggtgtatttacaatccctgagctagacataaaggttctccaaggtcccaccagagtagccagatacagagtgacgattggtgcatttacaaaccctgagctagacacagggtgctgattggtgtgtttacacaccttgagctagatacagagtgccgattggtgtatttatattccctgagctagacataaagattctccacgtccccaccagactcaggagcccaactggcttcacccagtggatcccgcacccgggctgcaggtggagctgcctgccagtcccgtgccgtgtgaccgcactcctcagcccttgggtggtcgatgggactgggtgccgtggagcagggggcagtgctcatcagggaggctccggtgcacaggagcccatggagggggtgggaggcaggcatggcgggctgcaggtgctgagccctgccccacgggaaggcagctaaggcccggtgagaaatcgagcacagcgccggtgggctggcactgctgggggaccccgtacaccctctgcagccgctggcccgggtgctaagcccctcattgcccggggctggcagggccggccggctgctctgagtgtggggcccgccaagcccacgcccacccggaactccagctggcctgcaagcgctgcgcgcagccccggttcccactcacgcctctccctccacacctccctgcaagctgagggagtgggctgcggccttggccagcccagaaaggggctcccacagtgcagcggtgggctgaagggctccttaagtgccgccaaggttcgagcccaggcagaggaggcgccgagagcaagcgagggctgtgaggactgccagcacgctgtcacctctcaatatggtagctttatttttagttttcttttatttattttttttattttgtattttttttttaacgagttagactcttgggatgttgcccaggctagtcttaaactcttggtctcaagcagtcctcccacttcatcctcctgagtagctgggactgcaggtgcatgccaccatgcctggcttatttttagattttttgagaaatctccatactattttcataatagctgtactaatttacattcccaccaacaatgtataagagttctcttttatccacatcttccccattattagtttttttttttgtctttttgctactagccattctaactgtggtgagatgatatctcattgtgcttttgatttgcgtttccctaatttatgatttgagcattttaaaatatactcattggccattagtatgtcttcttttgagaaatgtctacttatgtcctttgcgtgctttttactgggatcgtttgggtgtttttttgctgttgagttgtttgagttccttgtgtattctggatattagtcccttgtttgatgaatagtttgtaaatattttctcccattctacaggttgtctcttcactctgttgattgtttcctttgctgggcagaagctatgtagtttaatatagtccctttggtttatttttgtttttgttgcctgtgcttttgaggttttagccataaaatctttgcctagatcagtgtcctgaaggatttctcatatgttttttctagtagttttgtagtttcaggtcttatgtttgagtctttactccatttttagttgattttttaatacaggaagaggggtctactttcattcttctacatatggatataatttcttaagatgacagtgatgaagtttgctccgtcagttgactcttattttcatgaaagaattctctgtaccatgccatgctatttgataccattttaccctcagtacaattccattttttttttttttttttttgagacagagtatcgcactgttgtccgggctggagcgcagtggcacgatcttggctcactgcaacctccgcctctccggagtacaatttcttttaaaattgaggtcaattgtctcagactctgctgctggtttatcaactacatttatgtaatatcctaaatcctttattgtcattttataaggaactcctcaaagtcatccacgaggattggaatcaacttcttccaaattcctgtgacatattgacttactcccatgtatcacaagtgtttctaatggcacctggaatggtgaattctttgcagaagttgtcaatataatttgcccagatccatcagaggaatcaccatctatggcagctatagccttatgaaatgtatttattaaatgataagacttgaaagtaaaaattacttcttgatccatgggctacagaatggatgttgtgttaccaggcttgaaaacaacattaatctccttatacatctcagagctcttgggtgaccaagtacattgtcaatgaacaataatgttttgaaaggaatctttttgtgagtagtaagtctcaacagtgggcttaaaatattcagttaaacattctgtaaagagatgagctgtcatccgtatgagctgttccaacttgtcatccaagttgaagccagtgctcatttaccattcaaaaatcctgtggcccttaagaattatgctttatcaactctgcctgtgccctggtagctggtaatgtagcttgtcagtttaagttgaagccaatgctcatttaccattgaaaaaatcctagggcccttaagaattattctatatctactctccctctgctctataaatgctctataaatgcataggcagagtagataaagcataattcttaagggccctaggattttttcaatggcaaatgagcattggcttcaacttaaagtcaccagccacattagcccctaacaagagagtcagcctgtctttgaagccttaaagccaggcattgacttctcccctctagctgtaaaagtcctaggtgacattttgcaacaaaagactgtttagtcttcactgaaaatctgttgtttagtgtagctacctgcatcggggattttagctagatctgcggataacttgctacagcttctacatcagcatttgctgtttggccttacacttttgtgttatgcagaaggcttttttccttgaacttcataaaccaatctctcctagctttcaccttttcttctgcagcttcctcacctctctcagccttcatcaaattaaagagagttagggccttggtttttttttttttttccctgagacggagtctcactctgttgcccaggctggagtgcagtggcgcgatctctgctcactgcaacctccctctcctgggttcaagcgattctcctgcctcagccacctgagtagcttggactacaggtgtgtgccaccacacccagctaattttttttaatttttagtagagacggggtttcaccatgttagccaggctggtctcgaactcctgaccttaagcggtctgcccgccttggcctcccaaagtgctgggattacaggcctgagccaccacgcccggccgggccttgtttttaattaggctttggcttaagagaatgttgtggctggtttgatctgcgcagaccattacaacattctccatataggtaataaggctggttgtctttcttatcattcatgtgttcactggagtagcacgaatgtgaactagaaaccttctagaaaggcgaatccttgtttatatccattaatatatctctcttcattaccaccccaccaccagcctctgataaccaccattcttctctctacctccatgagatcaatttttttttagctctcatgtatgagtgaaaacatgtagtatttgtctttctgtgccaggcttatttcacttaacataatgtcctccagtttcatccatgttgccacaaatgacaggattctttttctatgggtgagtgatatttcaatgtgtatatatcccacttaaaatatccctttatccattgatggacacttatgtggattctgtatttggctattgtgaatagcactgcagttaacatgggattgaagatatctctgtgagacactgatttcatttcttttggatacatactcagcagtgggattgctggatcatatgctagttctatttttagttttttgagaaacctccatactagagcatacaacatttattggttaagttcaccatcttctatgggcatggtttgtggtgtcccaaaacaattacaataataacattaaagatcactgatcatagatcaccataatatatatagtaatcatgaaaaactttgaaatactgcaagaattaccaaaatatgacatggagacacaaagagagcacatgctgttggaaacatgatgccaatagacttgctcaaggtaggttgccacaaacctgcagtttgtaaaaatcgcaatacctgtgaagcactgtagaatgaaatgcaataaaacaaggtatgttaggatatctttgagggaaaaatctactttaaatagtgacatttgtgtgtatttgtttgtagcacattcttagaatttgtaacaaaattaattcattaatcaagtgctaggtgtgcacatatggtcccagctactcccgaggctgaaggaagaggattacttgagcctaggagttcaagtccagactgggcaacataatgagatcccatctttaacaaatgaataagtaaataattaattctgttatcttgggaagaattttccagagatcttctcttttttagctacggcaagaaggcagtggcgctttacctcctttttgtctcttgacatacctttcagtttaatacatgctttgtatctaacctctatttcaggaaaagtaatccatggtagaaatttatagggacagtagcaaaattgttttttgggcttgcttttcaaaatgaaatgaatgaaaactattttcttgaattaatcttaacttagagctggcagaaattctcagattttcaattctctgtctccttcagattttgtagttttctacattaagaaactttccgatgcacatgtcccaccagcttatattcaggtagcagataagtgaaatttcagtaagtccaagacgttccagaagttatttaccgagaggatttaacttgatctcctcacctgtgatcagtgtaacagtttacaccttgtttcctaatgcctctaaccctggccttcttgtgactaatggggtctctctgcttccacctttgctccccctcagtctgttttctctgtagctaccagaaggaccatttatgagcttaggttacaaacttacaggtatagagtaagttctggggatctaatgtacaacatggtgacaatagttaataatgctgaaataatactgtttacttgaaatttgctaatagatcttaagtatccttacgacacacacacacacacacacacacacacactctcactcactcagataactaagtgtggtgatggacgtgttaattaacttggttgtggtaatcatttcatagtgtatatggatatcaagtaatgaagttttgcaccttgaatgtatataatcttttttggcaattatacttctgtaaagctggacggaaactacaacaacaaaaaacctaagttagagtgtgtcattcctttgctctaaaccttgtaaggtcctgtgctttacttagaagccaaaatggtatcaatggcttgcttatttttcattgcttctttggcctcacctcccactactctcccctccttccctatgtttgggccactctagcttcttgccatttcttgaatatgccaagcatgcttttgccttagatgcctttgtactgaccattccttctacccagaaagctttttacctagtgtatctgtatagctctctttcttgtcttccttcggcctgtgctcagatctcaccttgtccatgaagcttgcttacttcccactcctatgttatttgggctcactgtgtctctcccttgcatgctctacttttttcccccatagcacctattgcagtcaaacatttctatcatagtatatggaacatttattattatatttcagttccatgaggatgagaatctttgtctcctttaatcattagtgtattttaagcagctagaatagtacttggcacaaaacagtcactcaaaaagtatttgtcgaatatgaataaaaatatgaatgaattaatatcaggttgaaggtctattttacattttaagttttgaagttataaaggtgatcatggaatctctttctaaattacagcagctctttgggtagcatccataaggagtcaccagaaagattgacctccagtggaacagatgtacaatctttcatggatcatagaaatgccatcttgattgcctctatcattagggacatttatttcctatttctgctttctactatcaactaaaattgaagcactacagttgctcctgtctcatttcttttcaggtagaaattcttatagtaggatgtgtgtggggaaatctttttctgctttgaacccatgtagtcttccttccttccttccttccttccttgcttccttccttccttccttccttcctttcttccttcctttctttttctgcatcttttcttttcttggcaggatctcactctgttggttgggctggagtgcagtggtgcagtcatggctcactgcagtctcaaccttctgggctcaagtgatcctcccacctcagctcccaagtagctgggactacagcacatgccatcatgcttggctaaattttgtattttttatagagatgggatttcaccatgttgcccaggctggtctccaactgctgagtttaagcaatcctcccaccccagcctcccaaagtgctgcgattataggtgtaagctactgtgcccagccccatgtagtatttttgctgtgagtatttcttctaatagtttcacttatgcctgagggtgtcagcaaacatcaagaatgtgactttttcttcttaggattcatgaaagaaagtcttccttgtggctcagtcttgaatttttttagggtggttgactttcatgttcactgagactccaactttcttcagctttccttgaggaaataatttgtaatactctagaggtgttcttttcctttttacttagagaggctgaaggatcccaggaaataaaagcagtagcatttgattcctttgggcatgtatgtgtcacccaggaattgggcagtctcagggagtgctcttgggaaaatcaagacaacaaattggatttttcctcccccctttcctgctttacttctttcataaaggaatattgcctacacctagtatcctcttgagaatttttaattgttcttgtgaaccttgtagctggtatctttttaactagagtctcatgggtggttgaggagctgaggatggctgtaggagcagtacaccgtttcctctgttgtcatttgcagattttttctctctggcttcccttatctcctaattcactgaggtttacaaaccaaacttgccgcacttcattatactcatagtttcagtttatgaaatccaagggagtagctttactgagtactcaacattttgtaatgaggtcattaatatatgccaatgtacattttttgacttttcttaatgcaaagaatgcttgtaaatgtcagaatattttgtttcaggcatagctactttggttacgatttgataacaatagaaactcatttctattttgcttcatctattcagagtatgttaaaggtagttgatagttggaataaagtgagactatgccatttaactttatgctaatcactactcatttccaaccatcttttgtagtcttcttgttctcttctctttggattttctgccttctttttatttatccactttctcccttccttactttacagttatatctcaacttcatagactttcctagaaatggagtgttatcattcatcccaaagtttaaaaacatactattattctccttctctttcctactttttctggagacgtgaattttaaatgacggaactgaaacaattcattgtgtttcatcttgttatccttatttctctttaagttttaaattgtttgtagagagtatagtattgtataaagaaaacattcagataattaaaaatgctgattattaatattattattttgagatggagtcttgctctgtcgcccaggctgaaatgcagtggcatgatcctggctcactgcaacctccacctcctgggtttaagcacttctccagcctcagcctctcaggtagctgggattacaggcatccagcactacgcctggctaatttttgtacttttagtagagatggggtttcatcatgttggccaggctggtcttgaactcctgacttcaggtgatctgcccgtcttggcctcccaaagtgttgggattacaggcatgagccactgcacccccaaaatactgattattaagcatttcttcgtgcctatgttgttatttatgatttgcaaacaatcaagtttaaagtgtcaacagcctggtagcctcctataaaatagttccacactttcatactaatgattgcacagaaatgttgaaaacacatagtaatgctggaaatcaaataaatattcaccctcccttggggagagtatatataatacgtagtcaatagaactggaatgaaagtacaatcagcttccctttgacttatcctatgacagtagacagacattttgttctcctgccacggtatcctccctcttttggaaatggagggtctgtaccaactagaaaattgggaagctatctttctactgtgtaggtgctgctttctgaggcaataagagtattctccccatctttctttcaactcccataccatctccgtgtaactcccagaatacagctagccaggaatgacccacggattggaggtaaagttctgagaagtctcctttgtattatctctaggaatcaagacaaaaaaaaaacattggtagcagttcatactagagataaaattttccctatagtctatctaactatatgtgccagaagtccagggagtagattgggagatgataccacctaagttcagggattgctgcttgctgaaaaatataataggaactgtgtacactcatgtagcttcagatattgatcttagagggagttttatcaccatgtaattgattcagagtagaactttggagaatttatacatacagtcttttttcaaactttctaaatattgttagggttttactcttttttttcatttaaaaattaaggaaaactaaatagaatttgtgaaaaactaagcaccacaaaacgaggggaaaggaacagtacctggtacatttagaacagagtggtgaaatgattcaccatggaaattggaataaaatttagaagctatttggcatccacagtaggctacaaaaagaaatgacctttttcaaatgggattaataaggaaagaataggctgaaatagaaaaaggttaattctcctcctactccgaaaaaacccagtaagattaacaggtaaaagaatgacataaggaaggagtctaaggaaactaaaaataggatagtagattaaaattgtgagtagctatgacagaattgacattagaaaatctacagtctacaattaacattttagattggtgatttggaggacaaaatgtagaaaaaagaacacagataaaatgcagaggaaaagaacaaagaattaaaacagataaggaaagaaaaacagagggaaaagatgataatatggagtaccaatgaaaagattgtacgtctttctaaggcaaaaactagagtaaatgaaacaaatgtaataattgaagacataattcaaaaatacttgtttgagataaaaaagattgtagcatgccagatgagatcactgctttacagggaaaaataatcaaataacacctgcatttaaatatatttttgaaatttttaaaactataagaataaaggaaaaatgtgttacctataagagcagaaatatgtataatgaacatgttttttcttactcccaagagaaacctcagtaaagtttacttcaaaaaagataagatcctcctatgatctttcttccttcaaattcatccagtaattaattgcatatctttttttatgaaaaatttcaaatatgtacaaaaggaggcagaatagtgtaacaaaatctgttgccctcatcactcagatcaacatttatcaacttaagaaccaattttgtttcatctacttcccctctgctgtattatattgaaagcatatcccagctatttctgtattatatatctgtataatacagatatctgctgtattatattgaaaacatgaaaatatgtttaattgtattcataaatatttaactttgactctaaaaaatgaagtcttttaaaaatataaatataagatcattataatatgtaaaaagttaaaaatttcttagtgtcataaatttcaaagtttcttgtatatctcatataatatcagttagtttaaattagtatgcagagaaggtctagatattatggttggctgattttaaaaaatctgtaggttcctctcctcttctgtctctctctctctctctctttcttttttgagatggagtctcactctgtcacccaggctggagtggcgccatctcagctcactgcaagctccacctcccaggttcatgccactctcctgcctcagcctcccaggtagctgggactgcaggtgcctgccaccatgccccgctaatttttttgtgtttttggtagatggggtttcaccatgttagccaggatggtctcaatctcctgacctcatgatccgcccgcctcgacctcccaaagtgctgggattacaggtgtgagccactgtgccaggccctctttcatttttttgagatggagtctcactcttctccaggctggagtacggtggcacaatctcagctcactgcaacctccatctcccaggttcaagcgattctcctgcctcatcctcccgcgtacctgagactacaggtgtgcaccaacacgtacagctaatttttgtattatttagtagagatggggttttgccgtgttgaccaggatggtcttgaactccggacctcaagtgatccacctgcctcggcctcccaaagtgctgagattacaggcgtgagccaccgtacccggccttctgtctctttttatcatttttgtttgaaatttatttgttaaaaaactgtttcatttgttctaggagtttcacagcctgcatttttctgattgcatcccattgtatagtttaacatgtttttttgttctgtagattttctcccaattggtaatggaatctgcagtaatggaaatgttctgtatctgttgttctagtatagtagactctagccacatgtggctattaagtgcttttaatattactatcgtgactaaggaattgaaaatttaattttaactaatttaaatatgaatacgaataatcactgttaaataaattttactatccacagattggacagtacagaattgaaggcttgattaaggcttggcctctgattttctttaaaattgtatatttttaaaaattcactttaaattcttcatcttgtacacttcttttttgagttctataagtctttgacctatatcagtttgaattttcaatttttgtttctcaattcatatcctgtttaacactatcatatttgttatgataggtttaattacattttgcctttactaggcttgttcttattatttctctttaggagaaattgtagactttttttccattttagtgatagaatattaagaattataaatataagaagtaactgtgaagatcaagtgtgcattataagataagaacatgtaaagctagagtttgattgggtagtcagaaccactatagtatttttgaataaggaatttgttgtaagaattagaccttatgcaattgtgggaggagctgggaaagtaaggtcagataaacccattgtaagtcgaggagcatattgaatgtgtattgctttggcactattgtaaagttgagaaatcttaagttgaatcattgtaagttgaggctgtctgtactctgtacttagtccttctttttctatctggtcacatgtaactggtatttttaacttcctttactacccataccctattgctttgctgtcagcaagcatctcagctggatatggttccatctctggcgaggtggtccacacctgtattccaggagggtctattatccgggagagctgtatggttctagtctgagtttgaagtcctgagaactgggagagctgatgatgtaagctctggcaggagtctgagcctgaaagcaagagaagattgatgttgcagcccaaagacagcaaggcagagagaaagcattctttcttactcagggttttattctcttcagaccttcaacagattggatgaagcccactcaagttagggagggcaatctgccaattcagatgttaatctcccttgcagacatacccagaaatagtgtttaaccacatatttgggcacccaatgacccagtcaggctgataaaaaattcaccatcacatccccttttctccttcctccttgtccctggtaacctccattctactttcttttctatgaatttgaccactttagataccttatattaagtggaatcatacagtgtttgtgtttttgtgatgagaaacatagtaagaccagtgaatcctatggaaacaatcttatttccacacttcatttgctgtaaaatgcattctctgatcagaagcaatgccatttggaatacatgatggtgaattaaagtattttgtgtacacatggatggtagtttggtcagaaacgttatggttagggaaggaaaatccgtattcagagtaagtgtctatcttagtaagaataaagcattgcccattccatgatgaaagttactcagtgtgatcaacctgccaccaagttgctatctcatcctcccagaggatggtgtcatatcatggtctcagtgtttgtttttgctattggtgaatttggcactcaacaggagttgtaacccaatcagccttggtgaatggaagttcatattgctgagcctgtgtattacctctgtccttgctgctatgactcttttgttcaattttgtaaagacaaagatggctaggaaaaaacattggttgatatccatagaatacttcattttgccctcctgattattaagatccttgtctactgaagttgatctgggcacagtgcccatttgaagaagtctgtccacatattcttccccagacaaccttgttaccaattttctattcacattctttccaagtacctaaccattcagccaaacagttagacaccacacatgaattggtgtatatttgtatatttggtcttctctcattctaggaagaatgatagtcacatccactacttgacgttctgcttactggaaggattctttttaccactgttctcccgagccagccttgagtggggctgtagtgctgctgcagctgcctatttttgaatcatgtcaccataacatacagaaccatctataaaccaagcccatttttttttttttctatttgtgagctggtcatagagaactctccatgcatccaaggtgtgggttaagagagagaaagcaatgtaacaggaatagggcccatgggaatctggactacttgctcatacaacttatttgtgccttcgggacttttatgccactttcatttgatgatagagtgctcttgtgtatgccaaaatttatggattggtggatcacacagtaaccgtttcatgatgggcaccctctagtcacatggtgaattgttggccatgtattcagtatctgctgaggaccagtagcaagtccaaagcccattttcaaaaggagaatagttatctgtagtggatgacttactttgcttctaactcctaaaagtttacactatgatccactcataaggacctgtgaaatgctatatacatcttgaatttgagtagttgctactttctgttcatcaggtgcattcagaatgatgccatcaatttagtagagaatgaagtggagcatgtgagatctttggtaatggagagttgattaagatttctacatactagattgtgatagagagccagagttgatatagctctgtggtagggcggcaacaaaggtacattgctggtcctgctagatgaaaaaaactggttttggtggtctttactaagggggtagaatgaatagcttcattccaattgccagaaaatgtgttgatttgtttcacaatgaaactgcatatttaattgcagcagcaattggagtcatattgattaattcactgtcattctgtaagatccatctgtattctgcagcggctgagttaggtgagttgaatgctgatgtggtaggaatcaccatgcctttatctttcaatcctttaaaaggcagtaatctctacagtcttgccaggagtgtggcattactttcaatttgtgttttggtaggtaaaagttccagtgatttcctcttggcttttccacttgattttcctctgtaatatccctcactctataggtcaggtaaccactgtggacactgtgccagttgctgcatctgtcctttctaaatatgtgttccaaactcggagaataactatggggtgggttcaggtacctactggaccgactagagagaggcctcagctaaaactcagttaattacctgacctctgtaagctcctaccctgactacagaaaccacagtagcacattttatgtctccctgaattaatggcagttcagatccagtgtccagttatccctgataagtgtagttaattcctccccccggtacagttaccctgttagatggttgcatgtttctttgaggaaggttaggaggaagatttacggtattttttggcactatgtcaggattgctaacagagacccatcgtctttattcacaggtccctaggtctgtgaattagctcaagtctgagaagtatttgaggactaattcttccttttttgtttacttaagtcctgcttgtggtaatcagagctaggacttttctacttatgcaaaccaaatgagacttaactatgctgcccatttattttggttctaggaacaccatgatcagttagccaatgtcagtgatctctgtaggtcaaaccattttgtttattgctttgactccactacccattatgttaaacatgtccactttgtctctggaagttaattgctaccatttggtctcttgttacccaagatccaatcacttgcactaaattcagggaacccattttgatggcaccagtgtttgctgttaatctttgccttctagccacatggagcttatcaagctacacagaactcatcaacgaagcagggacttccgttactaatatatttctcaagctttggtaaaggaagtgttttttgaattctcccaagagacgtagttagagagtgagaaggacttacataataaatactttccatatgttagaaaagttatgaaccatttttcctaaacactctagaataggcactaatgtttgcaagataatgaaagatgtttatttataaacttagtgattaagacaatatacagtgttgtggtctgagttcaaaaaaagtctaactgccaataaaatgtttgtattagtgcttttaaaatgaaaacagaattttcttagttatcaatacattatatattaaatgtttggattttatcaggtgaaaacaaaactcatttgaacattatttcctgttttctactacaagataaaaaatcaacactaaacaacagagttcagttcaaaacatgaacgtgactactcatatcctatattgatagctgtataaaaaaagctctgtcttttgtctgtattctccctccattatttcttactaattctcccttcttgggatcttgtagaaaaatgaagtaggtaacaaggtggttaagaagatggagaagatagactccattcatgaaaagttactgtttttttctgtagaactatggattactgaaataatgatgtcagcttgaaaaacaatgatttatatgagttatgaaaaattatttagtttttgagattgtctaaaaggaaacgtgtaaatagagggcttggaaccttttttctactccacctcctcctgtgggctactaattcaagaaaagatttgccaaagtacagccagagttgaaacctacttaaaagtgagagggagagatcgaaacagggtatggtgagtgaaagtaacccacatatttgggcacccagtgacccagtcaggttgacaaaaaattcaccatcacatccccttttctccttcccccttgtccctggtaacctccattctactttttttctatgaatttgaccactttagataccttatattaagcacaagtatagacagagggagagagaagctcaggattttgagttgatgttattcaagtataaagtgttcctgatatattctattcttcatttggaatttcacttttgaaaagctaattatgatcactgttcagatcttttttgctactctttgtgagtttttaaacctttctttgataggatagcttttatagttcattgtttttcgggccatactgcagtgattaaaagattattaggttaagtcaaatcactcaataaggtcctcggtttagggtgacccttttttttttatttgtaagcattttgtcaggttaagggaccagtaagtgtttcttttttataataaatttgggtgggatattgtcttagttccttttgtgctgctataacagaatgcctgagactgggtaattaataaagaaaggagatttatttcttacagttctggaggctgggaaatccaagattgaggggccaacatctggtgagggcccttatgctacatcatctcatggtagaagatgaaagggcaagagagagcaagagttggggagaactgacttttataacaaacctacttctaagataataaacccattcctgtgatgacattaattcattcatgagagtaaagccctcataacccagtaacctctcaaagattccacttctcaacactgcattggggattaagtttccaacacgtgaactttggaggacatattcaaatcatagcagctggaggctgagcaagatggctgaatagaagcctccagtgatcatcacccccacaggaataccaaatttaacagttacgtaggcaaaaaaaaccaccttcataagaaccaaaaatcagatgagcagtcacagtacctgttttaaacttcatatcactgaaagaggcattgaagagggttgaaagacagtcttgaattgctgacaccaccactcttccatgccccagcagcggctatgtggtggggggaatctgtgcacttggggaagggagagcacagtgattgtgggactttgcattgaagctcagtgatgccctgtcacagtggaaagcaacactgagaataagccagtgctcacggagggaacatttagactagtcctagccagaggggaattgtccatcctagcatttggaatttgagctctgacaagccttgccactgtggactaaagtgctcagggtcctaaataaacttgaaagacaatctaggccacaaggactgcaactcctaggcaagtcctagtgctgtgctgggctcggagccagtggacttagagggtatgtgacctagtgagacaccagcgggggcagcaaagggagtgcttgcagtaccccacctccagattcaggcagcacagctcacagctctgaaagagaccccttctttctgcttaagaggtgagggaagagtaaagagaaccttttcttgcaacttggataccagcttagccacagaaggatagagtacaaggcagagtcctgagacactcattccaggccttagctcccagatgacatttctagacacacccttggccagaagggaatctactgccttgaagtgaaggacccaatcctggcaggattcatcacctactgactaaagagcccctggggcctgaataatcagcagcaatacccgtgtagtacacacggacctttggtgagaatctgagatctgctggtttgaagtgtggcccagaacattcacagctgtagtggctacggcaagagattatttctgcttgagaacagcagagagaagaataaaggggactttgtcttgcagctaagttagcttggccacagggtggtagagcaccaagtgggttcttggggtccttgattccaggccttggctcttcgatggcatttctggacctgcccttggccaaaggggagtctgctgccctgaaggatgattcccagacctggcagcattcaccacaagctgactgaagagctcttggaccttgagtgagccttggcagtagcctggaagtactcctggtgggcctgtggcagtggtggccagggggagagactcctctgctatggaaatgggagggaagagtgggaaggactttgtcttgtgccagttcagcctcagtagaatagagtaccaggtagattcctaaggtttccaacaccaggccttggcttctggacagcatctctggatcttcccaggacctgggggagcttgccatcttgaggagaaggacacaatcctggctggcttcactacctgcttattgtagagccctagggccttgagcaaacataggcagtcgccagttaatggttacagcaggtcttgggtgatactcagtgctgtgctggcttcaggtttgacctagtgcagtcctactggtggtggccacaggggtgcttgtgtcacttctcccccagttttagctcagcacagagagactctgtttgggagaaagtaagagaaggcaacaagagtctctatgtagtaatctagagaattcctctgaattttatcaagaccacaaaggtggtgcctctgtgagtctgcaggagccacagtgttactgggcttggggtgccccctaatgcagatatagctgcagtggccaaaaacttagatcacaacacctaaagacgtttaaatactgggaaagccttctcgggaaggacaggtactaataagtccagactgcatagactaaaataaataactaactcgtcaatgcccagacactgaagaacatccgcaagcatcaaaaccatcccagaaaacatgacttcagcaaacaaactaaataagggaccagaaaccaaccctggagatacagagatatatgacctttcagatagagaattcaaaagaactgttttgaggaaatttaaagaaatttaatataacacagagaagtaattcaaaatcctatcagataaatttaacaaagagactgaaataaaaagaatcaagcagaaattctgtagttgaaaaatgcagttgacaatgaagaatgtgtcaaagtctcttaacagtagaattgattaagcaaaagaaagaattagtgagcttgaagacaggtattcgaaaatacacagtcagaggagacaaaagaaaacagaataaaaaagaatgaagcactcctacaggatttagaaaatagtctcaaaaggggaaatctaagagttattggccttcaaggctggcgggggggtggggggcggggcgggggaaagagagagagagagagagagagagagagagaaagtttattcaaatggataataataggggactttccaaagctagagaaatatatcattattcaagtacaagaaggttatagaacaccaagcagatttaacccaaagaagactccctcaaggcatttaataatttagccatagcagacataaagcttactttgtacttcaactaaactttattatataaacattttcaggaaataaaactttattttatttagaatataagaatgttcataggtcagtaaggagagggcattttgtcccattactcttcagcactcatattaagatgattttattcttctgaatttctaagaggaagttttctcccttattgtaaaaatgcagatttcccgagtgtccttgaatgatttattcatggtctacttgtgtagtagcaaaagaaaagaattatacattactttttttttcatcttgtgcaagagaggagtttaaaaatatatatttgataagacctttaataaaatttttaatgagttgtctttccaactcatagtcattacgaagagtactgtctcctctattatcatggctcagaagagtgtatttcttttcctagctgtcatatgtgttgtttccacattacttttggtttttaagttaaatgttcctcttctgttaaagaaaaaccaagttgtacccatatataagttggtgcttaaattataccttgataaatgtcataaatatattaataacattttctccaagatttaaacatgagatatcaccatactctgagctgagtaaagttgctctatcattaactaagaatttttcccctttcttccttctttattactgccttcccccacttctccataagttctaataatagaatatttgaagaatggataaatgatgtcatataattttttatctactatctttctcttattaaaccttaaattctataaagacagaggctatacctttcttgtttatctttgtatgcataatgcctaagattagtatgtagtaggaattcagtaaattagttgaatgaatgaatagtaggacgtataatatgaatgctgctcttaaaatttagctttgttgaaaatccgtttcgtgtatattgaaatatttatattataaaatatgatgagaagaaataacaagaaaagaaaaatattttcaatgtgaatatttaaaaactgaatttgctacttgctttttaacacttaaagaatagtgcaatcaacaatcaatttttttagtatattttttattgtactttaagttctagggtacatgtgcacaatgtgcaggtttgttccgtgtgtatgcatgtgccatgttggtgtgctgcacccattaactcgtcatttacattaggtatatctcctaatgctatccctcctccctccacccaccccacaacaggccccagtgtgtgatgttctctttcctgtgtcaagtgttctcattgttcaattcccacctatgagtgagaacatgcagtgtttggttttttgtccttgtgatagtttgaatcaacaatcaatttagtttttgaaattcaactttttggattaatacttggagctacgtttgatcatgtgacctttattagctcaactaacataatttatggcccaactaaattaaagtagtttgagggcataacatggaaatgctcatatttttaccatgagtatcagttttaagggttttaattgaaacatgatgtaggctatgtagataatagcatttttattgtttatttcaaattgtaacttgagaattttaaggattgaagaatatttccaagtataacagaaaattatatactcttgggttcagaaattattatttaagcaaaatagtgcagtataaaaggcctgactagtcagaaacacaaggaccacagtaagtgtacataactcccccaaacaatggtaatgtatacttcatttagttgttggataaaaggtatgtacaaacactgccgttacttaggagacatgaaaacaaaaacaaaaacaaaactcactaccatgtgggtcttgataaggtagaaagtagtcataaatttaaatttgatatattatgaactttaatttggccgcttgtttagaaagactattaatacttggccatacagcagtatacttggagaataaaattctattcaagaattttattctccaagtatactgctgtatggccaagtattaatagtttcataacgtcttttcagctctacctaattgtagtatctctgttactatttgcctaagttttgtccctttgtgactttaagggtatattttcatcctatatttttctctaggcatccacaaggacaaagataaacctcccagcttctctgttgtccttgagagattgaggcgtaccttgacagattaccagaacaagctggaagatgcatctaatgaggtaacacttgcactgtttggctccacacatatagccttcggcctgtaccagtacgtattccttgcttgttacaaaggtcaaaaagattgggaatgttgaactgacagcttcacagatacaaaaaataataaattatctttcgctgttctttctttaagtgtggcctaaagtcatgtctcacttacgtttttgtaactcttcagtcacactattattttcaaagttataaagactctatcacttcttgatcttcataatttatctgttttaacttaatgaaaaacactatgcaagtagtttaagttaatatgtactgtatttaaatgtcagtgtgtttttatgacatttggtatagctactggaaatttagattttgtcagtgttttaggttaagatttctacaaactgtggaagtcttaataaaaaagagagaaattagttttcattctctaaaggcagtaaagtgttgttagaagtttttaaaaaacaaatatctgtttgatgtagcctgggagcttttagtttgctgattgaaaaagctcatgcttctatttatcatcccatttgtattgtttaatgtgtgggttgataattttcttgggtattaaaatgttttatgaatttgtgctttaagaattgaagagtttgtctagttacatcttgtcaaattagcatatgaagtaattacattaaatacaattagttagcaaagcaacaaacagattgttagagtcaaagacaagtcacatagcatggaatttggagtttatccttgtgtgtatctctttctttcatataatataaatgccataaaacggttacatttcacatttcatatgcggcttattttattttagcttgctaagatgaacaaagaaggaaaagtgagtctttttaataccctcggtaattgttcaaaaggcataaaagaaaatgaccatcgaaataattaaatttctatgaggaacaaatattacgaagtctttcccagtgagacaagacaacctgtattgttagtagtttatgaaactcttctgaggcctaggtctggaagctgcagggtaactaggaacatattacccacagcgaattgttatttgggaggatgaatgtcacatgatcctcagcacagttgaaaagtcgactcagcaggctttggcttagtaatgcgctttgttgtgaaccagtgccagagacagcagtggggagaccaagggggtggctgcaaagaaagcaaaaagagcagtctgacagaaagaagaatgaactgtcaaagaaaataaatcacaagcggtgcaggaccaactgatgacctgccacaagccttcccagtaggactgcatgtgaccgaccctgaagttgtcatatggagtgagagaccagtgaatatcctcatgatgtatagaaagaacagtcttctgctctgttcttttttatttacttatagatgcccctgcttctggcattttggtccagtaggattttaagaataaagttgtatttgtttacaataagaatgaaatcctttatctggacgtgtggtaaaaatatagtaacataagtgatattttaagcttgaatgctttcttttctttttagccacatgaacttgtgacagaagctatatagcatttaaccaaaagaaataattttttaaagactcttaattactattgaaaaatttgtatttaagtaattgcataaaaagcacttaaagattaacttttgagttacccatccttgaaaaatgtaaaaaagttacttatattttctttcatcagctaaacagcatgaatgatgttaaggaaaaggcatgtaatgaacttgattctacgaaacagaagatagactctcacactaaaaatataaaggtattatttagaataacttttaccttttgtattaagaaacaaatatagttatctagggaatattttaaagtagagatattgaggtacctgaaaatatgtatttctattttttaaagtatgtatgggtagaattttaattttttcttgttgattaagagtaacaagaatgtttttttcatttaaaaaattaaaacctgattggaaattattttggttaaaggaaaatttatttcccagatttaattataataccttatgagattcaaataattatttaagatgaaatgtccagccttaggtacgtactaaacatattttacataagcacatcatatttggagtcagttttcatcattttaaggtggagccattgttttcagtacatcatgtctgttaatgggctgagaccacacctggctaaggcccaggactatagtttattttagtttctgtgctggttttatgtactacatctttgcaaaattatgctgagtcaactctcagaagtttcccagtattgctggaatttcattatgttgtttcatgttgggtttgtcctggacacacttcaaaagaatttgttaggtttaaggaataaacagttcagcaaaattttgtgccacatatttgagatttctataagtggttgggatgtcattggaaagtaaatgttcttatgttaaatgtaagatatttattttaaaatattttaaaatttttgaactacaacgttgttttaaaaaaataggttgaaaggaaactcccttggaagaactttttggaataagccatcatattaacattttatgtaaatgtttaaacataacaaatgttctaatttttgagctgagatattatatttagaaaatacattcagtaaaatattttaatgtaaacaaatgcttgcctgcctttgtgattctttcattttaaagctttgaaaatgttcaatatgtgttttatactagtgtcccctcaccccttgttggctggcctttctacaatctctttatttggtatctatgacaggaacttcaggataaactggctgatgttaataaagagttaagtcatttacacactaaatgtgcagaccgagaggctttaataagcactttaaaagtggaactacaaaatgtgctgcactgttgggagaaagaaaaggctcaggcagcccagtctgaaagtgaactgcagaagctttcccaggctttccataaggatgcagaggtattacctgagactcaatgactgtcaggaagggcctttcactaatctcagtgttatacatcaagtgactatttttacttgtatttaattaagaaaattgttctgagcagagtattttgaaatgtttgtgacagctacaaaatcactccattactcttgtgtcattctcttttgtgagagaagtactataacttgcacaactaattttttttgtttatcatgtgtacaactatctttttggacttttagaatattgtaactcaagtaactatgctcctaacagtcctttcaaggttcctgtttgccaatgacaaaattatttttatttcagtagcttggtagattgatggtggaaagaataaatattttataatcagatagacctgaacttggatgctaatacttctgtttataaatgatgtggctgtggacaagctatatagcttagcctctccacatcttcgtttccttatttattttttttcttttttgagacaaagtcttgctctgttgcctaggctggagtgcagtggtgcgatctgggctcattgcaacctccacctcccaggttcaagcgattctcctgccccagcctcctgagtagctgggattacaggtgtccaccaccatgcctggctaatttttgtatttttagtagagatggggtttcaccatgttagccaggctggtctcgaactcctgacctcaggtgatctgcccaccttggcctcctaaagtactgggattacaggcctgagccactgtgcctggcctagtttccttatttgtaaaacagtaataatatctactttaagagatagcctcctaactctgtataattataggatgttaataaaaatttagaaaaataagagtcccataaaattaaaacttttcatttagaaaccctggagagttgcctacccatttatgtttattaatgacttataaaaatattatgacacaaatttcatattttgtttaagcctctgtgaatggaattatcttctagttctttttaccctatgggttatagagctagtctagctagtggaactggtttatctaagtcatcctgcatattgagttcattactccaacaaatatgaacatgaatgccaagagagtaaaaaggaaacattctttccactctttttacagtctgggatttaaattgtgtccacatgaaggggttggaattgctctacacatcagataatgattaaagtaaaggaaactagaagcctgactatattgtaaagtcagcatgtctacagcgctgtggttgggttcaacatgtgtgaattgattttggattttggagtctcttttcatgccaaatggatgattatcatgcttggtttatcacagcccaagcaaaaaggacataatagcgacacaatgaattatccttgaggatgaacttccttgagaacaaacgtgatcagtaggcaaaacacaggaggaagatttttatgtatttgttaagttatatttaataagactttaaaacattttgacctagttaaataatgcaaaagtcatcattaactgcttatgaaaaggtatagcatatttgtgaaaaaaatctgatttcttaaatttgttgttgtaactacattttcaaattttttgatttttaaattattacatttggaaaaaaggtggcatacatagtgaactaaagatttatattttgatatttgtaagaaaatgttctctataatttctaattataaaacttttacatatgctatattcagttttttaaaaatctataatagactttctaaatttttctttttaagtttgtctcttttaaaagttttcttcctgctgatctattaaaaaatcttgagggaacttattttatctagataaaataaaaatattcattttgcagctttacaattaccttgtcttagagttccatgctttgggactttacagatgaaacaccttataaagagagctatttgacattatagtaagtaaaccctcctcatgtgttcaaatgtgatctgctttatatgaattctgcagcatagtaagtgtttctaagtcattcagcaatggatagtttaattactgaagtggtaatataattttaaaggacttttaaaaacatatttctaattggacattttcgaaagtatgtaatgagcagctatatccatttttttttgctgttactttataatatttaaacacctacaaatgcccagtgtgccaaatactatatgaacttataagtggggaaaacaaatgagcccatcttccatatctttcatatcactatctgctttgcctaaggggcttgggatagatttcctataagtagtaagtaaactggattctctggaggaagaagaaagctgagtaattgtgtccatgtaaagtacagatattggtataactttttttcatcagagttgaataacactttttttctgtattgttttttgacaagtagtatctattttggcaaatgtaactattaaattatagaattactgtactgagttacagttagataggcttataaacaatgagtccaatccatatgcttcgtgtgatagctaaggaaacttaagcctgagcaggtgtttactcaaatcacaacctccatcagtagcagaggtggagatgaatcttggtcttctggcttccagacttcagatttcgattttgaataccaagtgtaagcaattccaaatgttttatctggtgcttagttttgattataaaaaaagtcattaaaatattctgagacttgagtattgtaattccttttcaggttttttaaattaactcttcaccattagtattatgtattttacttcttacaatgtttatatacagcaattaatttttcttttttttttcctgcaggagaagctaaccttccttcacaccttatatcagcacttggtagcaggctgtgtgctcataaaacaaccagaaggcatgctggataaattctcttggtctgagctttgtgcagtcttacaggagaatgttgatgccctgattgcagacctcaacagggctaatgagaaggtaactgtcctcaggcaccagatacctctattaaattcagtgacatttgtccacatcacagtatcattaagaggggctgacattcatcttatttcaaaaagaatttggatgttaataattcaataccattaattatggcttgtctacaactcagtttgatgccattgctgtgggcatgtaaatgtgactgaagtctgtatgaagtctctaagctccactttctgtgcaggacatgctaatactactagccagtattagccacagggacctaattaaaagaaaataaattaatcttactgatgaagcaattcaaagaccttagtcatttacattaataaaccaactctttatgttagcataaaatagaagcaggatatagttattcaaaaacatgatcttaaaattctttgcttaggaaatataaggtgttatttttaaaagcttaaacattttaaattatatgcttatgatttgcttctcgaaatacaacaaaatgtatattagaaaactcactccatgctttagactgcaaaaagtgtattttataggagaatatagtagacctttatggtaacattactatctcacaagtctaggaaatcagtctccaacaaatgtttaaaaacctgcttttggtcatagaaaattacagtggcttagcagatcaacatatgccaccattaaagacacattggttcttatcctgggtctattgaactagtcagtactgtgtttatgtggtttagtttccaggtcttagttgcaatgacatgtgctcttaagggacaagaagagaaaaactgtcccgtaagttaaaaaaaaaaattctgttgaagtaataaaacagcatattgacctaatttcagggtgatattttttattattgagcattttatcttggtcctattgacaaacacaaccatagacactgagaagtagggctaggaaatgagggaataaattgtgaaaggcacagatgctattcttgattgtgaatgtgtacataatggatttgaaaattaaagataattaaaatgaatgtgttttaaccctatgagatggtattatattttcaatagttttcattgtttcaaaacatccttaatagtcatacattttagaaaatgaggattttctttccagagtttgaatgtgaaacaaaaaatggttagaacattctgctttatttcatgtaaactgtttgcagatttttaaatcttacttactttttttcccattgagatatttgaatagcttgagctttggttccagaagtaacagtatctttctcaatctcaatcaaattaattatagaataagtaacttcattagaaagagaagatgaaaaatttgccatctaaatatacaagtaacacaattttctgctaacgtgtggcagtttacactgctattttctttttttaaatttctttatttacattttatgttaaaatttttatatgatcttaaggaataaaatatagtaggacattttgggtattttattgggggagatgacacaaagaaatagcttgtgagcatatttccttctctgttgcatctccccgtatagataaggcatctagagtatatctgtaaaaacaagtctgacacgatgagagagcttcagcagactcaggaagacacctttaccaaagtggcagaacagatcaaagcccaagagagctgctggcacagacaaaagaaggaactagagctgcagtattctgaactcttcctggaggtgcagaagagggcacaggtatgctacctttacaaagagctttaaaaaatgggttactcagtgtaaccattagaaactttttttttttcagtagcagtgctaaatcagtttaaacttcttaagaacttcgtagaacttgtttagatacacatatatttgtttagatacacacacatacgtgtgtgtgtatgggtgtgtatattaaggattgtctttcatgtaagtttggaaatatatgggtttctgattaaaatatcccaaaatgcattggtcagttaattaaatgcgaaaattatatttcctttatttatttttaaaataaaatattaaagtatttggtaatgtattgtcagttttagtgtaggtattcctttatctggtttactccatttgtggaggttcctatgtgaaccatcatttaaatttatttggggttaaaatctcctatgcctgctgatattatataaggttatattatataactgatattatataaggttatagttgtaggccatgtagcaaaagtaattcactatgagttgtattatgtattatatcttgattgagagtagaagttatgggttaacataaccatgtattttttctacacaaattatcatcaacattatttatattgttaactatcatcttcacctaatcaggaataacttgatgatagggtatacttttttggcattgaatttattaataggtcacttttgttcctaagttaggatacttaggaaccagaaggttgtatattcttcccatggttgatttggtatttagcctctttatttgatccattcatgcttatattggcaagtctaattaaaaataaccaaactatataaatatatatacacacacatacataaataaaattattattattatattaaatcaggtcattctgtatccccaaatttaaaggtcctatatgaacttatgcctttctatatgaatttgaatgaatcaacaaacgtgccatctaaaagtagtaattttttcattgtatgcagattactatattatatgctctgcattttctaatattgaagtaaaagagctaaacaattttaattttgtagaggtagcattgatatacagtgacatgcacaaatcttaagtgtataatttgatgtttttaaaaagtatttatttgatatgtaatatttgtacatatttatggggtacatgtgatattttgatatatgcatagaatgtgtaatgctcaagccagagtaagatatctatcaccttgagcatttatcatttctttgtgttgggaacatttcaaatcttctcttcttgctattgtgaaatacacaatatattgttgttaataaagtcaccttactgtgcttttgaacactagaccttattccttctatctaactgtattattgtaccctttaacctacctctctccatccctttcctcccccaacacacccttcctagactgtggtaactacaatttgatgttttgatcaacataaacacccatgtgatcattaccccatttaagacttcaaacattttcattaccctagagtgttctcatgttctctcttccagtcagttttacgcctcataggcaaccattgttctgatgcctgtcatgtagattagttttcacctgttcttgaatttcatgtaagtggaatcattcaatagtctggtgattgactaatttcactcaatattaatgttccgagcataatgtcatttacgttgttgtgtgaatcagtacttcattcttctttatggtcactagcgttccattttatcacagcaccactatttgatggattgtgggttgatggatatttgagttgtttctgttttttaaatattgtaagtaaaattgccacaaacattattgtacaagtcttttgtcaacatatggttttatttctctcgcttaattactaaagtgcagttgccaggtcatgggatatatgtgtgttcataagaaactgtcaaaagtttctaaaaaatgcttgtgtcattttttattcccaccagcaacacatgtaagtttccattgttctacatcctctgcagcacttggtattgtcagtcttttaaattttagtcattatagtggttttaaaatggagtttcattgtgatttaaagttgcatttttttggtaattcatgatgctgagcacctttcatatacttattggctattcacatatcttcatttgtaaagtatctcttctactgttttctcatttaaaaaatagagatatttggtttttattattgatttctaagagttctttacatatcctggatacatatcctttgtcatgtatatgcatcacaatattttctctgaatctcttgcttgccttttcagtgtttcttttgatgatcataagttttaaaattttgatgaagtccaacttacaaatctttttctcttttggctatttgtttatatatgtgaaatgatttttccttacttcaaggttgggaagataatgtcttgtttcttctagaagtttcatagttttagcttttacgtctaagtttgtgatccctctcaaattaatttttgtgtgtgctgttaggaagagtttcattttttccctcttcatttattgttcccacttcacttgttcagcactttcctagctgaatagccttggtacctttgtgaaaaaacagttggccatatttagaaaccacagacttgtccatctatatagttttgccctctccagaatgtcatataaatggactcatacagtatatagccttttgggtctggttactttcacttagcaaaatatatttgagattcagtcacattgttgcatatatcagtagttaattcctttttactgctgaataatgtcccattgtatggctgtaaaattttatccaaatacttgctgatgggcctttggattgcttttagttttggcaattatgagtagagatgctttaaacatccatggaaaggtttttgtgtgatcataaattttcatttctcttgggtaaatacctaggagtttgatttctagattatatggtaagtgtatatttatatggttatatggtaagtgtaacttaagcaactattaagttgtttttccaagtgactatatcattttgcactctcactagcaatgtaagagattttgatttggtctgcacctgtgccaacatatgacttcatcatttttttcttttgaattttagccattataataggtgtgtaatgccatgtcattgtgatttcgatttacattttccctactgcctaataaattaatcatttatttatgtgtttatttgctatctgtatatcttttttggtgagttatctgttcagatattttgctcagtttttaattggattgtgtgttttcttatcgtcaaattttgagagttatttacataccggaggttcaggtcatttttcagatacatgatttgtaaatgttttctactgttctcttagcagtacttttgcaaagcaaatgtttcaaatttttatgacccatttatcaatttttttatgggttatacttttgatattacatgtaagaactctttgcctaagattataggcaccatttttttccctatatgttttatagttttaggttttacatctaggtctatgatcaattttgagttagtttctgtaaaggtgtgaggtatcgattaaggtcagttttttttttttttttgcgtattcatgtccattccagtaacatttattgaaatcactgtcctttattgaattgcccttgtacctttatcaaaaatcagttcactgtttgtgtcaatctatctctagactttcttgtctgttccatttatttatgtgtctaattctttttttctttcaatactatactgatttaaccttttactaagtttaaaatcaggtagtgtgagtcttccaacttcttttttcatcaatgtcctgaactctttgaaaatctaccagaaggcatagcaattcacttttttctctttttgagacactttcgccctgttgccctggcttgagtatggtggcacagtcacggctcactgcagccttaacctcctgtgctcaagtggtcccccacctcagcctcccaagtagctgggactgtaggcatgcactaccatgcctaactaattttatttttaaaatttttttgtagagatgaggtctcactatgttgcccaggctggtctccaactcctggcctcaagtgatcctctttccttggtctccctaagtgttgtgattacaagcgtgagccactgtacccagctgcagttcattttttgaagtaagagaatcagtcatcacaaatgctaatgttttaggagaagctctcattgaagacttttctctgaagaatgtgtaataccttagtctttgacccatctgtatacaaatggaaatgatcattttaattatctgtaaaagtacattactattataaattggaggctgagtgtggtggctcatgcctgtaatcccagcactttgggaggccgaggcaagtggatcaccttgaggtcagaagtttgagaccaacctgaccaacatggagaaaccccgtttctactaaaagtacaaaaaattagccaggcgtggtggcgcatgcctgtaatcccagctacttgggaggctgaggcaggagaatcacttgaacccaggaggcagaggttgcaataagccgagattgcgccatttcactccagcctgggcgaaactccaacaagagcgaaactccatttaaaaataaataaataaataaataaataggcatatattctgtattatttatgtacatatttgcttttttatcaaatataattgaatacactgcagcaatttattttggtattatgtttgataaactgttattataatacatattataggacctgtaaattttattttaggaaattttgttatgattaattctatatcttttaccaccaaaagtgcaatgcaaataaaaaattttcattttacattacttaatacattttcaaaaattatgttgataaggacatgaggggaaaaaatccgcagttgttatataggattgtgagttatagaggatgtttggtgtcagatgagcataaccataagtatattccatctgctgggaaacaaatgacctattcttagagtcttatgtttaatatttggccattgtaaagaagcaattagtaaaagacactaaattaaagtaaaaaacaatatttggatttgattgcttttatctgaaaaaatgtagtagatgttagaaaagtagtgtttgtaagaatctaatatttctaagacttttttaatgtcgaagctttaaaacagttagtgtaaatgctactagaaaaatgaaatttgtagagaaggcagactggttttactatcacagcatgtctttagcactgggtaaagtttgctagccacatgttgggtaattcttgaatttaaatacgttgagccatcatgtaaatatatctcaagtgtctatgcctactaaagtatctgggcccagtgccacataccattccatttactaactttgtttttgtaatcttagcatttatgttcttgtttcttttctatttgaaaaagatagttattggaacaaggacttcctttctagaagtaaagttttttttttactgtcagttaattaagggttacccttgatgtaatgtttattgtaaacactttagatttatttgacattttagtaaaatcaagtgagtttagaatggagaacaaaactcagggagattcaggttcatcatgctatattgcattttattcttcttttactgtggtattgagagtgtatttggcaaggaatccaggtgagtcataaaagtgttattagatgttgaaacttttttcttcataattgaactccaagaatattcagagataaagtggagcttattgatattgttggaggtgataattccttaaggtatacacgccagcctgcagcgattcagagagttagttacaatcacgtgtacactatgttctgatagactgtgagtccatgggaatggatacctctaatgaaattgtggaagagacttctgactacttttcaaataattgctttagaaattgtttttgttaattataatattagcagttgaattggcgtggtgcttgatataattttcaatgcttttgcatattttgtatgtctctccttatgtaagccctaccacaggcatatgagataggtcatttaagtatcatttctattttacaagcgaggaatctgaggttcagacaactgatactacttacttgtgtagtaaggaagttctagggacaggattagaagaaacataaccatatgtgaaatgtctagcccattgcttggcatttagaaattacaaagtgaatgttatggactgttttagtacgtttttaccatccttatcttccagtcccttttgcattatattgtaatactgcttcttttagaaatatatgctatttttatatataaagcaatatctgaaaataggtatagtgatacctcagtttcatatttatggaactcatattccttttttttttggagctagtacctcactacattgcctagactagaggtcagtcgtgcgatcatagctcactgcagcctcaacctcccaggcttaagagattcccccacctcagcctcccaagtaactgggactacagggcacgccaccatgctctgctgatttttgtattttttaagtagagacggggtttcgccctgttgtccaggctggccctgaactcctgggctcaagcagtacacctgctttgacctcccaaagtgttggaattacaaatgtgagccacggtgcccggctcacatttctttttctttctttctttctttctttctttctttttgaaacagggtctcactctgtcacccaggtggagtgcactgctgcagtctcggctcactgcagccttgacctcctgggctcaggtaatccttccacttcagcttcctgagtagctgagactataggcatgcaccgccacacctggctaagtttttgtattttttcgtagagattgggttttgccatattttcgcaagccatctgcctgtcttggcctctcaaagtgctgggattacaggtgtgaactactgtgcctggccagaactcacatttttaagtgattcttgattaatgtttaaacatgataatgtatgaaaaatctaaatagtgctacattgtcagccacccacaaatggtagttctcttaatttgtatttctcggattttttttttctgagaaactgaagttttaatacactatatcataaattgctactgtagataagaatatcaagataatttttacataatttagttaatattaataaaaaactatatatgttatataccaaatatatagcacactgtgttgcatgctgtggtagtaacaaagaggtatactatatatttttttcctcaaaaagtgtaaaatataattggggagatacatgaaaaagtaaataatacaaggtttatcataggctgtacataattagttgccaaaagaatgctatacatttagaagaggagatagatggtcaaagtttgaggaggcttagcagaggagactggagccaacctgggccctgttgccaggatctgaaagcacagaaagaagggagatataggacacatcagaatttagaggtaatattgctaattttccacagtcagaggtaatatctcttaacagtaagcaaaccagacatcttgcctgtattgacatatttattcccagtcttccgataaaaagaactctgttcttttgagggtatggcttatccaaagggtattttataatttacagtgctttagaaacaaaacaataaacccaggcacatactatttttggcacatatttttgatgtgttaaatttacgtaatgaagatagtgttttaaaattaaataaccattatggggcttgagaatgtgtgtgtgtgtatgaagactagataataggattgctagatcatatgataattctatgtttaactttttgaggaactgccaaactgtttttgaaaatggctgcactattttacaatcccattagcaatgtctgagagttccaatttccctacaaagtgtccttattttttaacagagaaacatttacataatagagaaagcaggtgaatttatgtttgttatatttttaaatattaccatagcttaaaaaggcaagatatgaaacttataaaaataagacactttaaatgaagtcctttgatgtctatatgccattgaatgtccagtgtgcaatttgcctttttgccaacataaagagcaagaactcagcaagcaagagtgatacaaaagaattttactccctagggaagtgtctaatttctggcccagagtctcaaagttcacagagtgctgtaagccagtaaggcatccctcaaagttcatgtatttcaggaagtaagtccgtgattcattaaggaaaaaagctgtcctttttccacattatggatgcactttgaatttattagagagtaaaggaaaactggtgaaattatgtagtatttttgttatgctattgaattttgtgtaaaaggtatgcattctatatttttaggtttttttcttcatgatcggaatgtttttatgggggaatttgagaatattatttttcgaaattaaacacactgaggagcaggttatttcagtactaggaatgcttttgtcccatatgaaagcgatgttccttatgtttgttttaaaaatactggcctttaatctccttgggtggaaaacattcgatttttttttttaaagcaaatttgctctatagctgtttccacccttacaatcaaacaggctttgttcttcaagaataattcacagtaaataatgcaatacctctgaaagtagttccctatggaaagtcagaattaatttaaaccagaattctgacatgtagataagttccaaattacatttggaaattttgtttttttaaattatatttttcttttttctaagcctttacactctaaagcttttttcattaattgggcatttattcagtgtctattatgggcaaaacactgtgctaagcaaagtcagggatgattttataaagggttatttaattccttcaatatttattaaatacctacagagtatagagcactgtgacagacactatagtaaataattcctaacctctaggaactagcaatcttgtatttgagggagagtagatatacacacatgaaataaataagtagtgtagaagttaaatgcctgagtgacccttacttaagttcagagaaggtcaatatcagtgtgaaggaaaatgatagtaaaatgagtcatagaatagacagaacctgaaatgggctctgaagattgttagtattcaaatagtgttaggggagatcgaaggcaaaggagccgggtgttctacagaacatgttaaattgtgaaaagtagtggtgaggctaatgcctgtatactaaaggaagagatcaacttcttgttcatcaggttgaggacagtgggagaaggtgaattctttactggggaagacgtggggatgttggtacctgaggggagaaccttagttcagtaaagacaaaaaagttaggtgatagaattagataaacccagctgaaggagtgtgggcaaattgtgtaacttctctaaacctcaattttattatcagtaaaactgtgccaacctcatagttcagtataaggatttaaaaaaatatatgtaaagcatttagaacaatgcctggaatatgaataagcactataatattcaaactattcctattaaaatagagaaataataggtctcacagtatccactgagatttgggttctagtaggagtgaattggaaactttgagacaaaattatttatgtaataccaatttttttttttttttgataccaagtctcactctgtcgcccaagctggagtgcagtggcacgatcttggctcactgcaacctctgccttctgggttcaagtgattctcctgcctcagcctcctgagtatctgggactacaggagcgtgccaccatgcctggctaattttttgtatttttagtagagatggggtttcactgtgttagccaggatggtctcgatctcctggtcttgtgatccacctgccttggcctaccaaagtgctgggattacaggtttgagccaccgtgcctggccctccaatgtgttttttttaaatctgttaattgatcttctctttttatgcatctggatttttagttttaacaatcctatctttataacaagattaagtaatttgcctgtattttcttctaatatttctgtggtttcattttttttacatatagatttatggtctatttggaatttacttatgtataaaatgtcaggtatagatcaacttttatatttttttccagaaggccatccagttatttcaccaccatttagtctgtctttttgctactgctttgaattgctacctttatcattgaagtttttttgtgcttagatctgtttctagctgttctgttccattggtcttttttttttttatgtacaaataacgtgattttttaaatagaggtttttgtttgtgtgtgtgtgtgtgtgagacagagtcttgctctgtcacccaagctagagtgcagtggtgtgatcttgggttgctgcaacctctgcttttcaggttcatgcagttctcctacgtcagcttcccaagtagctgggattacaggcctgtgccatcatgactggctaattgtttttttgtattttaagtagagacagggtttcaccatattggccagtctggtctagaactcctgatctcaggtgatccacccgccttggcctcccaaagtgctgggattacaggcatgagccaccgtgcccggccttaattagaggttttgttggtgtttcaatatgtggtggggctgttcccctctcattcctcttctttttcagggttaaactcagcttgcctagctccagaaaacaaactggtttgttttttggtggaattgtactacgtttatcaatttacttaggaataattgaatctttgtgatgagttaggctgttgaagtttgaagtattattttgtgtctttcaaccatatttaaaacttttcctcatatagattttttacatttcaggccaaattgattcctaaattattatatcttttttattatggaattctaaatggggttttctcttccattattttcttttttgtttatctgtatatattaaggatattgatattttaaattgtggtaaaatatgcatgacataacatttaccattttgatccttttaaagtatacagttcagtggcattaagtgtgttcacagtattgcacaaccatcaccactatttagctcgtgaacttttcatcactccaaacagaaaccctgaactcgttaagcagtcactccttattccttcttctcctcagcctctggtgaccaaaaatgtgttttctgtgtctataaattttcctagtgtgtatattttgtataaatggagtcatacaaatgtggccttttgtgtctggtttctttctcttagcgtaatttttcaatttatgttgtaccatgtattagtacttcattcctttttatggctgaataatattctgttgtgtggatataccacattttgtttattcattcatcctctgttaggcatttgtgtttttcctaccttttggctattgtgaataatgttgctgtgaacaagaagctattgatttttttgtatgttaatttaatatattttaaccttactgacttttttttcctgtttgaattctgtcattggatcttttgctatttctagatttatgatcaaattttctacaaatggagatagttttacttcttctttgccaattcttatgtctctacttgctttttgttgcctagttgtactggctaataacacaccaaatacaatgttaaatactagtggagatagtgggtgttcttgcattgctccggaacttggtaaaaaatgctttaggtttttctccattattaagatactgactttaggatacagtgtctctatctctacctgtatctacatgcacaatttttattgtaattttatgtgtaatttttgttgaaaacacttttgcctgagacactgaggttcacttttattttcacttatctaagtgttgctagtttgcctcttgtattttctaggttttctgtaattttcttttttttctctaattgaacagatgaaattgattttgaagagaatatggaatcaacctttgtgatgtccatttgttcccctcatcctactcccaactgctgcaactctactgctaaccctggctatctttattatgtttctgattctcacatccctttactaagaatagggacagttccaggattttatggcttctcatacctctctagataaagttaagtttcttagtgtagcacataaggtactcagtcctctgttatctgtgtacttttcaaatttccatcctttctctcatttcttcaggtattctgaattatttgcatccttagagcatacgatgctgttttctgcctcttccttttcctcatgctagtcttcctgctttaatatagctataagccaagtgtcaagttttatttttccttgaagtgtgcctgctttaagagggttgtcgcacatcctcttgcaagcagtctgcgtagctactgcttctcagagttccttgcttcttttagcactccctgtgggccaccacttgctttactaatggtctttatgtggagttctgggacatagtcccattgatagaatatggctgccaaagtttaagtgcccttttgtactcctctggcaacctggaatatctctatcatagcattataccatgctagttgatttacttgtctcttttccgagtacatgtgatttagtaactaatcaatacttttttttttcttttttaatagaaacagggtcttgcactgtcacctaggctggtctcaaattcctggactaaagagatcctcccaccttcaccctcttgagtagctagaactatacacataccaccctacttggctgatatttttaaattttttttttgtagagacagggtcttagtctgttgcccaggttggtcctaaactcctgccctcaagtgatcctctcaccttggcctccaaaagtgctgggattataggtgtgagcccttatgcctggccccaataaatgtttattgaataataagtgaatagtaaaggaaactgggatctgttaccttctttttttttttttttttttttttttttttttttttttttttttttgagacagcgtcttgccctgttacccaggctggagtgcagtggcataatcatggctcactgcagcctcaacctcctggattcaattgattctctgacctcagcctcccgagtagctgtaactataggtgtacaccactattcctgtcttaattttttttattttttatttgtggagatggggtcttgctatgttgcccaggatggtctcaaactcttgagctcaagcaatcctcttgcctcagcctcccaaacactgggattacaggcgtgagccattttgcctgtcccttcttaattttactctttctttcaagattccttactgattaggttaagatttcatagagagagccaatttattttctagtgattaattgtggttcttacagttaaatttctttttatttcaaattaagttttggattgtaagcaacttgattaggcaaaaaggagcagagggctgctgaggcccagctcacaattagtatttcctgtcaccactggagatgcactgtgtatagctttctgtcatggggaggtaagacagaaactgaaattaagtgagtatccttgagagacagtgccttctcatgcagtaaatggtagaccatgctatttgttatatcattgattgaaccggttgcttattttggtaaaaagtaaagtcttttttacatctaggaaaccctctattggcagtgtcatttctgtttaaaagtagaaatgaagaattagtgaggagtggaagaagagaaattatacagagaaagcatatttttcttttctaaatttgtgtgtttatgtataagtctacaggaaatatatgaaatagtcttaaatttatgtgttctactttacataaagcttctatgtgagaggatttaaaaatcaatgtgcacattcagatctaagctgtttggctcactgttgccatgtctatcttatttatattttggatattttagcacatgtatcttttaaagaggaagaagtggttgtcagcaaaagtttgttttctttgagtaaagggaaattaatataatgcctgtttgtttcatgatcaaatatattttttgacttcttccatagaaatttcaagaaattgctgaaaaaaacatggaaaaattgaaccatattgagaagtcacatgaacagttggttcttgaaaattcgcacttcaaaaaactgttatcacagactcaaagggaacagatgtccttgctggcagcctgtgcattaatggctggtgccttatatcccctctatagccgatcatgcgccttgtctacacagagagattttctccaggagcaggtcaacacctttgagttgttcaaactggaaattagaactctagcccaggctttgtcaactgtagaggaaaagaagcaagaggaagccaagatgaaaaagaaaacattcaaaggattgatacgtatatttcggaaaggtgttattgctgttttggcagcaaacagactcaagattttgggccaatcatgtgcctctctttttacctggatggagagtttcaaagaaggcataggcatgttagtgtgcacaggagagccccaagacaagcataaatttccaagtaagataatttctgcttttaaaaatataagttgcatgtaagcgaaatacagtgtgactatacctggctattatggaaaaactcttaaaaaatcatgtaatatgccaaataatataacatagtctccatatgtacgtatatgtgtgtatggataagtgaatatttttgtataaattaggctgtgattttttgttttaaacaggttaaaatattaggtggcaaatatatataatttcaactttgtcttgttttagatttgaatcctctgcagtaaagtggagagtttatacagtgatttttcagttatgtcaatcaaaaactgccctgtttcaaattaccagtataatttattttcagtttctatgaataagtatgaaatgggttaaaaatatattgaagaattgtgtgaaaatgagacaaatgtaaattttccagttgtgttttgaatgcataactattttgaagaaacaatttgttttaatttttaaaaagcagactattaagtaatataagtaaaactaaagaaaatttgtttttttctgtttatttggtgtcatttacagttatttgtaaattaggtcaagctaatctaacatttaatagatttttccacattaggcaatgttcacaatagggttttatctgtttcttaaatagctgaacactgctacgaattttaaatatagattttaataaagttttgtagaattttacaatggattttttcaattttatagaacatcaaaaggagcagttgcgttgtttacaagcgctcagttggctcaccagttctgaccttcttgctgcaataatcagttctatggctgaattacaagacgtcattggtaaagcaggtatggttccttcttttatgtccttgcaaaatacatttaagaacaaatatccagaaattctttatgtcacaaattctaataaaacatatagggggaaatatatttgtttttatctttattttattcagtcatagagagattgttaactctgtacttaatgatgtaaattaatataaattttgtctctatttatggggaaatgacatttcttggtgaatgtatccaccttttctttttttctatctgtttttcctatggaaagctcatcatcagctttttattaagtaatactggcaatgttttttcatatgttttggccttatttcacttctacttctggctgtaaatttcataagcttgagtaatatgagagccagtagaaaatttttatctctcgttttgtgatatatttttttactttttctagtttattttagatggaattaatttggatagtctgctcctttccacctggtgtggaaccacctattatcagcaatttacaaaagtttaaaatgcaagtttttttttatgattcggattgcatgatattttgtctgacaggttcaatgaaaactaattggactaattatggtcatttcagacacattaattgttaaaattgtgtaatggacttaagatttgtctgtttaatgaaatgtaagcctatatgtaatgataatttgggatttaattcttagacaattccactgtgcaaatatagattattcattgtgatttcaaatatctaaacctagacttttgtagtaggaaacttaaagattatttttaagttgtggccatcgatgttggtaagcaatgcgcatatttaatgtattggcagaacctcaagatactgggtttgaagtctgaaataaaagtctaaactaaatgtattttaagaattttggtattataacttcaaagcaaaactgaacattcttgaaagagcttagaaatagtttttagatttggtttaagaaacaggcgatttgagtgcttccaagatggccaaataggaacagctccggtctgcaactccagcaagattgatgcagaagacgggtgatttctacatttccaactgaggtaccttgttcatctcactgagactggttggacagtgggtgcagcccacggagggtgagctgaagcagggcggggtgtcacctcacctgggaagcacaaggggtcaggggattttcgtttcctagccaagggaagctgtgagagactgtactgggaggaatggtacacttctgctcaaatactcagcttttcccacagtcttcacaactggcagagcaggatattctctccagtgactggctcggcgggtcccatgcccacagagcccagcaagctaaaatccattggcttgaaatccttgctgctagtgcagcagtctgagaatgacctgggatgctggagcttggcggggggagggcgtctgccattgccaaggcttgagtaggtggttttatgctcacagtgtaaaccaagttgccgggaagctcaaactgggcggagcctaccgcagctcagcaaggctgactgcttctctagattccagctctgtggatggggcatatctgatcaaaaggcagcagcctcattcagggacttatagataaaaccctcatcttcctgggacagagcccctgggggaaggggcagctgtgggcacagcttctgcagacttaaacattcccctgcctgacagctctgaagagagcagtggttctcccagcatggtgttcaagctcgaataacgggcagactgcatcctcaagtgggtccctgaccctcgtgtagcctgactgggagacacctcccagtaggggccaacagacacctcttacaggagagctctggctggcatctggcaggtgcccctctgggacgaagcttccagaggaaggatcaggcagcaatacttgctgttttgcagcctccgctggtgatacctaggcacacagggtctggactggacgtccagcaaactccaacagatctgcagctgaggagcctgttagaaggaaaactaacagacagaaaggaatagcatcaacatcaacaaaaaggacatccacaccaaaacctcatctgtaagtcaccaacatcaaagaccaaagatagataaaaccacaaaatggggagaaaccagagcagaaaggctgcaaattccaaaaaccagaacacatcttctcctctaaaggatcacaactcctcaccagcaagggaacaaaattagactgagaatgactttgacgagttgacagaagtaggcttcagaagatgagtaataacaaacttctccgagctaaaggagcatgttctaacccactgcaaggaagctaaaaaccttgaaaaaaggttagacgagtgactaactagaataaccagtgtagagaagaacataaatgaccatcatgttgaagctgccaggcttcaaatgcattactctgagcaagtgacttaacctctctgggcctcaattttctgatgcagctgaaaaacacagcatgagaaattcatgaagcatacacaagcttcagcagcagatttgatcaagcggaagaaagtatatccgtgattgaagatcaaactaatgaaataaaacgagaagacaagattagagaaaaaggagtaaaaaaaatgaacaaagcctccaagaaataggggattatgtgaaaagaccaaatctgtgtttgattggtgtatctgaaagtgacgaggagagtggaaccaagttagaaaacgcttttcaggatattatcgaggagaacttcccaaacatagcaaggcaggccaacattcaatttcaggaagtacagagaacaccacaaagatattcctcgagatgagcaaccccaagacacataatcgatagattcaccaaagttgaaatgaaggaaaaaatgttaaggacagccagagagaaaggtcgggttacccacaaagggaagcccatcagactaacagcggatctcttagcagaaaccctacagccagaagagagtggggggccaatattcaacattcttaaagaaaagaattttcaactcagaatttcatatccagccaaactatgcttcttaagtgaaggagaaataaaatcctttacagacaagcaaatgctgagagattttgtcaccaccaggcctgccttacaagagctcctgaaggaagcactaaacatggaaaggaacaactggtaccagccactgcaaaaacatgccaaattgttaagatgctatgaagaaactgcatcaagtaacgggcaaaataaccagctaacatcataatgacaggatcaaattcacatataacaatattaaccttaaatgtaaatgggctaaaggctccagttgaaagattcagactggtaaattggataaagagtcaagacccattggtgtgctgtattcaggagacccatctcacacgcagagatgcacataggctcaaaataaagggatggaggaagatctaccaagcaaatggaaagcaaaaaaaaaaaaagcaggtgttgctattctagtctctgatacaacagactttaaaccaacaaagatcgaaagagacaaagaaggccattacataatggtaaagggatcaattcaacaagaagagctaactatcctaaatatatatgcacccaatacaggagcacccagattcataaagcaagttcttagagacctacaaagagacttagactcccacacaataataatgggagactttaacactccactgtcaacattagacagatcaacgagacagaaaattaacagggatagccaggacttgaactgagctctggaccaagcggacctaatagacatctacagaactctccaccccaaatcaaaggaataaacattcttctcagcaccacatcacacttattctaaaattgaccacataattcgaagtaaaacactcctcagcaaaagtaaaagaacagaaatcacaacaaactgtctctcagaccacactgcaatcaaactagaactcaggattaagaaactcactctaaaccgctcaactacatggaaactgaacaacctgctcctgaatgactactgggtaaataacaaaatgaaggcagaaataaagatgttctttgaaaccaatgagaacaaagacacaacataccagaatctctgggacacatttaaagcagtgtgtagaggggaatttatagtactaaatgcccacaagagaaagcaggaaagatcaaaatcaacaccctaacatcacaattaaaagaactagagaagcaagagcacacagattcaaaagctagcagaagacaagaaatgactatgatcagagcagaactgaaggagatagagacacaaaaaaaccctttaaaaaaaatcagtgaatccaggagctgtttttttttttaaaagatcaacaaaatagactgctagcaagactaataagaaagagagaagaatcaaatagatgcaataaaaaatgacaaaggggatatcaccactgatcccatacaaatacagactaccatcagagaatgctataaagacctctacataaataaactagaaaatctagaagaaatgtataaattcctggacacatacaccctcccaagactaaaccaggaagaagtcgaatctctgaatagaccaataacaggttctgaaattgaggcaataattaatagcctactcaccaaaaaaagcccaggaccagatgtattcacagccgaattctaccagaggtacaaagaggagctggtaccattccttctgaaactacccaatcaatagaaaaagagaatcctccctaactccttttatgaggccagcatcatcctgataccaaagcctggcagaaatgcaacaaaaaaagagaattttaggctaatatccctggtgaacattgatgcaaaaatcctcaataaaatactggcaaaccgaatccagcagcacatcaaaaatgcaaggctggttcaacatgtgcaaattaataaacataatccatcacagaaacagaaccaaccacaaaaaccacatgattatctcaatggatgcagaaaaggccttcgacaaaattcaacagcccttcatgctaaaaactctcaataaactaggtattgatggaacgtatctcataataataagagctgtttatgacaaacccacagccaatatcatactgaatgggcaaaagctggaagcattccctttgaaaaacggcacaagacaaggatgctctctctcaccactcctattcaacacagtattggaagttctggccaggacaatcaggcaagagaaagaaagggtattcagttaggaaaagaggaaatcaaatggtctctgttggcaggtgagatgattgtatatttagaaaaccccatcgtctcagcccaaaatctccttaagctgataagcaacttcagcaaagtctcaggatacaaaatcaatgtgcaaaaatcacaggcattcctatacaccagtaacagtccaacagagagccaaatcatgagtgatctcccatgcacttccagttgctacaaagagaataaaatacctaggaatccaacttacaagggatgtgaaggacctcttcaaggagaactacaaaccactgctcaacgaaataaaagaggtcacaaatggcagaacattccatgctcatggataggaagaatcaatatcgtgaaaatggccatactgcccaaaataatttatagattcagtgctatcctcatcaagctgccgctgactttcttcacagaattggaaaaaactactttaaatttcatacggaaccaagaagagcccgcatagccaagacaatcctaagcaaaaagagcaaagctggaggtgtcaggctgcctgacttcaaaacagtaatcaaaacagcatggtactggtaccaaaacagatatatagaccaatgcaacagaacagaggcctcagaaataacaccacacatctacaaccatctggtctttgacaagcctgacaaaaacaagcaatggggaaagcattccctatttaataagtgtgctgggaaaactggctagtcatatgtagaaagctgaaactggatcccttccttacgccttatacaaaaattaactcaagatggactaaagacttaaatgtaagacctaaaaccataaaaacgctagaagaaaacctgggcagtaccattcaggacattggcatgggcaaagacttcatgactataacaccaaaagcaatggcaacaaaagctaaaatagacaaatggaatctaattaaactgaggagcttctgcacagcagaagaaactatcatgagagtgaacaggcaacctaccgaatgggagaaaatttttgcaatttatccatctgacaaagggctaatatccagaatctacaaagaacttaaacaaatttacaagaaaaaaacaaccccatcaaaaagtgggcaaaggatatgaacagacacttctcaaaagaggacatttatacaaccaacaaacatgaaaaaatgctcatcatcactggtcatcagagaaatgcgaatcaaaaccacaacgagttaccatcgcacaccagttagaatggcgatcatgaaaaagtcaggaaacaacagatgctggagaggatgtggagaaataggtacgctgttacactgttggtgggagtgtaaattcaaccattgtagaagacagtttggcaattcctcaaggatctagaactagaaataccatttgacccaagcaattccacttactggtatatactgaaaggattgtaaatcatgctactataaagacacatgcacacatatgtttattgcggcaccatagcaaagacttggaaccgacctaatgtccatcaataatagactggataaagaaaatgtggcatatgtacaccatggaatactatgcagccacaaaaaggatgagttcatgtcctttgcagggtcatggatgaaggtggaaaccatcattctcagcaaactatcacaaggacagaaaaccaaacagcgcatgttctcactcataagtgggagttgaacagtgagaacacacggacacagggaggagaacatcacacaccagggcttgtcgggggtgtgggctgggagagggatagcattaggagaaatacctaatgtaaatgatgaattgatgggtgcagcaaaccaacatggctcatatatacctatataacaaacctgcacattgtgtacatgtaccccagaacttaaagtacatatataaaaaaagaaaaaggtgatttatgttactaatattctttgtaagtatgacgcttaaaagtagattggtttcttaagctatcttcttgtttatgttattaatttatttaatgtattttttcttgtcactgtgttatgtatatattctaggagataaaataaaaatgtgtgaattggtctgacgctaatacgcacagttgttagagaacaataatgacaactcatgagcgacttcaagcagaatgtaattaagggtgagatgaagagatacaggcttttaatgctacaagaatctacagaaggtgctgctcattgtgggcttatgagtatagggaagacttcagggaggagcttgtgatttagctagacttagaatgatggcaagttagagaggagagatggcattcagatgaagggcatggttaagcagagatgcagttgtgggaataaacatagaatggaaggaacagacattaaaaggatgagattgaaaatccgtgcctagcagacctggcctatagatagtgattaataaaggatattttccattattcatatcggaagagagatgtatcattggcatggggtcaaattacagaggttttataaaactaggcagtaatttcctctgagcacattacaaaagtggccccttacaacactttcaatgttaaaatattgacacaataattaagaccctgataaagatatgcataggtaagatttatcaagtagaaggtggtgtctttacatgcttgcctaagtctaggagcagaggtgcctttgatattagatctggctgtgcctcttacagctagaggaaatagcaggttcaggaaaacttttttttagggtaagttttaagtgtttgttcgctaagaaacacgactttgagaagagtaagtgattgttaattaaagcaagagaattattgatgtatcacagtcatgaggaatattggaaggaatatggtccatacaggtagataaaggaatattattggactgacacaaaattatcagtgtggaccctctctggatataacttgaccatctgagcttttagaataatttcttcaaacatgatgaggggtttgtttatataatatttttccagggtcatgtgttttcattttaagttatatttttgtagtagaaatttcaggtattttgacagaaaggatgggaacatattttcagaaagttaaagcgtatgagtagttatgaagagagaataatgacagtaataaatataaaaccataagagcttatatagtcatgtggagtttccaatttagcatatgaataacctaaacaggtaaacattattgtatggtagagagagcattagctttaaacaaagcggatttgattttgtatccaaatgtagttatcagttatctagttatcagttgtgtgaaactgggcacgttatttaactttactgggtctcagattctttgcctataaatgaagatattatcttcctcctggatgttccaaggatttagtgagataatactttttgagcattgtgtataatacctggcagttggtgggtggtaaaaaaatagttgtcaccttattactcatctcactgtgaatgtagagtataacataaatgagcacacatgcgcatacacacacacacccctttatacattttcaggctactaattattaatcttctatcctaaaattgctaagctgctctacaggggaggcaatactttagggttaagcaggaattctgcctgactttgaatactggttctgacactagctgtgtgaccttgggcaagttatttaaatcctgtgtgcatcaatttgtttatatataaaatggggaaagtagttttacctatctcatagagttatttagaagactaaatgaatacatttttaaagtgcttagaagagtctttgattactggtttgcttgctttgcttagttcatatattggtcattattaatatttattgcattaacagaataataaatagattttgtaaaaaataaggtcaaatgaaaatacattggttgatcttagaatttcaaggtaatttaaatgttatatgtagctataaattttaaaaagatggttctgttataaattagtatataaagatcaaggagaagtttattctctgaataggatgacattgtatgtttgaaagaggtttgccttctttgtaattattggatgaccctacttaaaataccttaatcaaataggaatttttcctcccagataataggaagtctagaggtaagtagaaatctagactggttctttcttctctgctgtccttaacgtgttcatgtttgtgcctcttagttttaagctggctactctactttcaggcattaggattgtgtttttgcaagaaggaaaagggaagggcaaaatgtgaaggcattcgtacattgttggtaggaatgaaaaggatacagatgctttggaaaagagtctggaagttcattaaaaagttaagcatagagttatcatatgagctagcaattcactcctaggaatgtatccaagagaaagagaaaggaaaacatacattcatacaaacacaaaccaattcaagtgtttgtgaattggatacatttgcaaatgttcatagcatcagtacgcgtgagtcaaaaagtgaaaagaaaacccagatgtctatcaactgattaatggatagatatctaaatgatgaaatattattagttcataaaaaggaataaagtactgctacatgctataatgtgaatgatccctgaagacattatgtagtgaaagaggatggtgacaaaagatcacatattgcatgattccatttatttgaaatgtccagagtagacacatctagagatagaaagtagattagtgattgcccaaggctggagtgagggttaagggagtatgggaagtgactgctaatggatatagagtttcttttggggttgataaaaatgttttaaaattggttgtggttatagttgcacaactctgtgagtatactacaaaacattgatttgtatactttaaatgggcaaactgtatgatgtttaattatatctctagaaagctgttacagatgtgaagagatgtggctgctgaatatattcctttatgtcaggaaggcaaaagctttcccataagcttacccagcagttttctcttcttgtttcattgacttgaacctgaatcacatggttattcctggctggctagctagaaggtggcaacagagaagggatattttgtagatggatccactaatcaacaaactcaacatagagaggatttactttctaaaaagcaaatatcatttattacctccacatctactgccccaccctaccattacaaaggaaaactggtcaattcagaaaacttgaaaaaaatgaattagaaaagaataaaaataacagaaacaaaaaatatttttctatcagctcacacaagaatggttactgttattttttcttttttaataatttcaacttttattttagatcagggaatacatgtgcaaatttgttatgtgggtatattgtgtgatgctgaggtttggggtacgaatgattctgtcacccaggtagtgagcatagtacccagtaggcagtttttcagcccttacccacctctttcactccctactctagtagtccccagtgtctgttcccatctttttgtccatgtatacccaatgcttagctcccacttataagtaaaaacatgcggtatttgcttttctgttcctgtgttaatttgcttaggataatggctaataatggtttggctctatgtccccacccaaatctcatcctgaactgtactcccataattccggcatgttgtgggagagacctggtgggagataatttaatcatgggggtggtttcccacatactgttctcatggcagtgaataggtcttaacaagatctgatggtttgataaggggaaacacattctgcttcattctccttctctttctttctgccaccatgtgagatgtgcctttcaccttccactgtaattgtgaggcctcctcagccatgtggaactataaatccaataaacctctttcttttgtaaattgctcagtctcgggtatgtctttatcagcagtgtgaaaatggactaactaatacagtaaattggtaccagtagagtggggcgttgctgaaaagatacctgaaaatgtggaaagatacctgaaaatgtttaagcgactttggaactgggtaacaggcagaggttgaaacagtttggagggctcagaagaagacacgaaaatgtgggaaaatttggaacttcttagagacttactgaatggctttgcccaaaagtctgatagatatatggacaataaggtccaggctgaggtggtctcagatggagatgaggaacttgtagggtattggagcagaggtgactcttgttatgttttagcaaatagactggcggtgttttgcccctgccctagagatttgtggaactttgaacttgagggagatgatttaaggtatctggtggaagaaatttctaagcagcaaaagaggtgacttgggtactgttaaaggcatttagttttataagagaagcagagcataaaagttcagagaatgtgcagcctgacaatgtggtagacagaaaaaccaattttctgaggagaaattcaagtgggctgcggaaatttgcttaagtaacaattagctgaatctccaagacaatggggaaatgtctccaggtcacgtcagaggtcttcacggaagcccttcccatcacaggcccagagtcttaggagaaaatggtttcattgtccagtcccagggtcccccgtgctgtggtcagcctaggggcttgatgccctgcgtcccagctgctccagctgtggggctgaaaggggccaacgtagagcttggtccatggcttcagaggtgcaagccccaagccttggcaacttccacatggtgttgagcctacgagtgaacagaagtcaagaattagggtttgggaacctctgcctagatttcagaagatgtatggaaatgccaggatgcccaggcagaagtttgctacaggggtggggctcttatagagaacctctgctagggtggtgtggaagggaaatgtggggtaggagcccccacacagagtccctactggggcatctgcctagtggagctgtgagaagagggccaccatcctccagaccccagaatggtagatccactgacagctcgcactgttcacttggaaaagccacagacactcaatgccagcccttgaaaacagctggaggaaggctgtaccttgcaaagacacaggggtggagctgcccaagaccatgggaacccacttcttgcatcagcatgacctggatatgagacctggagtcaaaggagatcattttggagctttaacgtttcactgccctgctggattttggacttgcgtggggcctgtagcccctttgttttggccaattcctcccatttggaatggctgtatttacccaatgcctgtacctccactgtatctaggaagtaactaacttgcttttgattttacaggctcataggtggaagggacttgccttgtctcagatgagactttggactgtggacttttgagttaatgccgaaatgagttaagactttgggggatggttgggaaggcatgattgattttgaaatgtgaggacatgagatgtgggagggagtcagggtggaatgatatggattggctgtgtccccacccaaatctctgaattgtactcccatatttcccatgtgttgtgggagggacccagtgggagataattgaatcatggggttagtttccctcttactgttctcgtggtagtgaataagtctcacaaggtttgatagtttgataaggggaagcctgttttgcttgagtctcattttctctcttgccactgccatgtgagatacgcctttcatcttccaccatgattgtgaggcttccccagccatgtggaactataagtgcaataaacctctttcttttgtaaattgcccagtctcgggtatgtctttatcagcagtgtgaaaacagactaatacagtggcctccagctgcatccatgtcgctgcaaaggatatgatttcattctttttcattgctgtgtattaggaatagttactgttaacatttgaatatgttcttccaatgtatttcgtctccctccctccctctctccagccttcctcctttcctcctatccatccactaatagactaacaagtgatattgataatatcatagagtacataggtttatatcttcatttaaaatgtgatataaaacttacagaaaagtggcaagtacataacaaagaacttttctttttgctgaacagtttgagagcaggttgatagtatgatgctgtgtcactccctcttgttttagtatgcatttcaaagactgcatattttagtgtgtatttcacagttgcattctggttattctcctgtataaccagaatgcaactgtcaacatcaggaaatcaacatggatacattactgtcattcagatcccattaaactttccctagttgtcccgactatgttctttatatagcagaaggatctagtttagaattatgtgttgcatttagtcatgtttttttagtctccagtatggaagagttcctcagtcttttcttgcccatgatcttggccttcttgaagattgcaggctagttatttgtagaatatcccttagttttgatttgtctgatgtttcctcatgattagattcagcttgtgcatcttttgcaagaaaactcacagaagtgacactgtactttgcttatgatacagtgtcataacttcatttttaaaaaagctttactttttgagggtttttccatttctattaatattcttttagagaatgatttttaatttctgagtaatatttaattatttgtatattccataatttaactgattcatagtaggatattttcatcataggacaggtagcaggaatatcagtttagctttgatttgtaattgactcattgtcctttgaatcatgttaaattatgagcagtatcttaattattttagccaagtaggaaatagaaatgacagaatcttggggaaatctatttagtaagtattctgaaaattctgaagtgaaagaagatgtttgttatgaggcagaagtatgtttttatctttttgtacttcttgttttttgtttttgagaacttgctaaaaatttaagccattttaaatattgggattacaaattaatagcatcactgaccccttttcttcttagccccaggaaaactgtggtgcatgtatgccagtactaagcttttaataataactgtatggcttttcatattatctttgttctaaggtaaaaaacattcagtctttttaaagagtaggtttttatctatttagagtaagttctgaattatatgcatactattaattaggaaagaaaatttactgtaaaacgtgttggatatacattaaagtattggttaagaacttggactctagatttgaatctgggtaccgttgcttactatttgtgtgttattgggcaaattacttaatctcatttcagcctcagtatcctaatctgtaaaatttggctaataaaatttcctagcttttctttacattaagaagaaatgtaacctgcctagtgtttgtaaatgtcctgtaaatattcattgttttatttctttcttgtgcactgatgtcttaatgggacctgcatattactttttaccttttcatgaaacaggaggttcaataacaatagcttgaattcaatgcgtagaaagtgctaaaggtggctgccccagctaccttcctaaactttgatgatgaacttatagagagtgggcaaagaccccagttttcatgttgcctctgtaaatactggacaggtggcaaccttcttgctttcattatagtgtttgcccacttgagataaattacctcttctcggtatccaaatggtgtgcctgcaagagatcatttacctcaaacaggggagaatgttacttccactgaagggttaggatatcaatcatgatgggaatggactaaagaattctttagatagctgaactttttgatatgactggtcgagactaaaattctcaagatagaaacaaatgtgctgatttgctttgaaatatctctgaacaaacacaggagtagatggacataagtagaatgttaacacattttgtcacacatttcctgtgtaattacgtcttaattgtctagaagatagatgacccaaatatacccctgctagtacaactcagaacttttttttattgcgtactttgagttaactttctagaggtcatagcgaccctttcaagcaaactaagcctaggttgtgttcaactcaacattgaggtttcatactaaggaagttcaaagtggtaagaaaagatactggtattgataagcagctattggcatatatttaaaagtgctgaggctttattgaatcttaaaaaaattataaaaagaatcttgctactccaagtgtggtccatggaccaagggcattgtcatcaactgggaatgtgatacaaatgcataatctcagactccactccagacctaatgtgcattttaacaagatcctcaggtgactaatatgcacagtaaagtttgagaagagacttaggggattttattattttgttatttttattttgttatttaaaaaaaattttttgtgtatgggattttgttatttatataacttcactcatatctggaacggaaacaagcacaatctgactgagtatcgtttctggtgcttcagctgctagtctctattttggggagccacaatttaacttacagatttttacaaattttgtgatttcttatattatcactttcacattttgccatattttttcaaacattttatgaaaaagtataagcatgtagaaaagtcaaaagagttttacagtgaacagatattttgtattttaaattgaaattttatttgcctatcaatttttaagagcaattttcaaatggataattcatccttgaaagtgttcacaactatgcaaaatcttactttcatgtcttttatagaatatattttataatgcagatctaaaataatatacaaaatcaaaataattttaggaagcatagatgaggcttgaacacattttgtagtttatgggtaatttctgggcaacttctaagagcctgaagctttttttttttttttttaagaaagctaagttggatatccagatactgtctaacaaagcaacatagttatcttttcaggtttttgtaaaagaacaaaaaaaatcttccttcaaatctgtactaaaatattacagatatatttagaaaaaatttttacctccttttccagaaaaaatatggcagcttataggtatttgcaaaatacaacataatattcattaaaacctaagcaggaaaaggagcaaattcaagccaggaatgacattgaaaaagtcaactatggtagcctacacacttgtgttcacattttggtctgaggattcagttgccaattatgttattaaagaaaaatcacaatttaggaaaaaatacaaatgttccttaggctaagagtagataggaaactgttctgcagctcttaataaaaagggatatcaagtgatagaatgaacaacattctcagtaatatcagacataggactttttcttttaagccaaatgtattgtgatacaatttacatgcaataaaatgtgcttatttgactataaaatttgactagttgtgaaaaatgtatacactagaatgtatacaagaaaatgtatagcacattcttttcacctgttttggagtcagtcacccctgctcctacctggtctaaggcaaccactggtgtcttctctgtccctttagttttttctgttcaagaatttcataaattttataaaaatggagtcatacagtgcaaaggagtgtagctgaactgcacaggtggagggaacagttcccaaaggctgtcctcacttctgacaccacaaattcaggggtccccagggccaccctcacttcaggctagctggctacaaattcgtggtccacatggattccttcaggttggacagttttctagaacaactcatagaactcaggaaactgttatatttaggattacagttttattataacagaaggaaacaaattagaatcagccaaaggaagagacacatagggtgaagtctgggatggctccaaatgcgaagcttctgttgtcctcaggatgtgttaccttcccaatattgaggtatgataatatgcatggagtatgaccaacccaggaagctcactggagttttgatgtccagagttcttaattgaagcttcattatataagcatgattgaatggatcatgctccacattgttgacctcaatatctagttcttttcctcttcttgaacattggggtgatatcatatgattcaaagccccaacttgctaatcatatggttggtgtttcaggcatggccagcccttatccagagttagcataaactatcagatgctcaacatgagtcatatcattacaaactatcaggtgtggtctggggccaccacgaatacaaaaaacactctaatcactccagaaatgccaaggttttagaggttatctcccaggagctgggaaaatggccagacttctccttaggtgaggccaaatttcttactacccatacaatatatattcttatatatctggattcatctgctcagcataatgtttttgagattcacctgtattacctgtgactgtagtttgttctttttcattgctgagtaatatttcattctatgattataccaaagtttgttcattcattaacttattgatgggcattagagttgtttctactttagagtattatgaataaatctgatgtgaatattcatatacatgtcttttgttggatgtatgtttttatttccttcgagtaggtactcaaaggcttggaattcttgggttgtaagcctgtgttttgcttgaaaaaatgagccatgcaaatatctgaggggaagcggtggtagttggggaaaggacattctaagcagaggaaactgaagtgcagaaaccctaacaaaggagtgtgcttgatatttttaggaatggcaaggaggcccaagtggctgaaccagagtcaatagtgggagaaaggtggaagatgatgtcagagagatagcaagggcagggttaacacctgcacccacattatgcaaatccttgtaaactatggtaagaactttagattttattcaggataagatgggataccatcggaaagttttgagtggaagaatgacaagatgtgatttaacgttttaaaagattatctctgacttctatcagtagttaaaggtgtaggtagtaagggtgcagtgttctaagatgaggaacaatggtagcttggaatagtataacatcattggacttggttattggctagagtctggaaatattttgaagatagagctgatagggtttgctgatgtatgttgaatgtgaggtgtgaaagaaagataggaatcaagaatggcttcaaggcttttgtcttgtgtaaatggtaaattgaagcaagagttactgaaatggggagattagagaaggaacaagtaggaagagaaaatcaagagtttttttgacatgttatgtctgagaaatatattagactcgtaagtgtcaaggaggtggctggatatctgaatttgagaaaaatgtcaagacagataaaattgtaagtgctctcagtataagtgttatttaaagtcatgctattggatgaagtcatgtagggtagtgattttaaccctggttgtacattagaattacctgtggagctttttaaaaatagtgaagcctgcattccacccagattttggctggggtgggacataactgctttggggagtgagtatagctagaagagctctgaggatttgtggacctttcaacatttagaggttaggaaatgagaaggatatagcaaaggattctgaagaatagccattgagctagttggtgaaccctgatggtaacctttaagccaaataaagtgttttacaagtaggagtgtaattaatcatgtggaatgctgctgctaaggtgaatatgatgagaattgaagaatcactccaaatttggcaagatagagataactgatgaccttgaagggactgttttgatggagtagttgagacaaagtccgactgcagtctgttaaagagaaagtgagttctgttaaagacagtttttatgaaaggcaagcaggtacattgagttggagcaggagcaatatttaggggtcaagggaggtttttgttttaagatgaggggtaattcaatgtgtttgtgtggtaaggggaatgattcaacgaatgaaagaaaaaaaaatcttgataatgagggaaggcacaattggcagatgtcaagtctctgagttgatgaaagggatgggatccaatgcacagaagtggggaggaaggttggcacaaacagttcaggcattgtaacaggagggaaggcagagtatatgggtacagttgcaggtaggttggtagatttggtagtagatgtatgtaaaaattattttctgcttgctactatttagtgaaataagcaagactatcaattgagatggaggaaggtgagaagatattggttatttgagaagcggagaaaatgagaaatagtcattcaggtgagtgggagattaagttcatcagatgatcagctgcttgggtgtcaggccataggaggtttttatttaatcagggtgggggtttgccaggtaaatacaatggaaagaaagagcagcaaggaacttgaaagtatatgcaagagtatagttataattgttgggagaaaattctccataggtcttgtgtttttgcatattttgtgagcagaggcactgacggctttcttatttatttatttattagctattttttcagggaagtttatgtaacgaacagcctcggaaaataaagacagtacctccctccagagcggaggacacgtttgtttactttccagtataatgaaaataatgtttcccttggggaaaagattgagcaggtttgttttcagcctattataaaagatttgggcttcctaagttctggattcctcagctatgacacaaacccattacatgcacagcattagcctaggtcactctgtgtcacctccatgggacttggggagcaagaggaactgtagtgcatatgaagctcctgctgtctcctgtgccgtgagtgttaaagtcccttgtctctcacccaggagtcttgtgttttttgccaacattcatgaaatttgttagcttgaaaataaggtgacctcgaactcctgggctcaagggatcctcctgcctcagcctcctgtgtagctgggattatagatgtataccaccatgcttggcttcaattttaatttatatatatgtatatatatttttattttagaaaattatgataggatagtaagttccatattgcaataaattaagtagcagaagggcaatggaaatatgagatattggagaaaacaaataaggcagaatttctgattgttaaggaagagcttgttcatgtattttaaaaatgtattatggtaagggccaactcttcctggcatttagattctcttagttacatttatttttattttattttatattttttgagataagggctctctgtctctgtcacccaggctggagtacagtggtgcaatcatagctcactgcagcttcaaatttctgggcccaagggatcctcctgcctgagcctcctgagtatctaggactacagatgtgtgctaccacactcagctgatttctaaggtttgttttttgtagagatgggagtcttactatgttgtccagactagtctcaaactcccggcctcaagcaatccttttgccttggcctcacaaagtactaggattacaggtgtgagccactgcacctggtttctactggttatatttaaaggagggatgtgtcagttttttttaaaaatgccaaaatttacagcataccaggaatgatatgctttacaactggttaaaaatacatgacgaaagtttttttagatgtaaacttaaaaatgtgtgagggcatacatatcaggttcctgttattgggctaacaaattgtcacaatctgtggctaaagaccacacgaatttattatcggatatttctggagatcagatgtctgaaataggtcttattgggccaaaatcaaggtgttggcagggctgtattccttccggaggctgtaagggtgaatctgattctttttgcagcttttagaagccatctgctttccttagtttatagctctttattccatcttcaaagccagcagcatcacatctgcaaatctctctctgactctgacctcttcttctgtgtaccactttaaaggactcttgtcattatgttgggtctacttgaataatccaagataatctttgtattttaaagtccactgattagcaaacttcattccatctacacccttaattctctctcgttgtgtaacataacacagtcacaggttccagggattagaatgtggacatctttagcgaggtcattattcttcctaccacagcatacatagttaaaaaaaattacagagtacattagtgaggacagttaaagaccactgtcctgcctttggtatttgacattgctgatcacttccttcttccagattcttttgatgcccatgatattactcctgtttctcctcttttcatgtccttgggcctttctgttcagtgtttgtgtgccctatgggctctttttcttttttcttttcttttctttccctccttcccttccctctttcctttcttggagtaggactttgactatgggtcttttcttagccattaaaaaaatttttttaatttttagtagagaaggggtttctccatgttgtccaggctggtcttgaactcctgagcttaggcagtgcacccacctcggtctcccaatgtgctagcattctaggggtgagccactgcgcccagccacttagctatgtttttattccttgttgtcccgagcagtcccatgtatagccagggctttatttaccatctatgtgctgatggctcccaaatattatctgtaacctagacctcattcttgaactgaaagcttgtatacttagcttcctatgagtttcctaaaaaaaaaaaaccctaaaattcagcatattcaaatttttacccattttcttaggcccaaaacttccttctgaaaactgtctttgtaattgacatgaccatctgccaaatagtatctaaaatagaaacctagcagtcactgtaacatacttttattcttactcttattctccatattctacatttcttattgggttatttttttatcccagccccattgctgtggtcttagctcattttttacatgtgttactaacctgctagtgggtatccacgagcccactcttagactgacccaccctttctccctgtctcccagccttccttcatttagcaaagtgatcatttggacgagagttattgaaataataaagaagtagcatcagtatattgtagaatattctaaaacatataaaagtatataaggaagtaaatttaaacctcatgtaatctccttattagagaatattagtatttaattagtatttatatcgagttgttttttggatatttcagtataatggggtcattctatagatacattattttaattattctttccccctcacttattattttaagtggttataataatgatatcatttcatggggttataatgatggttaaattggttaatgcatgtaagcagtgcttgatgtgtcacctatcttcatccgcagtatcagcagcaatattgttccttgtttcttattgcatgaattaacactttagctagataaacaacacccttcatgaccagattctcatctgtttgtacagtctcacctcccaatgctgtccataataaacctgcaatttaagccaatggaactgcttattattcttcagaagtgagatgctctcttatgtctccagacatatgagaaataacgtttcctggcactaaactttaaaaggaatttattacatggattattgtattagaaatattgaataacattgcagtttctgtctttaaatgcaatttcttagaagatgcagaagtttttttcttgtcagtaaaactgagagcatgatagtatattgtcattctctgactgaagtagtccagggatgtagctttcttgttaatttaagttgacagagagagagggtcaagaatatagatttatgattgggtagtatattccttaaataagggatctcttaaccaggggttcatagacctcttctcaaaagggtccatgggtagaattcagcagagctgggggaacggtctgtggacttgaatgagaaaaaaacatcttgtttcactatctgccaacagaattttgacagttccttcaattatgaatggtaacgatagaccatgataatattagcagcatagtgactttggcgctaatagaagtcacagatatttttatattgtaatacagttactgcagctatcacacatgtagtttatgctcatcttaactaatcagtaatcatgagagtcatcacttacatggcaagtcatcatagtctcccccgtaccaacggatgctggtgcagtgcagccggccaagtgaaaggacaactctgcatttagttgttcatccatcaaagtgaggttctgtgtactctttgtttatgttgcttttcagtattctctaaatacgaaattctctgttattttctttgaaatagcagccttaagcccttggaaagacttcagaactccttcaaaagagttactgaagttacttctatctaaatagcataaaatttgaaccatggattcatagttctttcctttccaatacaaattgcattgaatatgttgacctagccaaagatgaactcattgactttaggacaaaaaaacttaccacactagattttggatttaaaagccttggagaattctggtattttttgtgagaagccctccactatgttgtaaaacgaactatcgaagctttaattatatttgtagcagtaaatactatatttgtaaatcaggacttttatcacttttaaatatattaaaaaacttgatgtccaacatgacatgtatgatgccttgttgaagaccacccaaaaagttcaatgttcttatttggtttatgcaaaaactttcactatgctatgtcttctaaaaaactatctttatctatatttgaaatgtcctgtcttgtacttaatggattagtaatcaaacttaaaatattttgaaaactatattacagaaaaattagtttcctttgtaatcccacatctcttgatttatggatttaaaatgattattcttagaaggggagccataggttccaccagactgccaaaggtatctacagtacaaatgtatcatttgtctaaaatgataacagaagtatcatttgtctaaatcagaatatgtttctggatattcttatttgggggcatttgtataataataaataatacaatataaatgggagttattgattcttaatcagtgttacatgtcccctctctccattgtccaacacaattcccttatacatatgagctattctatagctagctgtttaatgaatgagtaaggtagtgagtaagatagtgcatggtgcttttaaaaatagttttgttatttctgtgaaaatgcttatacccagcgtaaaaccttcacacaatacagaaacctgcacagaaagtaaaaatcactcaaagggtcacctccaaccattcttaacattttgatgatctctacgagtatcccatacatgtgtacaaatataatcacacacacacagttttacatgagggaatcatataatcatgcttcattgtaattatttttactcccactcaatggataatgaatattttttaatatcaataaaataaatctatatcattaattgtatttagttacatactagttgcactgtatatatctactgtaatttactcagcaaatttccttttgatgagtatttattttttcttatttttttcgccattttaagcaatattgtaatcagccatactatagttaatatgcgtgtatataaaatcatcttatacttgtgcagttatttcttgggctaaattcatgagaaatgggattgtatattttacatttagaaagtactatcagtattctttacattgttctttcatgaacagtgttgaccgttctggttttctcataacacctttggcatgcaaaattttgataatctctttgacctttatcaatgtaaaaggcaaaagacattatattattacttatttgtattctttgattggtagttaggttgcacatcttttcatttgttataagcccattcatattctacaaatgatcatactatgatcatatttgggggtgtgtgtttgtgtcttatggaattataaaagctccttgtgtatcatgtatattaacactttatcatagtgcaaataattttgcagcttgtgttttaattttgcttgtgatatttttatatagtttaaaattattaatcatttatttctgttttttgttatggtaagttactgagaaaggctagccttacctcaaggtagtattgctcatattttagtagaatactttcgatacattaaatcttgagtttatctggaattatttttcctgtaaatagtgaataaatgattaaactatttttgcagccagatgaccaggtagcttttttggggggacgggcggggcagaggctgtctctgttgcccaggctggattgctatggccagtctcagttcactgcaacctctgcctcccgggttcaagtgattattgtgcctcagcctccggagtagctgggattacaggcatgtgccaccacattcagctaattttttgtatttttagtagtgacggggtttctctgtgttggccaggctggtctccaactcctgacctcaagtaatctgccagccttggccacccaaagtgctgggattacaggcataattcaccacgcctggcctgcaccagtatttttaaattctgtaatccatcttttccctgattaagatatgccattaataacacgttaaattattgtttaagttcgtggatcgatctatttcctgtatttccagtttactccattagtttccacctctcttctagtaccagtatcatactgcgtttttcatgaatgtatatctgtgtgttttacagtaagacaaattcgcttactacttttttttttgtcgttttctgggctgttttgcccagtgatttttagataaaacattgctttgaagcaaacatcttactatagtgtttgcctccacagtttgaaaaatgatgtctatattcacgtttctcaaattattagcagtttggaacacaagcataatttttactcagagggaatgctttaagattgtgatatattggggtcacttaaaaggagttgcatataaagaaagttgcatataaatagtgaaagatgttcctgtgaaagtaagtagggaccagatgtgtaggacttttgagccatgttttaaggagtttaaaatccattcttagatgagaagaaagttattgaggcataaaagcaggcagtgtgatgagatcctagttgtgtgttacgagttattctatctactttgtggagaatggattgaagagcgggaagactagagaagagtgcgtcttagatatggccatgactacagagaaaatggaataaattggagaaatactaagaacaagaaatgggaatatggcaagggaaatggagatgtcagggttgacaaaatgttaccaagtgtgtagaactgaggtggaattaaatttagttaacaatactcattattaatattattaaccttattattaacattactcattattacaatattagtaattatttttgctactattatactcattactaacattattttaaacgttactaattattaccttttttggttaaaggaatatttctcaatctttgagtatgaggacttcattttaataagaaaaaatgttgtagattgctctctcttccacataatagatgtattttgagtagcagttgatttatgtaatgttttcaagggacttttaatttgattactcacaatatcattattattcacgcatatattttgttagggctagataaagatcaaaatgcacaatggttactgcagctaaaagtagtggaactgttgcaataacttttcaatgtccttccttccccacctcatcaagatctgcagcccacagatttagaactacaggtcgaaacaattctttatgaatttgttttgaagattttagccctagatgtacatttttcccccttctattggaaaaagtaatttcagaatatagggttcacttctttcattaaagacacattttattaaataggaagaaagtgattaacaaatgtatttaacataagaatttgttaaatgtaacaagccaaacatttacaacagtctagacaagtatacatgaggaactttagtgacgtttttcctcttatttctgtattattatataaataattttacaactgtatcactagaggatttttttttgttttttcatttatttaatatagaatgaattgcactctgacccaaaagaaatgcaagaaaaacaaagataaatagagggggcataattaaactaaaaagcttctgcacagccaaagaaataagcagcagagttaatagacaacccacagagtgggagaaaaatcttcacaatctatacatccgacaaaggactaatatccagaatctacaaagaactcaaacaaatcagcaagaacaaaacaatctgattaggccaggtgcggtggctcacgcctgtaatcccagcactttgggaggctgaggtgggtggatcacttgaggtcaggatttcaagaccagtctggtcaacgtggtgaaaccctgtctctactaaaaatataaaaattagctgggtgtggtggtgggcatctgtaaccccagctactcgggaggctgaagtgagagaatcacttgaacccaggtggcataggttgcagtgacccgagatctcatcattgcactccagcctgggtgacagagcaagacgctgtctttaaaaaaaaaaaaaaaaaaaaaaaaaaaaaaagtcatcagaaagtaggctaaggacgtgaatagacaattctcaaaagatatgcaagtagccaataagcagatggaaaagtgctcaacatcactaagatcgggaaatgtaaatcaaaaccatgatgccattactgcctcactcctgcaagaatggccataataaaaaaaaataaaaaatcatagatgttggcatggatgcagtgaaaagggaacactttacactgtttgtgggaatgtaaactagtacaaccactatggaaaacagtgtggagattcattaaagaactaaaagtaaatctacagtttgatccagcagtctcactactacatatctactcagaggaaaagatgtcgttatacaaaaaagatacttgcacacgcatgttgatagcagtacaatttgcaattgcaaaagtgcggaaccagctcagatgcccatcaatcaacaagtgggtaaagaaaattggtatctatataccatggaatactactcagccacaaaaaggaacgaaataatggcatttgtagcaacctggattgaattggagaccattattctaagtgaagtaactcaggaatggaaaaccaaacatggtatgttctcactcatatgtgggagctaagctatgaggatgcaaaggcataagaatgatacattgtactttggggactcaggggaaagggtgaggggtgacgagggataaaagactacacattgggtgcagtgtacactgcttgggtgatgggtgcaccagaatttcggaaatcaccactaaaatatttattcatgtaaccaaacaccacctgttcctccaaaacctattgaaataaaaaaaattgccctctgtactgtataatgtgaactatattgtaaaaacacttcttattatagcatacattatttagtgctcttactgtaattcattgagagtcggcagttaggaacttagagcatatgactttcacttcttaaaaatttagaagaatgcattgcagaattatattgtcatttagtatcacccttcagatcagtcagtgtctacacaaacatttctgtgacaaagtaaaaaaccttatttgtttgtttatttatttattccttttttaagacagagtctcgctctgttgccctcccgagttcaagggattctcctgcctcagcctcctgagtagctgggattacaggcacgtgccaccacgcccggctaattttttgtatttttagtagagacaaggtttcactgttttagccaggatggtctcgatctcctgacctcgtgatctgcctgccttagcctcccaaagtgctgggattacaggagtgagccactgtgaccggcctatttattaaaatttaattacaattaatttgtgcttttaaaggctctttatctgtgaaaaatttttttgtatcctgaaatttcctaaaataatgaacttttgtattgtttatttaaaaacaagaacctttgacatagcttaagagttaacattaatttctcttagtattcttgtgttcagcattgttgcagtagctatggaaataaaaagaaatataatttaacaaacatgtaaaaaatacccatgtatgctgggctggcccagtgaagataaaaagagtttgttaagatgaaaaaagacacagataaataattgcaaggtagttggagaaacagggaatacatatatatattaggtattgaaatgataaattgaatattatagacaaaataaattttactgttctttcattcaacagtggcctatttaattcacatagtactttagtaaattcctttaactcagtgttctgtgttatatattgattgccatataaagctacttagttctttttcatccattgttttctttttatttatttatttattttgtattattattataaaaacatggaacgcttcacaaacttgcgtgtcatccttgcgcagggccatgctaatcttctctgtatcgttccaattttagtatatgtgctgccgaagcgagcacttcatccgttatttatttaaggaatatgattgttaacaaaaggactgtgtattttcattatactttgtcttttttccatgggactgtcacagagtatgtttataatgagtggcatatagaattaaacttatattaccgtatatttatattcctagaagttgatgcatcaataactgattgaaataaattttacctggaggatattatgcttttattcactttatttccaatttatgtataactcctaagcaagatcattttcaaattctggctgctacatagattttaaaatttgtctgtcctttaaacattgaggaataaaataagtagaatgaagctcaaattttataacagtgtctccatgagacagttctttatgccatagaaaaccattggttgattaccgtctcagtcaatgttgctcttcagttgttgaattatatgtattcttataaggataaaacatttttaatttggtaagactagctgaatttgctttttgtgcttatgatgtaaagacaagatttaaattaacaccaacagcagaggctcttaaaaatgtagaatgttatactatgaatttaaataatctttctgtgcttgtcattttacattgatagtatcataagacaagtaatgacagattaagacctacctagcagagggaaaactaaattacatggctttattaaggcgtaaataaacctattaaccattatctggaataccaattagtagaaagagcactgacaattttatttatcaacattaaacacaattattaattacagacctgatgaatctagcagtaagcaggccatgttggatatgctgggaccttaagtccattatatgagaaggatgattaccaaaatcctgtggggaaataagtaattgtagttgtaaaattttaattgccttggaataaggcaaattatattttcttgtctgagaatataaatagtatggcatgaaggtaacaagctttggcagttgtaaatagaaaatggatttatgttaggttttaaaacaaagaaaagagtgatgaatttttagtgtcatgctattccatgtgaatggcatactgtaaatacatgcagattttttttgatgtattctttagtaggtgagctattctctgaattcctttttttcatagtgaaaataatgtgggaaggacctttttgaatgaattactacaggtgaatgggaattatataattaaaaaatattttcattatgtgattagcagtgttgtgaaatgcacaagagacaattcacatttttgtgcctttttttctttttctttgaagatccaaattccagaatttgtggacatttactcataggtgcagccaagaattcttttgcaaaactcatggataaaattagtctggtaatggaatgtatacctctgcacagtagcaggagtattacatatgtagaaaaagattccctggttcagaggctggcccatggacttcataaagtaaacacactggccctgaaatatggtttgcgtggccatgtgcccattacggtatgtatacactttcatttagtagtaacctaagaacttgtaggtttaattttgaattagcctaatttgtagtttaaattattagttgtacatgaatgtatctggattttctttatagttcatgtaaaattttaatacactaaattacttccaaataagtgtccaaaatatctaaatacaaaaatcactggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagcccggcgcggtggcgggcgcctgtagtcccagctactcgggaggctgaggcaggagaatggcgtgaacccgggaagcggagcttgcagtgagccgagattgcgccactgcagtccgcagtctgccgcagtctggcctgggcgacagagcgagactccgtctcaaaaaaaaaaaaaaaaaaaaaaaaaaaaaaaaaaaaaatcactggccaggcgcggtggctgatgcctgtaatcccagtactttgggaggccaaggcaggtggatcacctgaggtcaggagttcaagaacagcctggccaacatggtgaaaccccgcctctaccaaaaatacaaaaatgagccaggggtggtggtgggtgcctcatgcctctaatcccagctactcaggaggctgaggcatgagaatcgcttgaactcgggaggtggaggttgtagtgagacgagattgtgccactgtactccagcctggcctacagagtaagactgtctcaaaaaaaaaaaaaaaaaaaaaaggcatgacattagtgctaaatttaatgttctctataaatgcactgcaacagaattgtatgagacctaaacagctgtcaatttcatttttagctatctagattatttcttttctccagatgttcatttttcataagccaaattattggtcacataaaaaataaagttttcacctctacatttctgtaatagctagcactggtttttggataatctaagttacatttaatttagtaaaatggttattgctattgttagtaaatctgtagttactgtttataaaattgctcttgtttaacaacagaaaagcacagcatcgttgcagaagcaaatacttggatttacacaaagactgcatgctgcagaagtggagcgccgctcactacgcttagaggtcacagaattcaaacgaagtgtgaatgaaatgaaaaaggagcttgacaaagcccagggtctgcaaatgcaattaaatgaatttaagcagtctgtaagtatatatcatttaggaaactgttgctttgctgatatatatttctttatctctatatccttttttccttaacttttgttatgtgtggtttttcaaataattcaaaagcctattaataacatctctttttcttcagaaaacttcctgtctaaaatgcctctaattgctgatgttggtggcaggcgggggagtggggagagagatttcctctcttctttttttttgagatggagtctcactctgttgcccaggctggagtgcagtggcactatctcagctcactgcaacctctgccccccgggttcaagtgattctcttgcctcagcctcccaagcagctgggattacaggtggctgccaccacgcctggctaatttttgtatttttagtagagatggaatttctccatgttggccggggtgttctcgaactcctgacctcagctgatctgcccacctcagcctcccaaagtgctgggattacaggtgtgagccactgcacctggcctcttctcttcttatattgaatattttgagtaaattagattatgtagtatgaaatcaaattgcttttccaaagaaatgttcaatttatctaacgtccatcaatgacttatatgtattattttaaaaagcagaaaatagctgaaaaagcacagtcgtatgccaaataccattagatcaagaacaaaatgtctaactgtgtgaagcacaatataatgcagacatccacatattctgtttgcagttgggatagttattaacattgctgtttttaatgtggatatgggaacatagagttaaaagattaccctgaaacttcaagactgtacaacttaaaacagctactataacttcagtttaaatgtgcttttatcttttgattaatttggaatttacagttttaacatttgcagtaacagaggcagcagcaggtgtagtagtttagttattaatcctatgataatgtaattgtgctagtgttaattattatttcaagtagatacaccttcaaagggcaaagagttcctatgaattaggcaggtcaagtaatcatgaattactcttaagccataggtttcttttcggtaaatgtctaaagacaccataatttttccttctcttagttttttgctcagagaaggaaaatttaagagatgagctgcttcaacttttttttttctaattatgaaagttatacatgacaaccttaagtaaaaatacaagaaagtattaagaagaaagtttagactgggtatggtggctcatgcctgtaatcccagtgctttgggaagccaaggtaggaaggttactagaggccaggaattcaagaccaacctgggcaacatagtgagaccgcatctctaaaaaaaaaattatatttattttaaaaacgaggaaagttaaaatcattttaatcttaccacccaaaaccaatcactgttgaaatgtggatgcattttgttctccacatttcgtgtgtatatatgtgcctgtgcatgcctttatgcacagttgtagtttggaataattttgtatgtatagtttgcagcctgacttatataaatatatgtatacatgtatgcacttaaagtactgtaatcattttcctctgtcatttaattattaatttcattttagttaaatgaatactagtgtgtcatatgaatgtatcaaaatttgagtatttcccttttcttagatatgtgatttttttccattttttgccattttacttaaataataaagagatgtttatacttttaaaaacgaattcttttgaagcatgtctctccttccgtttgatttgcttctgtatcatagaaatagttgaatttgggatattgagatagtctaccaaaatggacacagacagtcatttatgcaatttgagatttagagtatagtcaactgtatttagatttagataataatggcttttgtaaaaactggaaaattccttacatatgttgctccctggaatatatacgaagaattctaaatattctacacaatttgatttcctagtccatagttaagtattaagaaaacaagtttgcatctttgattagtttagaagtagtcaggacttaatttctagaatctagagagaagattagagtttgagggaaggttagtggaaggtgacagaatcctcttgtaagagctttgaataactggctttcagtaattaagagtatgtttgaggaagtgcaggaataaaaatagcatagtaattgagggaagaggtacttaatttttactttattttaccttattttttgagatggagtctcgctctgtcacccaggccggagtgcagtggtacgatctcagctcactgcagcctccacctcccaggttcaaggaattctcctgcctcagcagtagttggtgttacaggcgcccaccaccacgctcagctaattttttgtatttttagtagagacagggtttcaccatgttggccaggctgatctcaaactcctgacctcaggttatctgcctacctcagcctgccaaaatgctgggattacagatgtgagccaccacacctggccagtacttaatttttatatattgtcctataattataagttatgaagtacgtgacgatttctaacatttagtgatcgtgttgaccaggtatcagacactgaccctaagcacgttacagacgttgactcatttggtccttataattatctcacatactattattatttctaatttacagatggggcttttggagcagatagaaactaagtagcttgcctggagtcatatagttattaatggaaatgacagactttgaacttggttcctgtggctctaaaactcatgcttttatccacttcattacagtggttagtgttgatacctaggtgtgctaataaagggttgttatattaaaaacataatagatgaagaaaagatggtagtttcctctaagaaaattggagagagtgcctgcaaccatttgtctctcgctcatttcagaaaaagtgtattggagagaataaaacagcttctttatagttggtctaaaattatgaagggaaacatcctgctcaccgaaagctatttagtactttaatggttttggaatactgtgtccatctactgacagtcgttctttaacagctaacttccccagtctcatgatctttgtttattagctccttacacttgctttcacacaccatctctttcttattctgcgttgctatacttgcttgattttatttactttacagaggaataaacagaattgagccagtctctgggacggatggatggacaagagaggctaaaattacctgagtttttaggtaaaggggaaattttggaggattgtgaagggaacacacgttctgttaaaacaaggaagtcctgcaaaatggtggggatgttgatggaaagatctttattcacttgatggtcaagtggattgaaaaggacagaatggtctcatggcaaggagtggtaatttaaaacaacacattgaagatagaagaggtacaaaaatatatgttcacaagacccagcgcatagagggatgttaataaatagaaatataactggagtgctgagaggagactgttagattagatgttttgaaagctgagggtttggttgtaatagcacaatgtggagagttcggcagctgttaaacagcgagtaaaaagttgagtgttctgtataatcccagcactatgcaagtatcagtgacatattagatataccttttactaggtgactctctgaaaatgaggcaactttcctgtgtgtcttgtgatcattctcattaatttatattaacttaggtaaatcattagacatctgtttttatgctacactattggcttttaaaatttcttcattgttgagaaatgcactcttaaatttttgaggaatgcacccttaaaaagagaaatgagttttaaaagacagttgcttcatagaagtggcaggcagggtacctggtgccaaaataaaactgagtgcttatgtattatgatatagaaggacctatgtaattgatttatcctaaaacttagtttcagcaaaagtctttctctttatatgaattgcatgcttgctgttgttggcccacgaggaaactgtgactatgcacatttctatttttgtcttatttgtcagaaaaataaaagacaaagtctgtattcagttacaatagttactagatgcttagaatcaaaaggatttttttcactgctttttcctcccagatttgttaaaatttcaaatcaacctgctttatatttgtggcgaatgatattaatccacctcacatccttttttacaatgggaaagttagaatttttaaatagatacatgtataacttgtgtatttaagtggcctgaatcgttcctttgagttttccacatatatttctcaggttatctaccttttgtgaaaccttcctcttttttatacttcacgatgtctctgttgtttgttgtatctagatttcatttgtttaaatgttttgaacaggagataatacaagcttgtcttgccttggattctccatccctgtctagaactgtcattagttattccagagcagagtactgtgccctccaaagcagtcatgatattgtaaaaaccatgttgtgtgttatggtgtagattttgttggcagatgtgtatatatgagtattatttcattcaacaaatattgaacactcactgagtgccaggcactcttctctatgttggatgaaaagctaaatgaagcccctgctttggggatgctacacctttatatgtgtggttggtggcagggtgtggacaggcaataaaaaaagtgagatgaatttagataatgacaatggctgtgaagaaaataaaacaagatggtataatagagtgattgggagttggagaggtgtagtcatgtaagacctgcctaggagaagatatttgaccgggagacctgaataataacatacgctgaacacaaacttctaggtgatcacttaaaagccaaggaatttgttaaaggttttaattcccacaatcataatctttataaaaagtgctcatgtatgaaaatttaaactgagcatcatggattcatatggaatttaaaatgagttttctaagattttatttgactgaaaatgataactaagtgtggctgttttgctttaaaaatcacagtagtatttttatcttgacttatgcaattaagaaaagctaattgtatttttttaatgtatcaagtgcctagaaatgtttgtattatattcctttagttttgaaggtgaaatgatacaacaatgcagttagctttataactgattctcccctctcctcctttttacagaaattgatcacccatgagaagtttgaaagtgcatgtgaagaactaaataatgcattacttcgggaagagcaggcacaaatgctattgaatgaacaggcacaacaactacaggaattgaattataaacttgaattgcactccagtgaggaagctgacaaaaaccaaactcttggagaagctgttaaggtaagagaataaagggatatttgcataaagggatattttatctatgtgtggatcttagagggaattatgatatctcctgaataggaatagatcccaagatgtaaaattttattctatgaggatagaatgaaacatgtttctgagacctcagttataagcctgcattcacatgcatcgagaaggtaaaagtaggctttacttgctggttgaaaacgaagtgaaggtcttttccagtaataataacaattattattaacaataaaattaacaataaatttttgtttcttttatcttctttatttcttcctctctttagaattttccttttcttgttttgtacccaatggactttggaaactccacacatcttttggattctggaaggttttggtctgggtctgattcttatataagtacatatttggggagaagggaggtttggttagaaagagttgttctctctgtcatatatttgtggtaaaggtatttcaaaggaaaaagagaagctatcatttaaaagttgtcactgagaaaatttcattaatgggtttaaatgttgcctacaaagtataatagaattctagtttttgattataaaacttgtggatttttcactagtgagattatatacgttggaatggaactaaatccagggaaacaaaaatgatatagccactatataggatatcatacttaatacagttaatcaactcagagttggtattaacttatacaaataatatctatttattctgatatcttaataatactattatgatcaatgataaaatagccaaaatttattgttaacttcctgtttaccaggcactatgctaactactttaaaacacttatgtactcctcacacaaactgtatgggattataaaacacttaggtactcctcacacaaactgtatgggattataaaacacttaggtactcctcacacaaactgtatgggattattcctgttttataaatgagaaaacagatacagagaggtgacataacttacacatttcttagtaagtaatatatctagggagtcagatttcacatctgtcttcctaaccaccacatcatatgttccactgattgacagcatgcatttgccaggctctgtgttactgtctctacatgaattactcattttaaactacctctgtgaggtaggtactattattatgattttgatttttttttttgtttaaatttagagacttcaataaacttgcccagggtatcctgtaaatgttgaaactgggatttagttttcaggaaaattagaaaattttgaaatctaaagcaggaaaatacacgtgaatttaaagaggaaaatatagatgtcctttacgaagaggaataaacgaccaggatggtattagtattttagagtatgtttttccaaatacatgtattaaattgaaccatttgaaattgctgtttttataagtgaaaactagacaaatgccaggaatttcaaatggctcaacctaatgcatattatttttcttacataaatgagaatgtacctatatactgttttgaaacttacttgtattacttagtaatagattgtgagcattcttgcttaccaaccgatatgactgtgaatttttttcacttttttacacaagtaataaatattcattgtggaaaaataagaaaatatagatgaagaaaaattaaaataatctcaaatcatatcacctgatatatctaccatcaacattttgatatatatattccagactttatgttttaaaaatatagaaatataactgaatataggttaataaaaatacaatcatactattatacatattgttttttacttacttcaaacaccatgtcaaggatttctttctatgctaataagtatagtggtatctgtcaggcctctgagctgaagctcagccattgaaacatctgtgacctgcacatatatgtccagatggcctataggagccaagaagtctggagcagctgaaaaaccacaaaagaagtgaaacagccagttcctgccttaactgataacccaccttacgacattccaccattatgacttgttcctgccctatcctaactgatcaatcaaccttatgacattcttctccaggacaatgggtctcatgatctccccaccatgcaccttttgacccctcccctgccgacaacagataaccaccttcaactgtagctttccactgcctacccgagtcctacaaagctgcccctctcctatctcccttcactgattctctttttggactcagaccacttgcacccaagtgaataaacagccttgttgcttacacaaagcctgtttaggtggtcttctatatggacacgcgtgacagtatcatcatttcctggctggttgaattcttttggatgtatattttttctttttctttttaactgacaaataattgcatacatttagggtgtattttgatgttttgctacatgtatgcattgtggaatgatcaaatcaggctaacattcatcttttcacatacttatcatttctttgtggtgataatccacttttttttttaccattttgaaatatacattattattaactgtactcaccttgctgtgcaatagatcaccaaaatttattctttctgtctagctgaaactttgtaccctttgattaacatttgcccatccccactcacagcttctggtaatcacttcaatgtactgtacataatttattaacctaatttaatattatagacttagatttatcccagcttcttcctcctcctactcctccacctcctcttccttctctcactcctttccctcctcttcttcctttttttctcttctgtttctccgtctccttttgctattataagtaagtatcaagatgaacaacctggtatctaaatgttacgcacatatctgtgattatttcatcaggatgaattcctagatgaggaattactaggttagaaaccacatacattaaaaaatgtacatgttatcaattggcctacagcaagtttctactgattacattctctcctaagatatatgagaatggcaactttggccctacctggctattactatttaaaacatttttgacagtttggtagatatgtccttgttactttaatttgtatttcttttattatcagtggagttgaaaatttttataagcatattggtcattaaacaacatttttatgattcatgtcctattaatagataatgtaatgaactgtgctttggaaaagcatctttgtcattttgaagtctttttctctgttatagtttgtgtttaggtataatatctttacgcagataaagagctgttcatgttaatttttttaaattgccagtagcttaaatattgttgtcaggaatggagaattgtttaattactatctcttaattagaactagcaggtggtaatgtgaaaatgctctcttgtgggaggcaacatggttcaatgggaaaagcactggccttggaacaagtattcctgaattcaaatcccagctctgttgcttgggcaaattacttaaccttctgagcctcagtttcctcttctgcagaaataaggataatgatacttaagttacaggatgtttatgagaatgaattaagattctatttgaaaagcaagtgtatacttgttaaatattcggttgtgttttcagtaatgctttaaaaaatagttcttttttaaatatgtcctgtgcataacttcttttaaaaaacaaagtgtattgtttcttctttttaaaaacaaaataagatcatgagtagaagatatggatacagaaaaaaaaaacaagctatctatgatttataatctgaaagcaatcacttaacattttgggaattttgttttaaatcatatgtttttgtttttttttttttaaagacagggcctcactctgttgcccaggccacgacctcctaggcttaagtaattctcctgcctcaccctatcaagaagctgggtctacagacacatgccaccacaccctgctaattaaaaaaatttttttgtagagatggaaactgcctatgttgcccagtcctggtctcaaactcctgagttcaagcgatccccttgtcttggcctcccaaagtgctgggattacaggtgtgagccactgtgtccagcctaaatcatttctttatatgtaatagtttttataaataataatttagactggattctcagaatggccttttgttttaatacagctaaatcttggattagacattccctgcaataaatgcactgcatttattgcataaatgcacataaaggaaatctccaaggacaaaaataaaacaaatgacaatattgtcaaacgtcagtatgtggaaatcaaagttaacaccgtgagtagttgctaggtttgtcctggaggcagatacaggttgagcatccctaatttgaaaatccaaaatccaaaatgctctaaaatcaaactttttgagcactgacatgacactcaaagtaaatgctcattggagcattttggatttcagattatcagatttgggatgctcaaccagtaagtatataaataatacaaactttccaaaatgcaaaaatattcaaaatctgaaatacttctggtcctgagcattttacataagggatgctcaacctataccaatattaatcctggaaataggagattaagctttgggttccaccagcagataggagcttgaacctaaagctccgacattaagaaattgcttaataacctgaaagtgataatcaatagtattccattgttttaagcaaaagctaaggcaaaagtctatctggaaaaaggcttgcctaatctagttccttcagaagccaacaaagagtaagatcaacgaagtaactgacacatgaatagatagatatattaatctttttttaaattatactttaagttctagggtacatgtgcacaacgtgcagagttgttacatatgtatacatgtgccatgttgatgtgctgcacccattaactagtcatttacattaggtatatctcctaacgctataccttccccctccccccaccctacgacagtccccggtgtgtgatgttccccttcctgtgtccaagtgttctcattgttcagttcccacctacgaatgagaacatgcggtgtttggttttttgtccctgcaatagtttgctgagaatgatggtttccagcttcatccatgtccctataaaggacatgaactcatccttttttatggctgcatagtattccatggtgtatatgtgccaccttttcttaatccagtctatcatggttggacatttgggttggttcgaagtctttgctattgtgaatagtgcccaataacatacgtgtgcatgtgtgtttatagcagcatgatttataatcctttgggtatatacccagtaatgggacggctgggtcaaatgatatttcttgttctagatacttgaggaattgccgcattgtcttccacaatggttgaactagtttacactcccaccaatggtgtaaaagtgttcctgtttctccacattgtcttcagcacctgttgtttcctttttaatgattgccattctaactggtgtgaaatggtatctcactgtggttttgatttgcatttctctaatggccagtgatgatgagcattttttcatgtgtctgttggctgcataaatgtcttcttttgagaagtgtctgttcacaccctttgcccactttttgatgcggttgtttgtttttttcttgtaaatttgtttgagttctttatagattctggatattagccctttgtcagatgagtagattgcaaaatttttctcccatcctgtaggttgcctgttcactctgatggtagtttcttttgctgtgcagaagctttttagtttaattagatcccatttgtcaatttcggcttttgttgccattgcctttggtgttttagacatgaagtccttgcccatgcctatgtcctgaatggtattgcctaggttttcttctagggtttttatggtttcaggtctaacatttaagtccttaatccatcttgaattaatttttgtataaggtgtaaggaagggatccagtttcagctttctacgtatggctagccagttttctcagcaccatttattaaacagggaatcctttccccatttcttgtttttgtcaggtttgtcaaagatcagatggttgtagacatgtggtattatttctgagggctctgttctgttccattggtctatatctctgttttggtaccagtaccgtgctgttttggttactgtagccttttagtgtagtttgaagtcaggtagcgtgatgcctccagctttgttctttttgcttaggattgtcttggcgatgcgggctcttttttggttccatatgaactttgaagtagttttttccaattctgtgaagaaagtcattggtagcttgatggggatggcactgaatgtataaattaccttgggcggtatggccattttcacgatgttgattcttcctatccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctgtgtttttcttattggtgtataagaatgcttgtgatttttgcacattgattttgtatcctgagactttgctgaagttgcttatcagcttaaagagattttgggctgaggtgatgtggttttctagatatacaatcatgtcatctgcaaacagggacaatttgactacctcttttcctaattgaataccctttatttctttctcttgcctgattgccctggtcagaacttccaacactatgttgaatgggagtggtgagagagggcatccctgtctgtgacagttttcaaagggaactctgctgctgatacccggcaaacagggtctggagtggaccttcagcaaactccaacagacctgcagctgagggtcctgactgttagaaggaaaactaacaaacagaaaggacatccacaccaaaacctcatatgtacgtcaccatcatcaaagaccaaaggtagataaaaccacaaagatagggaaaaaacagagcagaaaagctgaaaattctaaaaatcagagcacctctccccctccagaggaacgcagctcctcaccagcaatggaacaaagctggatggagaatgactttgatgagttgagagagaaggcttcagatgatcaaacttctccgagctaaaggaggaagttggaacccatcgcaaagaagctaaaaaccttgaaaaaaggttagacgaatggctaactagaataaccaatgcagagaagtccttaaatgacctgatggagctgaaaaccatggcacaagaactacgtgatgaatgcacaagcttcagtagctgatttgatcaactggaagaaagggtatcagtgattgaagatcaaatgaatgaaatgaagtgagaagagaagtttagagaaaacagaggaaaaagaaacgaacaaagcttccaagaaatatgggactgtgtgaaaagaccagatctacgtctgtttggtgtacctgaaagtgacggggagaatggaaccaagttggaaaacactcttcaggatattatccaggagaacttccccaacctagcaaggcaggccaacattcaaattcaggaaatacagagaacgccacaaagatactccttgagaagagctactccaagacacataattgtcagattcaccaaagttgaaatgaaggaaaaaatgttaagggcagccagagagaaaggtcgggttgcccacaaagggaagcccatcagactaacagcggatctctcggcagaaactctacaagccagaagagagtgggggccaatattcaacattcttaaagaaaataattttcaacccagaatttcatatccagccaaactaagcttcataagcgaaggagaaataaaatcctttatagacaagcaaatgctgacagattttgtcaccactaggcctgccctgcaagagctcctgaaggaagcactaaacatggaaaggaacaaccagtaccagccactgcaaaaacatgccaaattgtaaagaccatcgaggctaggaagaaactgcatcaactaatgagcaaaataaccagctaacatcataatgacaggaacaaattcacacataacaatattaaccttgaatgtaaatgggctaaatgctccaattaaaagactcagactggcaaacaggataaagagtgaagacccatcagtgtgctgtattcaggaaacccacctcacgtgcagagacacacataggctcaaaataaagggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtccttagagacctacaaagagacttagactcccacacaataataatgggagactttaacaccccactgtcagcattagatcaatgagacagaaagttaaaaaggatatccaggaattgaactcagctctgcaccaagcggacctagtagacctctacagaactctccacccgaaatcaacagaatatacattcttttcagcaccacatcgcacttattccaaggtttttttttttttttttttttttttttttgagacagagtctcactctcttcccagtggctggatctcaactcactgcaagctctactctccaggttcaagtgattcttcttcctcagcgtcccaggtagcttggactacaggcacacaccacaacacctggctaagttttatatttttattaggacagtgtttcaccatattggctaggatggtctcgatctcctcacctcgtgacctgcctgcctcggcctcccaaagtgctgggattattgatgtgacagatatattaatcttatatgcagccacattgctgaactctcttgtcatttctaatattttatctatactctctggggcatagacagtaatatttattctataatgatagttttgttttttgttttcaaaccttattcctttaggtttttttttctcctgctttactgtactggctaggatacagtgttgggtggaggtggaggtgtggtaggcatccttatcttgtttccagtcttaaagaaaatctttctttcttcattaagaaggaagtttgatataggtttttatttgataatccttgttgggttaaggaagttatcttcctgcattatgcataaattaaaaatcatggaccgggcatagtggctcacgtctgtaatcccagcagttttggaggcttaggtgggcagatcacctgaggtcaggagttcaaaagcagcctggccaacatggtgaaaccccgtctctactaaaaatacaaaaattagccaggcatgttggtgggcacctgcaatcccagctagtcgggaggctgaggcaggagaatcacttgaacccgggaggcagaggttgtagtgagcctagatggtgccattgcactccagctgggtgacagagcgagactctgtccccgcccccacccccccaccaaaaaaaagaaaagtcatgaatggatgttggatattatgaaatacagtttatgcatctatttagataatcatatgacttttcccacttattctgttggcatcttgaattatatcaggtaatagcaaactatgatttgtgtttatacagactgtgagctaagagtggtttttagatttttaagggattataaaaaataaaaccaaagaacaacatgtgatacagatggcatgtggtacacaaagcctaaaatatttcctatcagaagtttgctgacccttgggttatgttttagtattctaatgttaaaccagccttgtattcctgaagtaaacccaatgtagtcgtgatgattttttaaaaatatattgctgcacccagtttcttaatttttcacttgggacttttagatctgtagtcttaattggaattgtcttgtaatgtatgtttctcctactgtcatcactttcttgaagtcaggattttgctaacatgaaaggacttctcttcccactccaaacacagagagtggtgtcttagtgcattttgtgttgctatgacaaaatagcacagatggagtaattaaataacagtagaaatctatttctcaaggttctggaggctggcaccaatatcaagttgtggcatctggtgaggaccttctttatgtgtcatcccatggcagaaggcagaagggcaagagagtgtgcttgcattctctgggggaaggaagtagggaagggggccaaacccatccttttataagaaaccctatttcatcggttaatttataactaactcactcccatgataactttattaattcatttatgatggcagagccctgatgacctaatcacctcttaaaggtctcacctctcagcactgttgcattggggattaagattttaacacatgaactttgggaaacacattcaaaccatagcaagtggaaactagaaaaaatataacatgaattttggggtatatagccaagcttaaagagagcaaaataatcaggttcaagaaataaagaggaccaaaacaccaaatgatgaggactcaacaccaaatgatgagaaggagctgaactctaattagctcattggggtgtgcaaacctagctggaggccagagttgataataataatgttagggaaatctaggctttaagcctcagagactaggagagatctacctgtgtaaagctaggcatctggaagggctgccctactatgaaatgtggatgagaaaatctctgcctagcagctacatgagaatttgacatctactcaggactgtgggtgggaaaagttactaaggaaactggaacctaggcctgtgccacacacagggtcttagtttacaccttaatgatccaaggactctttagttgagatttaatctttaaaatggtacagtccagtcaccagtgtgaccttgtagaaggaaacgtgaaaatgttcaattagggatgtttctgcatctcaaagaatacagtcaagacttttataaaaaaattcaatatttgataatagaattcaatattacaaatcacacaaaaatgaattacacatcaaatgagaaaatttacactttaggtggtagaaatactagaagaattgaaatcagctaaacagatactttaagtgttttttcaagcattctaagagataaggtatgaatagaagttgtaagttaagacatgaaaatatagtcatggagattatgaactcagtgaacattgggtagacattgatgaagtatattagcaaattgtaagaaagctgaggaaataacacataatgctctccagggggacaaaatgatggataataagaaattaagaggaaagaaaaagagaatgaaacagatttaataaaagaatgaaagtagagtaccataagcacctataaacatagtaatgagatgacagaataacgaagacaaaagtaagtctttaaagttatgggagaaaaaggattacttacagaagaataacaattagatcctaagagtaatgacttaattcaaaataacttaattgaggtataattataacaatataatgtacacttaaaatatatatagctcagtgccttttgacaaatgtatacattgtttaactaccactacagcagtctgagctccctgctcaaccctgcggttggggagggtgttggcagggtgcaagatgggccaagtcagacctggcaagtatgccctcaggcaagaggcacatttgtggagtgcacagtggtctgagctccctcctcagccctggggttggggaggagcgttggcagggtgcaagatgggccaaatcagacctggcaagtacagcctacagcctacaggagagcctacagattcccctatagcagactcaagcaccagtgctaagggagaaaccagtgggtgactagcaagcacccagaggtgtacctaggttgtatagtaagtgtgagtttttaagaaactgccgaaatctttttcaaaattggctgcatgattttacatttctatcagcactgtacgaaagttccatttgcttcacatcctggtgaatacttggcactgtctttaattttatctgttataatgggtgtatatggtatgttttttgcatttaatttgcatttacctgatgattaattatgttaatcatcttctagtgtacttagtcattcatatatgttctttgtaaaatatctgttcaaaccatgtgatatttgattgattgactgatttttttgagacaaggtctccctttgtcactcaggctggagtgcagtggcgctatcatgggtcactgcaacctctgcctcctgggctcaactaatcctcccatctcagcctctcaagtagctaggactacaggcgcatgccaccatgccagctagtttttgtattttttgtagagacggggtttctccatgttgcccaggctggtcttgaactcctgggctgaagcaatccacctgcctcagcctcccaaagtgctgagaatacaggcatgagccactgtgtttggccaacatttaatattttaaactttgggttgtttgtcttattcattgtaaaaattctttctatattctctatatagattcttttttcacatatattaataatattatcttttagtctttggtttgctttttcattttcttaacagtatctttcaaataaaaattttacattttgatgaagtatccatattctaacttttattgttgtagttgatcctttttatatttcatctaagaaatgtttgcctactatgatgtgaaaaagattttacctttttgacaattatatcagttaatttttatacatggtgtggtgtaagggttgaagtttattttctttccaaataaatattaagttattcctgtgctgtttaaaacatatggtcctttttctattgaattaccttggcccctgtattaaatcctctgtgtatgtatgtgtgtgtttatttctttattactggactctgtctctgtttcattgatctatatgtcttcctttttgctaattccacattgttttaattgctgtgcctttataggatgccttggaattcatatttttaaggtgctgtaagtcctttaactttgctctttttttggaactgtatttgctatttgggtccattgaatttctatacaagttttagaatcagattgtcattttcttgtaagatattaagtttactgatacagagaggctttataacattccattattatatttttaatgcttgttggatctgttgtgataattcctctttcagtcctcatactggtaattcatattttctcttttctctagttaggagtttattaattttgttgttcatttcaaaaaacataagctttggctttgctaacttattctattttttgtaatatttatttctgttatttttattatttccttttttttagttttttaaaattttactttaagttctgggatacatgtgcagaacatgcaggtttgttacataggtatacatttaccgtggtggtttgctgtacttatcaatctgtcacattttaggttagtttagcccttctttttctagttgttaagggtttagcctattagatcaggaatcagcaaaatgtgacccacaggtcaagtgtagcccactgtccatatataaagttttattgaaatgctactatgcccgtttattaaaatattgtctgtggctgctttcttactacaatggtagatttaagtagttgcaacagtgaccacgaggctcacaatgcccgaaatattgactgtgtagtttttacaggtattgaatattttttagaactttataaagtctctgctattggcttattaggtatttctcttttttacttttaggggctgctgtagtgtttataatatacctatttcacctatcacagtctattttaaaataatattatttgactttatgtataatacaaaaatcttacaacagtatacttccatttcttttctttcattctctttgtgttgttgtcatagatttcaattttacctgtattctaaactccatactatattgttatcatttcaacttttaatagaaaattagattttaaagaaattttaaaaataagaaaacaattgtctttcatcattgccatatatatatatatatatatatatatatataccattttgatgcacacttcctttatatagacccgtgtttccatctaatgtgattttccttctgcttgaggaactccctttaacatttcttgtgatacttgtctttattttcgaaaggtgttcagtatagatgtctgtgttgacagtttcttttagcactttaaatatgttgttcccttctcttctggtttgcattatttctgacaagaaatacgtgttcattttacctttgtttgtctctatgtaatgtgtctttttttcccctcaggttttgtaaaggttttctttacaaattttaatttttaatttttaatgtttgtggaaacttaatagggtatgtgtatatatttatggggtacatgagatatttttatacagacattcaatgtgtgataaccacatcatggtaaatggggtatcccctgcaaccgtttatcctttgtgttgcgaacaatccaattatactctttcagttatttttaaatgtataattaaattgttattgactgtagccacctgttgtgccgtcaaatactaggacttattcaatctttctctctgttttttttgcacccattaaccatcccgaccttcccacacattccccactactcttctctgcctctggtaaccatccttctactgtctatctccatgagttcaattgtttggatttttagcccctccaaataagtaagaacatgcaatgtttgcctttctgtacctggcttatttcacttaacataatgacctccagttccatctatgttgttgcaaatgacaagatctcattctctcttatggctgcgtaatactctattgtgtataagtaccacattttctttatctgttgatggccacttaggttgcttccaaatcttggctattgtgaacagagctatgacaaatgtgggagtgcagatatctcttcaatataccaatttcccttcttttgggtatatacccagcagtgggattgctggatcatatggtagctctgtttttagttttttgaggagcctccaaactgttctccatagtggttgtactaatttacattcccaccaacagcatacaaaggttcttttttctcccttgtgcatccatttgttactccctgtctttaggataaaagccattttaactggagtaagatgatacctcattgtaattttgatatgcatttctctgatgatcaatgatgttgagcaccttttcaaatttgtttgctatttgtatgtcttcttttaaaaaatgtcaatttaatcttttgcccattttaaaatcagattattagatttttttcctatagagttgtttgagctccttgtatattctagttattaatcccttgtcagatggacagtttgcaaatattttttcccattcagtgggttgtgtcttcactttgttgattgtttcttttgctgtgcagaagctttttaacttgatgtggtcccatttgtctattttttctttggttatctgtgcttgtgcgatatttcttaagaattttttgcccaaaccaatttcctagagagtttccccagtgttttcttgtagtagttttatagtttgagctgttagatttaagtctttaatccattgtggttttatgtttgtgtatgacaagagataagggtctagtttcattcttctgcatatggatgttcaattttccctacactatttattgaagaaactatcttttcccaagtttatgttcttagcacctttgtcaaaaatgaattcactgtaggtgtgtggatttgtttctgggctctctattcattccattggtctgtgtctgtttttatgccagtaccatgctgttttggttgctgtaaattctgtagtataatttgaagacaggtaataggattcctccagttttgttctttttgctcaggatagatttggctattctgggtcttttgtggttccatgtaaattttaggattttttttttctatttgtatgaagaatgttattggtatttttatagggattgcattgaatttgtagattcctttcggtagtatggacattttaacaatattgattctttcaatccatgaacatggaatatctttccattatttttgcactcttttccattctttcaatcattgttttatagttttcattgtagagatcattaacttatttggttaagttaattcctaggcattttattttatttatggctatggtaaatgggattactttttttattgttttatttcagattgtttactttaggcatatggaaatactactgaattttgaatgctgattttgtatcctgcagctttagtgaatttgtttatcagttctaatagttttttggtggagtttttaggtttttccaaatataagatcatatcatctgcaaacaaagataatttgacttcttcctttctaatttggaggccctttatttctttctcttgtttgattgctcgagctaggacttccagtactatgtcatgtaacagtggtgaaagtaggcatccttgccatattcagatcttagaggaaagggtttcattttctttccctattcagtatgatactagctgtgggtctgtcatatatggcttttattatgttgatgtatgttccttatatccccattttttttaggcttttttaaaatcatgaagggatgttgaattttatcaaatgcttctgtcagcatcaattgaaatgattatatggtttttgtccttaattctgtttatatgatgtatcacatttattggcatatgttgaaccatccttgcatccctgggataaatcccacttggtcatgttgaatgatctttttaatggattattgaatttggtttgctaatattctgttggggatttttgcctcaatattcataataaatattggcctgtagttttctttttttgatttgtctttgtctgattttgataaggtttcctttttattattggtttccggaagtttgattatgacaaatgttggtgtggtttctttgtgtttttcctactgagggtttattgagctttatttatttatttatttttaaatttatttgtaaaatttaattaattattttcaacttttaagtttaggggtacatgtgcaggatgtgcagatttgttacctacgtaaatgtgtgccattgtggtttgctgtacagatcattctatcacccaggtattaagccctgcatccattagctatccttcctgatcctctccctcctcccagcctgcatcctctgatagaccacagtgtgtattgttccccactgtgtgtccatgtgttctcatttagctcccacttataagtgagaacatgtggtatttggttttctgttcctgtattagtttgctaaggataatggtctccagctccatctatgtccctgcaaaggatatgatcccattcctttttatggctgcatggtattccatgttgtatatgtttgacattttctttatccagtctatcactgatgggcatttgggttgattccatgtctttgctatcgtaaatagtgctgcaatgaacatatgcatgcatgtgcctttataatagaacaatttatattcctttgggtatgtacccagtaatgagactgctgagttaaatggtatttctggttcttggtctttgaggaatcaccacactgtcttccacatggtcaaactaatttacactcccagcaacagtataaaaatgttcctttttctcaacaaccttgccagcatctgttgttttttgagtttttagtaatagccactctgactggtatgagatggtatctcattgttgttttgatttgcatttctctaatgatcagtgatgttgagcttattttcatatgtttgtttgccacatgaatgttttcttttgagaagtgtctgttcatgtcctttgaccactttttaacagggttggttggttggttgtttgttttgtaaatttaagttccttataaatgctggatattagacctttgtcagatgcatagaattgcaaaaatttctcccattcttaggttgtctgtttactccattgatagtttcttttgctgtgcagaagctctttagtttagttagatcccatttgttaattttgcttttgttgcaattgcttttggtgtttttgtcatgaaatctttgcccatgcctatgtcctgaatggtattgcctagttttttttctagggtttttttttgtagttttgtgttttatattgaagtctttaatccatcttgagttgatttttgtatatggtataaggaagaggtccagtttcaattttctgcatatggctacccagttctcccagcaccatttattaaatagggaatcctttccccattgcttgtttttgtcaggtttgtcaaagatcagatggttgtagatgtatgattttatttctgggttctttattctgttccattggtctatgtgtctgttcttgtaccagtaccatgctgttttgattacagtagccctgtagtatagtttgaagtcaggtagcatgatacctccagttttcttttttattgttgtttaggactgcctaggctatttgggcttttttttggttctgtatgaattttaaaatatttttttctttttctgtgaagaatgtcaacgatagtttaatgggaatagcatcgaatctataaatcactttgggcagtatggctattacacaatattgatttttcctatctgtgagcatggaatgtctttccatttgtttatagttctccttgaattggtccttcacttcccttgttagctgtattcctaggaattttattctttttgtggcaattgtgaatgggagttcattcatgatttggctctctacttgcctgttggtgtatgggaatgctagtgatttttgcacattgattttgtatcctgagactttgctgaagttgcttatcagcttgagaagcttttgggctgtgatgatggggttttctaggtatagaattatgtcatctgcaaacaaagatagtttgacttcctctctttctatttccatacttatttatttctttgtcttgcctgattgccctggccagactttcaatactatgttgaataggagtggtgagagaaggcaaccttgtcttctgttggttttcaagagggaatgcttccagcttttgctcatactgtatgatattggctgtgtttttatcatatatggttctcattatttgaggtatgttccttcaatacctagtttattgatctttaacatgaagagatgttgaattttatcgaaggccttttttttttgcatctattgagatgatcgtatggtttttgttttgggttctgcttatgtgatgaatcagatttattgatttgagtacagtgaaccccaaccttgcatcctggggatgaagcctacatgtttgtggtggataagctttttgatgtgctgctggattcagtttgccagtgttttgtggaggatttttgcattgatgttcattaagaatattagcctggagttgtcttgttttgtttatctctgtcagttattggtatcaggataatgctggcctcatagaatgagtttggttggtaagctgtttattactgggaggaatctctcctcctcaatttttggaatagtttcagtgggaatggtactggctcttctttgtacccctggtagaattcagctgtgaatatgtctggtcttgggctttttttggttggtaggctatttattactgcctcaatttcagaactcattataggtctattcagggattcaatttcttcctgtttcagtcttgggagggtatatgtgtcaaggaatttatccatttcttctagattttctagtttatgtacagagaggagtttctaatagtctgtgatggttgtttgtatttctgtggggtcagtggtaatatcctccttatttctgattgtgtttatttgaatcttctctcttctttattagtctacctagtagtctgttttattaagtttttcaaaaagccaactcctggatttgttgatcttttgaatggtttttcctgtctctatctccttcagttaaactctgatcttggttatttcttgtcttttgctagctttggggtttgtttactcttggttctcaagtccttttagttgtgatgttaggttgttgactcgagacctttgtagctttttgatgtgggcatttagtgccataaacttccctcttaacactgctttagctgcatcccagagattttggtacattttatctttgttctcattagtttcaaagaacttcttgatttctgccttaatttcattatttacccaaaaatcattcaggagcaggttgttcaatttccatgtaattgtgtgttttccagtgaatttttttagcactgagttctaatttgataacactagtctgagagactgtttgttatgatttcagttcttttgcatttgcatttgctgagcagtgttttacttttgattatgtgattgattttaagtaagtgctgtgtggagatgagaagactgtatattctgttgtttttgggtgaagagttctgtgggcatgtgtcaggtccacttgatcctgagctaagttcaggtcctgaatatccttgttaattttctgtctgataatctgtctaatattgtcaacggggtattaaagtctcccagtattattgtgtattattgtctgggagactaagtctctttgaaggtctctaagaatgtgctttatgaatctagatgctcctttattgtgtgtatatatatttagtatagttagctcttcttgttgaatgtctttctttgtcttttttgatctttgttagtctaaagtctgttttgtcagaaactagtattgcaacccctgctttgttctgttttgcatttgcttggtaaacgtttctccatccttttattttgagcctacctgtgtctttgcatgtgagatgagtctcttgaagacagcataccgatgggtcttggttctttatctagcttgccactctgtgtctttcaattggggcatttagcccatttacacttaaggttagtattgttatgtgtagatgtggtcctgtcataatgatgctagatggttatttttcggactcgtttatgtggttgcttcgtagtggcattggtctgtgtacttcagtgtgtttttgtagttgctggtaatggtttttcttttccatatttagtgctttcttcaggagctcttgtaacacaggtctggtggtaatgaattcccttagcatttgcttgtctgaaaagaatcttatttctccttcgcttatgaagcatagtttggctggatatgaaatccttggttcaagatgtttttctttaagaatgttgaatataggcctccaatctgttcttgcttgtacagtttctgttgaggagttcacactgttagactgatgaggtggcctgccctttttctctagctaactttaacattcttttttttcatttcaatcttggaaaatctgatgattatgtgtcttgggatgctcttgtgtagaatcttgcaggggttctctgtatttcttgaatttgactcttggcctctatatagcaagtttggggacattttcattgacaatatcttgaaatatgtttcctgacttgtttgctttctctccatccctttgagggattccagtaatttgtagattttgcttctttacgtaatcccatgtttctcagaggctttatttgtttttctcattcatttttctttgttttcatctgtcttatttcagagagccagtcttcaagttccaagattctcttctcagcttggtttactctgctgttaatattgtcattgcattgtgaaattcttgtagtgtgtttttcccctctgtcagatcacatagttcttctttgtggctatttcatttgtcagctcctgtatggttttatcgcagttcttagtttccttggattgcttatgccattttcttcaatctcaatgatctttgttcctatccatattctgaattctatttctgtcattttagccaactcagtctggttaggaacccttgttgtagaactagtgtagtcatttggaggatgtaagacactctggccatttgatttcccagagttcttgcattggctcttgccatgacttgtaattttttattgattgctgggcattgtgttgcttcttttatagagtattggactttattcagataagcagttatttgttgtttaattttatccttttgaggcttgtaaggacggggatagaataacctttactcagggatggttaagccttactactgaggtatggtccttctgggatctctagcgaatgacacatataataaatgtagactcaccacatgtcttgaggggacttgagtgattctcagtcttggtgatctctctggaaattgcttactactttgctcttcagttgctcaattgccttaccttatggattttttttactctgcacattcacatcttattgttcaagcaaagacacaggacactttaagctggaattctagatttattttttagggtaatttcttcctctccagaactctgtactataccttttagctatctcaggcacctaggtatctgatctctgtcttctcaccggagcaagattgccgtttctgcttggaatcttccttcttgctccatggtccaaaatatgcctccaggaagaaagccagatgattttatggctcctctcatttctttctcttattaggtttttttgccctatgctactggttgttcagtatctgaaaacagttgttttacatattttgtccagttttatcattgtttaaggtggaagggttaatctggttcctgttatttcatcatgtccagaagtgaaagtatcctccacttaaaaagaaatccatttctctttgatgccactttttcctttgtgaagctggcaaactcatatactctgagtgagggggcatttggagggaaaaggcagctggagagtagagaagatttgaaatagtcactttagagagaaggagagcaagtcaacagtagaaatataactggaatgctagatagaaatacaaatggagggatgttttgagaatttacggtaatactaatttgcctaaggcatttgaatgcttagatgtatgccttcaaacatgagtttgcattgtttttcaaggattgggatttgttagatatattagacaagaagacagaggggcaagggatgatagagtccaaacaagagtacttttgaatgaatcaatcattggatgtaagctggattaaaagagaagtgaagaagggagagtgctagtagactgggtgatcagtgaatggtcatataatttattgttgaacaataaatctgaaagaatcattgcttgctttcagagagcagggtgcttgatttcagagagcagggtgcctcagtgattttggaagcagagtaaggttaggatatcacaggcgtgaagttggagtatggaatggaattgagcaggtgagatgaagaggtcagggaaatggagaggtcagattttttgatgggctgtctgtgttgtctttcaagtcacccagaatgataggatgttgccttagtctatttgggctgctgtaccaaaatacaataaactggatagcttataaacagcagaaatttttctcacattgctggttattgagaagtctaacatcaaggcactagtagatttggtgtctggtgagggcttgcttcctcatagatggcaccttcttgctgtgtcttcacatggtggaaagcggcaaggcagctctagggagctctttgggccttatttatataagggcactaatcccgattttgagtgctcgtccatgatggtttagtcacctcccaaaagccccaccttttattgccatcaccttgggagttaggatttcaacataaaaattttttgggaacataaaacattcaaatcatagcaagtgggtattggagttagataataattgtgagccaggcacatgtggctgagaattagcatgagtgtatttgcaatgaatagtattttcaatgtatgtagtggagtctagtgtctagagcagcactgtccaatatggtaaccactagccacgtgtggctattgaaatttaaattaaaatgaaatgagataataaattcaattcctcagtctcactgtgtctgaaattggtgggttcctggtctcactgacttcaagaatgaagctacagactctcgtggtgagtgttacagttcttaaagatggtgtgtctggagtttattccttctgatgtttggacgtgtttggagttcttttccttctggtgggttcgtggtctcgctgacttcaggagtggagctgcagactttcgcggtgtgtgttacagctcttaaggcggcacgtctggagttgttcattcttcctgtccggagttgttcattcctcctggtggcttcatggtctcactggcctcaggagtgaagctgcagaccttcgtggtgagtgttacagctcataaaggcagtgcggacccaaagagtgagcaacagcaagatttattgcaaagagcgaaagaacaaagcttccacaatgtggaagaggacccgaacgggttgccactgctgcctggggcagcctgcttttattcccttatctggacccacccacatcctgctgattggttcattttacagagagatgattggtccattttacagagagctgtttggtccgttttacagagagctgattggtccgttttgacagggtgccgattggtgcatttacaaacctttagctagacacaaaagttctccaagtccccactagatgagctagacacagagcactgattggtgcatccactaaccccgagctagacacagagtgctgattggtgcatttacaatccctgaactagacacagagtgctgattggtgcatttacaatcctctagctagacacaaagttctccaagtccccaccagattagctagatacagagtgctgattggtgcatccaccaaccctgagctagacacagagtgctgattggtgcatatacaatcctctggctagacataaaagttctccaagtccccacccgactcaggagcccagctggctttgcctagtggatcccatgccagggccacgggcagagctgcctgccagtcccacactgtgtgcctgcactcctcagcccttgggaggtaaatgggaccgggcgctgtggagcagggggtggcgcctgtcggggaggctagggccacttgggggcccgccatggggtgggggggtggggctcgggcatggcgggctgcaggtcccgagccctgtcctgtgaggaggcggctgaggcccggcgacaatttgagcacggtgcgggcgggccggcagtgctggggaatctggtgcaccctccgcagctgctggcctgggtgctaagcccctccctgcctggggccggcagtgccggctggctgctccgagtgcggggcctgccgagcccacgcccacccggaactcgcgctgccctgtgagtgctgcgcgcagccctggttcccgcctgcgcctctcccttgacacctcccacaaggagagggagctggcttcagcatgggccggcccagagaggggctcccacagtgcagcggcaggctgaagggttcctcaagcatggccagagcagacgctgaggccgaggaggtgctgagagcgagccagggctgctagcacattgtcatctctcaacactagccacatggcaagtgctcactagtttcatgtggctagtaactgtcatatcagcagcataaatatagaaaatgtttatcattacagaaaattctgttgtacagtgctggtcgagaggacaggtgtcacgtgaagtatctaggcctgtagcagacctgttgggcttggaaagagaaacttacctgcaatattcttcatttaggcagaaaccttttggaaccagagggcttgaaaagccagatctttcttttgctgatattgagctaatggaacttgttgaatagttatcaaactctctaacaacccttatgtcagtgaaggaaaagtcctttgaaggcaaaaactataattagatacagcatacctctctgttattggaaacattacacaaataaatatggaaaatatagtatagaaaaaagtggaacaaattaaaggcttgggttttttttctttttttccccacccccgtactctattcttgagatgtttcatattgttgacctggtctgtaatatctttagtggtaccagacctctgagactgttgtgttaggtatcattacttcatttggtatagtttagaagacaatgaaagctgcatatgcaatgtattttatttttttctttaaccttactaactttaagtaagtgtggatttaaatttagttactgtttctactaatgatttttttcttgagtcctgtcttacatattttgatccttaggagacctcagattctgtttggtggtaggcaccccatgttagtggaagatgtggaagaatgattaaaatacatagttacttcgatgatggagtctacctataggtaaaattcatgagtgaatacagaaatgtttaccttaagatgtgttgctgctgtaaccagtacctaaagtgtgaggcactggcttagagatcaagcagtttgtggtggagaaactggtatcagggctggaaagctggagatttatgttaagttgtgggaaaacatttgataaaactgtacttgggataatttaggaggcagactatgtatctaatgatcctacacgtctaggggaaatggttggaaacaataatatgtcttggctttggcactctggtttgaacaaggtattaaaaaaagagaagtgagctcaggaaagaattagtcagtttgtgaccaaaataaaagggacgagagagagtctagaaatctggagcttagaagaagtccattaagactcagctccatggcaaagaaactaagggcatagctttcttattcaaacctgttatcttagatggcttcaaggaaaccaccattaagttcaagttcacatgctatgcctattgcacactcatatacatacacataggtatatagaaacagggaaactggtagcgagggtaatcttcaaggagtctaggtatattgattggcacatgcactggttggaagcaaacagattgaaaatcaactttttgagtcaactgtgtgctaaaaaccccacaagtctggactaaaattgccttatagtcttttaaccttaaacaaaatttgggccctcaaatatttgaaagtaagaaaaggaatgcaaaaattgtatcggccacaaaaagttactgtcctcaatgttcatttcatatatggccatggaagataaaggataaagaagaacctcccagaaggcagagcaagcgactatggagagcagtagagaacaggttcttccagaattagggactaattaaggaatttatcctactgtcaggatagaaggatctcttgagtttttgcccaacaagatttcattattattgtggaccagtgactgctacttgttgcccactcttcctttctctgaatgggagtgtttgctgtgcgttccctgtccccactaaatttgtgtatattgggttgagcatgggtttaaattatcttgcagttaataggttgctgtactatgaggacctacatttggacctcgtggtaactactgagcactatcagatgatcctagattttgagctggatgcaatgactagatgggaatttaggttgtcctctttggggagagagtgtgcaaataagggtgaacagaatactgaaatgggtatttggtggccaaaaacgcagcctgtgggcagagactggctaactgttcttcaagcccatttccttctcctttggggcttgctagagtgtgattgagttttggctaatggaatgtgaacaaagtaatgtttcttacttaaatattggttatatggttatggaaatttcccatgtacaataactctatattgtcttacctttctggcataatgccagacaagtaaggtgactttggaagccatgtgttaaagatagtggaactacaagacggaacatgtgggtcttgcaatcaccatttaggtgacaactaaacaccagtcaggaccatctattttggaatttatgtgaccaaaactctggacattatcatgtttgagccatcatacattttgtttgttttttggctatagcatctaactaatataagggtaaagctccctttgaccacaaccaacagttttggttgcttttttcctccccagaagtaattaatattacaagtctgtgtttctttctagacattttacatacttttacatgtatttgtgtgtgtgtgtgtgtatatatatatatattaaactatatgttaatattgtatattgtgtctttttgttccagaacatgggctagagatctacctatttattattttaattgatgtacagaattttatactgtaaataagtcattgtttatttagctattcatctgctgattggcattaggtttttgtcaatttttaaaatactgtagttttgaataaggaggccaaatgccttatgcagccatgttagatctagttctggtgcacacacaattttttaatttaatttagttgagtaataggatcactttgtatttgcatataaggtgaaataagaagaggtcaggataattaaattttagaatagggacctgtgatttgcagtttcagtaaatggaaggccttgggaataccatggccccttgacacttgtgtggttcctttgaccccttgacacttgtgggattcctttggaaagggataattttgctagtcttaattaattttgtcagttatagagaaatattggaaaacaaagcatctgaaatagcccattgatttcccagaatatttttggtatctgtagctagtaccagcctcgggctgggtcatcttctgaaaatccattccattgtcccaaagtgagttgatttctcccagttagtctacaaaccataatttaatgacatgcttctttgacttggtgtatatttcatgtttgtttcatctgttaaaaacaagattttggcccatagataatacgaggatggggttggggaagaggagtaaattaggctcttataaatgaaaatttaggaaatgatagtaatttgtgaatttttagcaaacaatgggaatagtacagaaactgttacttccttgaaatgacattgcttatatgaattttttttaaatgttgctctctgcttactaagtttgagattaagaatgactgaatcatttgggattgaaatacaattgtagctaaagtttttcttttttttctgagaaaagttagatatcttacattgttataacttacaattgcgtatgaaacacactagatatttttattatatatagaaaatttaaaaatatttttgtatttgtagaatcatctaatgaagcagagtcttttttgtaaaattacagatctactgatttatctttctgaaaaaacaaatcttcatcatgcaattaatacacatatttgagcctctactatgtaaaaagtgtagtacttgtcttcatgaatattgtatatcgaaagtaattagaatattgacatcctaatggttggtgagattttgatatgacaatgaatgacagcttctgaagctggagtattataaaatcttacattctgtgaattggtcaagtctgtccatgaaaaatcttagacattggtcaactgagactggcttagggggaaaaaataaagatttattcacagtaagagtcccagatggttcttttgtgtaaccttgatccagctcttgttcacacaccccttttcatcattgttttgtgtcatctgcttacttctgctatcttgtctttcatcccatcaagctgttagcagcctcacaggggtctcaagacttacgcctcttcctagccgcccgtatcattccttgcctttctgtagctgctttgggtttttctctcccatgtctcatttttaatagaatgtgaactctgtgctttattgttctccattctcaaaagttaattacatttagaccatgcatggggaagaagaattacttctttttgcaaagaatatgttttcacttatttttacttcttttactttttttttttttttttacaaagaatatgtgtttaaaaatttcaaatggagtaatcattatactaattctggcagagggtaacattttgtgattatttacctccttcttattttaaatgtgtcccaacgtttatattattaataaaattgtttgccctactctgagggtacagaatgaaaatgttgcataaagtaatataatcacttaattttgaataaataatcatattttctctggtaaacctttaaacaaaagaactccaacactcattttctttaaaaaatgtaaagatctcttagttgccaaaccttggttataataataattaacatctatgatataacccattttcataaagtaggattattagcatcattacttaatttaaaagtcttatcactttttactttaatcccatatatttttatcttcctactgacttataccattgagacctataagacagttaattatatttcaaggtcagagaaaaagaattaagaaaacaatagctctcagaccactttttaaaaataataattttagcagagaagattcaagatagaaggtagaagattcataaaaagttgtcattttcatttttgttagcctgaacaacagaaaatatgtaataatgtaaaacattcacgttttgtgtttattatgatgtcctattatgatatgataatttccttttttcaaagtgtatgttctcatacataattttaaaaacgttttttcatgttcaaatttgtcctcaatgagtcataatttgaaattagagtttttttgagtactaacctttgattagatcatattttaaaattaaaatatttgaatcatacagttcaatttgtataaacttttttacaaacattatattagttttttaaattaaacctgcttaagtaagaaaaaaattaaaaacatggactaaacaaaataacttgtatataatctcattatcactcacatataaacattattaatattttggcaaataaaactggaaatatgctatgcatagtttcatatcttgtttttgaggcatgcagtgacattatttttacttatattttcgaagaataattctagcatctattgaagtatagactatacgtatgcaaaactggaaacagaggcaagttaggaggctaacagtataatccagttcagttctaagacgagtggcttaggacagggtggtaggagtaaagagaggttagattctgcatgtacttgcattttgaatgttaacgcttatgtaattttctaatggatcagatgtgaatgtcagagagatgaaacaaggacaatcctgagccactgggtgaatggaattgctattaagcagttattaagataatttaataaccttttttaatgaaccatataatattctgtttcatgaatgtgctaaaatgtatttaactattttcttgttggatattcagattgtattcctttttcactattaaaagttaagatgaacatcttgtaattagatctttgactacatagctgattatattctcaggatagagctcaagaagcagactgagtcaaaagataaaagaagttttatagttatgtgtgtgtgtgtatttccttaaggctgtggatgtttttctcagttctggtgtttttctgagaggatgtgtaagcgcacttgtctaattccattctgattggcattggctgtcattaggtgttaccattaaaacaccaataacaacaaatcaaaaccaagaacctttgccagtgtgacagataagaaaaggtgtacagtggggtggagccaagatggccaaataggaacagctccagtctacagctcccagtgtgagcgacgcagaagatgggtgatttctgcatttccaactgaggtaacgggttcatctcactggggagtgccgaacagtgggtgcaggacagtgggtgcagtgcagcaagcatgagccgaagcagggcgaggcattgcgtcacccgggaagcacaaggggtcagggaattccctttcctagtcaaagaaaggagtgacagagggcacctggaaaattgggtcactcccaccctaatactgcacttttccaaagggcttaacaaacagcacaccaggagattatatccagcacctggcttggagggtcctacgcccacggagcctcgctcattgctagcacagcagtctgagatcaaactgcgaggtggcagggaggctgggggaggggcgcctgccattgctgaggcttgagtaggtaagcaaagcaaccaggaagctcaaactgggtggagcccaccacagctcaaggaggactgcctgcctctgtaggctctacctctgggggcagggcacagacaaacaaaaggcagcaataacctctgcagacttaaatgtccctgtctgacagctttgaagagagtagtggttctcccagcacacagcttgagatctgagaacgggcagactgcctcctcaagtgggtccctgacccctgagtaacctagctgggaggcatcccccggtaggggcagactgacacctcacacggccgggtactcctctgagacaaaacttccagaggaacgatcaggcagcagcatttgcggttcactaacatctgctgttctgcagccaccactgctgatacccaggcaaacagggtctggagtggacctccagtaaaccccaacagacctgcagctgaggatcctgactgttagaaggaaaactaacaaacagaaggggacatgcacaccaaaaccccatctgtacgtcaccatcatcaaagaccaaaggtagctaaaaccacaaagatagggaaaaaacagagcagaaatactggaaactgtaaaaaacagagtgcctctcctcctccaaaggaatgcagctcctcaccagcaacggaccaaagctggacagagaatgactttgatgagttgagagaagaaggcttcagaagataaaactactccgagctaaaggaggaagttcgaacgaatggcaaagaagttaaaaacctttaaaaaaaaattagacgaatggctaactagaataaccaatgcagagaagtccttaaaggacctgatgaagctgaaaaccacggcacgagaactacgtgataaatgcacaagcctcagtagctgattcgatcaactagaagaaagtatcagcgatggaagatgaaatgaatgaaatgaagcaagaagagaagtttagagaaaaaagaataaaagaaacgaacaaagcctccaagaaatatgggactatgtggaaagaccacatctacgtctgattggtgtacctgaaagtgacagggagaatggaaccaagttggaaaacactctgcaggatattatctaggagaacttccccaatctagcaaggcaggccaacattcaaattcaggaaatacagagaacgccacaaaaatactcctcgagaagagcaactctgagacacataattgtcagattccccaaagttgaaatgaaggaaaaaatgttaagggcagccagagagaaaggttgggttacccacaaagggaagcccatcagactaacagcggatctctcggcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcatcaccaggcctgccctgcaagagctcctgaaggaagcactaaacatggaaaggaacaactggtactagccactgccaaaacatgccaaattgtaaagaccatcgaggctaggaagaaactgcatcaactaacgagcaaaataaccagctaacatcataatgacaggatcagattcacacataacaatattaaccttaaatgtaaatgggctaaatgctccaattaaaagacacagactggcaaattggatagtcaagacccatcagtgtgctgtattcaggaaacccatctcacgtgcagagacacccatagactcaaaataaagggatggaggaagatctaccaagcaaatggaaaacaaaaataggcaggggttgccatcctaatctcggataaaacacactttaaaccaacaaagatgaaaagagacaaagaaggccattacataatggtaaagggataaattcaacaagaagaactaactgtcctaaatatatatgcacccaatacaggaacacccagattcataaagcaagtcctgagtgacctacaaagagacttagactcccacacaataataatgggagactttaaaaccccactgtcaatattagacagatcaacgagacagaaagttaacaaggatatccaggaattgaactcagctctgcacgaagaggacctaatagacatctacagaactctccaccccaaatcaatagaatacacattcttttcagcaccacaccacacctattccaaaattgaccacatagttggaagtaaagcactcctcagcaaatgtaaaagaacagaaattataacaaactgtgtctcagaccacagtgcaatcaaactagaacacaggattaagaaactcactcaaaactgctcaactacagggaaactgaacagcctgctcctgaatgactactgggtacataacaaaatgaaggcagaaataaaggtgttctttgagaccaatgagaacaaagacacaacataccagaatctctgggacacattcaaagcagtgtgtagagggaaatttttagcactaaatgcccacaagagaaagcagaaaagatctaaaatcgacaccctaacatcacaattaaaagaactagagaagcaagagcaaacacattcaaaagctagcagaaggcaagaaataactaaaatcagagcagaactgaaggaaatagaggcacaaaaaacccttcaaaaaatcaatgaatccaggagctggttttttgaaaagatcaacaaaattgatagaccactagcaagactaatgaagaaaagagagaagaatcaaatagatgcaataaaaaatgataaaggggatatcaccaccgatcccacagaaatacaaactaccatcagagactgctataaacacctctatgcaaataaactagaaaatctagaagaaatggataaattcctcgacacatacaccctcctaagactaaaccaggaagaatttgaatctctgaatagacaataacaggctctgaaattgaggcaataattaatagcttaccaaccaaaaaaagtccaggaccagatggattcacagccgaattctaccagaggtacaggaggagctggtaccattccttctgaaactattacaattaatggaaaaagagggaatcctccctaactcattttatgaggccagcatcatcctgataccaaagcgtggcagagacacaacaaaaaaagagaattttagaccaatgtccttgatgaacattgatgcaaaaatcctcaataaaatactggcaaaccgaatccagcagcacatcaaaaagcttacccaccatgatcaagtgggcttcatccctgggatgcaaggctggttcaacatatgaaaatcaataaacataatccagcatataaacagacccaaagacaaaaatcacatgattatctcaatagatgcagaaaaggcctttgacaaaattcaacaacgcttcatggtaaaaactcccaataaattaggtattgatgggatgtatctcaaaataataagagctatctatgacagacccacacccagtatcatactgaatggacaaaaactggaagcattccctttgaaaactggcacaagacagggatgccctctctcaccactcctattcaacatagtgttggaagttctggccagggcaatcaggcaggagaaggaaataaagggcattcagttaggaaaacaggacgtcaaattgtccctgtttgcagatcacatgattgtatatctagaaaaccccatcgtctcagcccaaaatctccttgagctgataagcaacttcagcaaagtctcaggatacaaaatcaatgtgcaaaagtcacaagcattcttatacaccaataacagacaaacagccaaatcatgagtgaactcccattcacaattgcttcaaagagaataaaatacctaggaatccaacttacaagggacgtgaaggacctcttcaaggagaactacaaaccactgctcaaggaaataaaagaggattcaaacaaatggaagaacattccatgctcctgggtgggaagaatcaatatcgtgaaaatggccatactgcccaaggtaatttatacattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatacaacaaggctacagtaaccaaaacaccatggtagtattaccaaaacagagatatagaccccggaacacaacagagccctcagaaataatgctgcatatctacaactatctgatctttgacaaacctgagaaaaacaagaaatgtggaaaggattccctatttaataaatggtgctgggaaaactggctagccatatgtagaaagctgacactggatcccttccttacaccttatacaaaaattaattcaagatggattaacgacttaaatgtcagacctaaaaccataaaaaccctagaagaaaacctaggcaataccattcaggacataggcatgggcaaggatttcatgtctaaaacaccgaaggcaatggcaagaaaagccagaattgacaaaggggatctaattaaactaaagagcttctgcacagcaaaagaaactaccatcagagtgaacaggcaacctacagaatgggagaaaatttttgcaacctactcatctgacaaagggctaatatccagaatctacaatgaactcaaacaaatttacaagaaaaaaaacaaacacccacatgaacaagtgggcgaaggatatgaacagacacttctcaaaagaagacatttatgcagccaaaaaacacatgaaaaaatgctcatcatcactgaccatcagagaaatgcaaatcaaaaccacagtgagataccatctcacagcagttagaatggcgatcattaaaaagtcaggaaacagcaggtgctggagaggatgtggagaaataggaacacttttacactgttggtgggactgtaaactagttcaaccattgtggaagtcagtgtggtgattcctcagggatctagaactagaaatgccattttacccagccatcgcattgctgggtatatacccaaaggattataaatcatgctgctgtaaagacacatgcacacgtatgtctattgtggcactattcacaatagcaaagacttggaaccaacccaaatgtccaacaatgatagactggattaagaaattgtggcacatatacacaatggaatactatgcagccataaaaaatggtgagttcatgtcctttgtagggacatggatgaagctggaaaccatcattttcagcaaactatcgcaaggagaaaaaaccaaacactgcatgttctcactcataggtgggaattgaacaatgagaacacatagacacaggaaggggaaaatcacacaccgggtttgttgtggggtgggagggataacattaggagatatacctaatgttaaatgacgagataaagggtgcagcacaccaacatggcacatgtatacgtatgtaacaaaccttcacgttgtgcacttgtaccctaaaacttaaagtataataataataaaatattaaaaaaagaaaaggtatattgtcttgccttgcattaagcataaaaaggaataataatttttttcacagatgttttctcttcatatactttacataaagttaatttgctatttttagtgtagtttgagaaatgagagctaagattactgagcacatataccttggctaggcacattgcaaggcacttcatattattttacttaacagtcacaacatgttaagatacataatattgcttacattgtataaacgaagaaagaaaaataattgcaaagaacttgacaatacgcatgaggacgctgctttatagaaaagccaaatatatttgtaatgttgcatgaaaggcttgattccctttgggcccttcacagttttaaagagtgttactgttgaaaattctaattttaatttgtcatagcaggagatttttgtattttatattgaaaaaaataaaatgctttacacagatttaaagagaaagttgataatgtgatgttttctttgtatattagaagaagatttacatgacagagaaaaaaattatttgtcttttaacaaaatcatttttaggtaagttttagaatagacattggtagacttgaaaatatgcattcttgtttcttgtcatatgttgcccacttgaagaaaacttaatagcattgaatctgattttcccctatcaagccagttagtcatattctgaattaatcaggctacacagtggagaaaatttttttccaagctttacaagaagttgtaccatttattatcaaaattctcattttattaaatgaaaaaacatgacatattggcttttcacttctgaaatcatgtatctatgtttatctgtatagacatccacatactcagtatatgtatatacatacactctacagtttatgtaaataaattatgtatttcacatatatgtctatatacaatataaaataaaatttatatactacacatttttacaaataattatacatttacatatgtattaattttatatgttaatatatatgtgtatatatatgtctgtcacgatgtttattgttagaaatatattctgtgatgtgttttgggtgtggtttttgtcatttgcgtgttcagtcttctattggtgctttgcttttaggtccctttcaacagttagtggtatgctgcccccaggtgttggcaagtactttgattcacatgatctcctggtctgaatttacaaagcctgttttaactaaggtctggattatgactttcacagaattccttttgtagttaaaaaacatcttttattaaaatagatgaacagaacaacgtatatacaggaagctggctaatttctatcctgcgaactctttaagaaacaagtatctttgaataatgtggtacctttctattaatcttttactgttgtccatccctagatttatcatagtactttgattagaatggtctcttctgatttactctgacagcctctggtggtcaagtagttgcctggattccaacgtggttcatggtactattatgaaggggtcattatctacatggctttagatgtcaggccagtttgctgttaaaatggttcctttcctcttggattctcagacttggatgatggtgatgcatttattttacctagagaagtaatattattgaagagatggaaggagtttttacttttctcctgctctaactctcccaaagttcctcttgtggtatggaagcaggatagaaaaaaagagagtcaacttcaaattttcttcttcatccacctatgactgaatttcagatgagaatatttttctagtttacactattagaaatagaacctattaatttgccttgtgtttgtggaatttagattgctatagtctcctgcattaaagacaccaaccacatgattgataactaaaaatatagacaaggagcaggtgagatcagacaatgcatagatcaatattagttcagagaatgtttctttgataatgtaggtagaagggaaatagggctatcacatctttggattctcatgaggatcctgagtcatcctaataatgtaaccactataaagtggatgctttacatacgttctctgcaatcctctaatttcctggaaataaaaaataaatataaattacaaatagaaagttaattaaggattagagttttaataaattggtccaatgtcacatattagaaagttttggagtcagaacttgaagtcagttcctggtgatttagtggctagggagaaaaagaacttgaactcaggattgcccaacttcattaccctccctatttccaatacaggattttctttcaagtttggggcattttctctctaggagagatttttttaaagaagaaaattggttaaaatatttaggaatggagattgcaataattctagaagtgtcttaatctgcagctattagcagctagttagctgtcaaatgatttatttcaagtgagtataatttactagttgaagttcagttcagtattggtggtagaggggcaccaaaatgtggtagacactaagcttccagaggattaacattttcactttgtgaaataatactccatagactcttcaaaattaaatttcattttcttgtttttgtttttctcttttctctttctggaacatctgttagtctgtcagaagttgaatatcctggttctatcctctatggctcttatattttaaaaatatttctatcttcttattttatattctcgtagtttctcttcactctttgtattgaaatgctttttattgtagtaatattttaatttctaagaattgcttttaatttctcattctcttttcatggcatcctttttaaagtttctgtgttttcttatagtttttaaaactggtgtttaacaagcaaatattataataaacaattatttaagttctctgaattctctttcgttcttctgagatcttcatatttttttcatttgtttttgttgatcctttttttttatgctgaaggccatggaagattatattttccaaaaatggccacagcaatatttctgatcccacaagtgcttctagaaccttgctactcccatatcaagatgtggagtctatttccctctttttgaaattgaatgggcctttgtgaagtgacagtgcatggcttttgagactatgtcataaagacatggcttctgcctgattttctttctctctctcaattttctctgttggaaaccagccatcattctctgggaaagcctgggtcacatcgtgaactagggataatatgctcagctaacagctcagctagggtctcttgcaacaagctagcatctcatgcaacaagctagcatcaaatgccagacctgtgtgaatgagccttcagatgacttcatataccagccttcagctgaggctccagataatagggaacagagactagcagtccctgctgtgccatgctctatttcctgatccatggaatccatgagtctaatcacagtagtttgacaccattatgttttagattaatttgtcgtatgtaaccctggaacacatgacatattgttctaaattgtaactggaacaaaggctttcatcaaatttatgaaaagctttgtttgatcattcacatttaagaatgaagaaaaaaatgctaactaggagctctttgtatatagttaagagttggtggctggttggctttcctttaggatggatgggctatgagcttgctgttaggctgggcaaccctcaaatgaatatgctggtccttcctttttggcaccaccactcgtagctagttgcctattgctcccttagagatctttcaatttttatttgtttttagtttgttttatgaaataaataccttcttttttctcccttgcaggtaaatgtctgcttacagttttgtatgattatgtgtgtgtggaaggggggacatgtgggtgtggttggttattccaagtatagtcttttaattaatttctatcttctacagcttgatttactcccaccttgtattgtagtggttttacaacttgagcctcttctaggttgtagaccattactcctcttttctgtacacatctcctacatacactctaggttgaagattgaagctttcactgctttctaaaatggaagtttgccagagaagagtgtcatcttgaactagactttagaccttcttgagtctgttgcttgtttattttcgtagaaatcttctattttattcaagtttgaaagtgtttcatatacacctaggggaatgccatatctttccttataattattaaaagtttccatgtatctgatattgtcacctgttttttattcctaattttgcatctttgtccttttaatctgattcagctagcttgtgagggtgccctagattatgtttcttttagattgattaggccacttgagttcaaagaccttgtgatttttgagcctttagtttgttgtagctgaataagcttttctgcttctaagtaatttttttgtgtgtctgagcaactcatgttagaattctccatacccgatctgctttcctctgggtcagaatgaaggaaaaggattcatcttgttatttcttagaatccatttttaaaatctgaggtgaggacctttctttcttagaagtcttcaatagtaggatttcatgacagagtaaatgtagaggatataggaatagaaaggaataaaagatgaattaatattttacactgtaagattaatagtactgctaacaacaaagagatagggcaggggaatcagtttggggaatgtgaaaaagatgatttcagcttttcgttttgttttattttgagatgatcataaattctagtgaggaaatgcatagttgttggttgtagtaaagtgttaaagatttaaaaagtagatgaaacatcttgaaagcatgaaaggaagagcaaacaaatgtaggaaagatctaaatttggaaggcaggaggtaaaagagaagatacagaaaaaaaaaaacaggacttagaaaagtgatacgtgaagaattttattgagaaagtgttcagtaacatccagtgcccatacatattaggtgtttagtttgaatctattttgaaaacttgtttaaaataattttgcttattgtatatttttagatttatatgtaggacgtccttagaagaagatagctttcaaaagaaagatttacttagcaagtagctcttcctgggtcaaaacacatttcatcttgtactggaagaaacagatatgcatagatttaagtgcaatacagaatagagaggaccatcattctctatagggtgctacagaagcctgcatattatgtgtaaaagccgtaggttgtcaaagaatgaaaactattttttcaaactacaatgaaaatgatttttctctgtaatattttttagagaaaacagaatgaaaactgttttttcaaactggaatgaaaacgattttctctgtaatatttttctcttttctaaaaataggtcagaaaatagcttatgttgatggaaaaaataatcagggtttttgtatctttagttcataagtgaggtttctccttcttgactggcatttggaagactgggaactgtacactggcatgttgagtcctgtctctgctaggagaatggtgagtccaaaggccagatttcacacggcaaagaatggcaggcatatttattgagtgtttactatatgtttggctctctgatcaatacttcaaatatattgttacattcagtcctcacagcaacctatagtatagacacccaaatttccttttacagattagaaaattaatgctcagggatgttagtaatttgaccgtttcctcaggtagtaaatgttatagcaggaatctgtatttcaatctattggctcttttattacatctgatgtgtggatgggaagggaaagtagtagatataggtttttacctttgagggattagcaaaggcagaaagaaaagccgatacatgataacttgagggaagatgatggccaagtgaaatttacagaaattaggaccacttaaatgtgtctaaaatgaaagccttgattctgaaaacatgtaaagatgagaagagggagatgtgaagaaagatagaaagacttgggattggataaacagagatgtgaaagttagtaatttttgtgtctaaagcatctaaaatttaaggtgctataagtctgattcccatgtgttttccctctttagtgaaaatactctgcaaaacttgctatgcaagagattcatattatatatgctaaaagaactatgtaggctgggcatggtggctcacacctgtaatcccagcactttgggaggccgaagtgggaggattgcttgagcccaggagttaaagaccagcctggacaacatggcaaatccccatctctactaaaaaataaaaaattagccaggtgtggttacatgtgcctatagtccaagctactcaagaaacggaggcgggaggatcacctgagtccagtagattgaggctgcagtgaaccatgattgtgccactgcactccagcctggacaacagagtgagaccctgctcaaaaaaatgtgcaataatggtagcaaatatggcatttgctataattatggcataatagtaggcttgttgctgaataaatgagattactaatgataatctgttttcttcagtagcgaagttggtgtgcctgtgatttgttgagattcatgtcagtgttcctcaagcagtgacaacaactggtagtacccataaaaatccttgctggaatgctgtttgagatagctttgtattttcctaagttactaaggcatcaatggaatatttagtttaaattaaatatcattatgagaaagtgtttttgtttgtttttatggtggtggaaacttgtaggaagtaagacatgaaagactcatctgatctagatgacctattgagatttattttagttttacatgttataaccagcagaggtttcacaaataacctctgtagtattataattcatatcttattccagttacagaagaaagcaggatattcattttctaacttttatgttactatatgcttattacgaggaaagcatattaagaaacagactttcccctaaacaaacaaaaccctataacagctgcctggccttttcaattgattctaatgatagtaaagtccctaataataggaagttcagacattgagaattagatattctcatttaatgcaatccgctttaccatgtagaacaatgcacccagagtctttaaccgtaatgtcaaaaaggagataggaaaactctttttctttgaaatactgattgttcattattgagagtagaaagtaaagtgattggatattgaaggataatcaagaatctttggtattatgcatatttacagttctgtagagatagatttcaaacactggttaagagtggttagaatcttaattgcttaagaattgttagaatcttaaatatttagaaattgaacatagagaccctgttgaagaatgcctgtaaagttgaataattcattatattataaatgagttccttttggctgttcagcaattttggctttttctacctcttttcttatggccatatcttaatttttttttttttttttttgagatggattctcgctctgccgcccaggctggagcgcagtggcacgatctcagctcactgcaagctccacctcccaggttcacaccattctcctgcctcagcctcctgaatagctgggactacaggtgcccaccaccatgcccggctaatttttttttgtatttttagtagagacggagtttcaccatgttagccaggatggtctcgaactcctaaccttgtgatccggctgcctcggcctcccaaagtgctaggattacaggtgtgagccaccatacccggcccttaatttttataaaaacaaaactgtacttcgtaagtgcttaaaaaaagttagcaacttcaaagataaaatgcaaacaaagctaaaaaatagatcatgtaataaaagagcaccacattaggaatctttagagctgaagaattaaaacacacttgacactttcttaatcttcttattctattaatgtatgaaacctagaactggaagcttactggtattttttctgcattgtaattatactaataaacatctttgactgtcaccttggaatttacagtgcaataggaaagatttattataagtcaatgctttagaagaaaaatgggattattgcacaagtggattgcatgttaagcacatgtacccgcataccatttgttccagttagttttgagctttaacttgtctttaggttttctttaaaaaacagagagggttcttattaaattcagactcctgacagatctttgtaatattattgagtcaactacaaagtaactactttaccttgaaatgtgcaaaaggaatcaataggcttacaaaactgccttttaaaaaatgtttgtaatcatatttttcctggtagcctgaatatcaatgtgtatgacctttcttggtttctttctttctttggttttgttgcaatattaaagtcccttatagttagagggtgtttgagtattttggttttgatttctttttttgtcccctgtgccagcatcttacttttttgtcttttttgtttgtttgtttgttttggtaaagaagtactacttacaaggaattttccttagggtgtctttatttttcaactcaatcaacttttcccatgatcttctttttctttttgttttaaagtcaagtctataaagaattttattttttaaacttttggtgtgaaatgccatagaaatgccaaataaatctacagtggacattcaaatggtgagatacaagtcaaatccctttctcctttaatttgaccttatccagctgtggttggcatttgagctctttgtgtgccttccttaaatgaggttacattttcatttgaaatacagtcatgtgtcatttaaggatggggctgtgctctgagaaatgtgtcagacaattttgttgtacaaacatcatataatgtacttacacagacctacatagtatacccttctacacacataggctccatggtaaagcctgttgcttctaggctacaaacctgtacagaatgttactatactgaatgctgtaggcaattgtaacacagtggtaaggatttgtgttatgtgaacatagaaaaaatacaatagaaatatggtatagaagataaaaatcatatacctatgtagggcacttaccatgaatggggcttgagggactggaagttgctctgagtgactcagtgaatgagtggtgagtaaatgtgaagacgtaggacattactgtatactgctgtcgactttataagcactgtatactttttgactcctttacaacacttagcttaaagcacaaacacggtgtaaagctgtacaaaaatattttctttatattcttattcagtaagtgtttttctctttaaaatcctttttttaacgtttaaaacttttttggcaaaaagtaagacatgaatacgcgttagcctagctctacacagggtcaggatcatcaagatattagtaggtgataggaaattttcagcttcattataatcttttttttttttttttttttttttgagatggagtcctgctctgttgcccaggctggaatgcagtggcgcgatttcggctcactgcaacctccacctctctggttcaagtgattctcctgcctcagcctcctgagtagctgggattacaggcacacaccatcatgtctggctaattgtttttgtactttttagtagacacagcgttttgccatgttggccaggctggtctcgaactcctgacctctggtgatctgcccacctcggcctcccaaagtgctgggattacaggcatgaaccaccacacccggcctcattatgatctcatgagagtactgtagtatacatggtccaatgttgaccaaaaccttatgtggtacatgactttatacatttccatctggaaactgaagtgttcaaatatatgtaaactatttggaattttgtaaatgatattcatttatgttgtgccacttaaaatctgtgagtgaagtttatttttgccattgttgaataagtctttcatttctttaaataattttctctgtaattagttgaattggtaatatgccaaaatactttattaatacaaatatgcaattttattatcttatgacttgtatttgctttagtggtttgttttattattaactacagtgaggattctttgtaaacttataaacctccaatgtggaggcttaagggactatgtaaattttgttagcatttgtccttgcattagataaaaatagctaggatttatttccttgccacttggctaaataatttgcagataataatttctcatctaacttttaaaacaattttaaaaataaatattattacccatcatttgcagatgaggaaacaaaggtatagaggatttaacttagcccaagtttcagagctagtaattagtggagcaaggacctgaacccagagatgtttattgagaatgacaatactgtagtaagactttctctcttagaaaaattattttctttgaatgcactacaaaaatgacccagactgtatagtataattacagatattccaaggttaactatgaaaatacttgttgtttcagtgggcccaattttaaattaataaatagtacattgtaacctaaaggactaattaaaatttgttcactttttgatcatgattattttagttctcattaatctgagactcagcaatggttttgtttcagaaatatttaatttaattgtcatcaatcatagtaaccaaccttagaatattacatttgtagtggaatgaggataaatttaaatgtctcagtctttggaggtaattatctaattatatgttcatatttctagcatgattaagtggcaatgtttaattcattttagaggtaattttaccccatgtggggatatgtattctaaatcattatacctttctgtttatagaaaacatttaattaacatactcaagttttatttggaagtttagtaatattgcactgttatatcacatcactacttaagatgttatttcggaaaacaccattatttattaatcttaacaaattgcattttattttagtatattcacaattaagaggctacccaatggatatgactttataatgctttgatcttatggagtgctggcgagtattattttctatgttttagttcagaaaatgtataaagtagtattaaccttgataaaattagaatgcctgaaactgcaaagggtaaagcatatttgtcagttttatcttgtgctagcaaaagcctggccaattgccaaaatgtggttagggacgtatatgcactctacaaggattattgttaagggcatctacaaggaaaatcactatgatagatgaaacaggatgctactttatggtggttttatcttattttaggagtaaaatcagagtatcaaagcaaaccaaaatcatcaaaatcatttctgtgatggaaatagaattcatctgtttttctgatctatgtcctgtgacacagaacatagagtccttgtggaattcagaaaatcatttatctgtgaagaatgttgatttggggtttctaagctgtgtcatggctaaaagtcttaaaaacaggcaactttaattggggagagggtttgacaaaatcctgggaatcagatggatatgtattatgatgtgactattagcttaagaaatactaaggccctatttattccctagagggaaacaggtcattgaaatatttccccctcaaagagttgaataaatgatagtgattaaatttagttgcatattacatgtatttgtatttatttaccatttgataaaatgttatataactgagcaatttcctgtctttgtttactagagcacattaaaaatcagttttaattactattatgatatcctgtgtctaaatttaagattttgtgatgaaagttgagcttatgaagattgtatcaattacatttttctcttttgagttggagtttcgcttttgttgcccaggctggagtacaatggcgtgatctcggctcactgcaacctctgcctccctggtttaagcaattctcctgccccagcttcccaggtagctgggattacaggtgtgcgctaccacacctggctaattttgtatttttagtagagacagggtttcaccatgttggtcaggctggtctcgaactcctgacctcaagtgatccacctgccttggcctcccaaggtgctgggattacaggcatgagccactgcgcctggctgtcagttgcatttttaattacataaagtttatacatattatattgaaagtaataaaaatattaacaagaaataagtgttgtcattactattttggtttatgcctttcatatttttaagtgtacctatttacatatatacatgcatattagtaatttatcatatgtatattaaaaatagtatgttttacagtatggtacccctctttattttgttattgtcttcaatttttaattattaaattatttttctataatgtccttatatttacatactcacctaagtctcagatgacttgctgtgattttaatatttaattaaacttcatatcttcccccaatgatccaatattaaatgagcctagacactgattttctaaagtatctcctgatgacttcatagttatataaatattaaattgccaaatgtagaaaaatgggttaagataccctctcctatgttgcagtgacaaataactctaaacagtgactttacaaccacaagtgatttctcacacattatgcatattcatcatgggtcagctgtgtgcttctgcttcatatgtccataccccatgattgaggctgatagagtgttctttatctggaacgctgttggtcttgttttattttatttatttatttttgtttttattttttgaaacggagtctctctctgtcgcccaggctggagtgcagtggcgccatctcggcttactgcaagctccgcctcccgggttcacgccattctcctgcctcagcctcccgagtagctgggacaccacgtccggctaattttttgtatttttagtagagacgaggtttcactgtgttagccaggatggtctcgatctcctgacctcgtgatccgcctgcctcggcctcccaaagtcctgggattacaggcgtgagccaccgcgcccggccggtcttgttttaaaggtgtctacatgggacattgctgtccttttctccgataggaattgacattttgcttctagtcacatttcattggtcaaagcaagtaacttgaccattcctgattttgacaggacagggtatatataatcttctttccagaaaggacaccaccgatttacatcgtcaaatttcgtatcagtggaacgggagaatatactttcccctcttggagaaggaacaaatagtttgaccaataataaaatctactgcggtaacttatctttttcattatataatgtatagaaataattaatcttctttctagttagccacattggccaaatttggtgtaacttgacattttaacatctgcaaccctcttcactagtttggtcagtagggttgaaaatagttatctccgggagtcatatgtctggttgatgcttttctctcttgttctagaggttttttaagtataaaagaaaaagattcttccgtgtattatgctgtttgttgtttaagaaaatttgaacgttctacaatatgtactcagtgtccaccacattccacagagcattttctaggctccagaagccatattcctgacattttaaagcatcaccactagatggcgatctcgctcatttagaaggttagaacaactatgtttttcttcaggtgaatgggttggttacagagggatcagaagtgtaaattatactaattttatagcaagctctttgtaaccaaaatggtactatttactgagtatgtatatattcatgtacatatatacacatacacccttatacaggaaaattccatttgaagaaaacctataaaatgctatgttttgctatgttacttccccagaatatatatttttcaactattactgcctgaacaaatacaggggttttcataagcacaattcctcaagaaactgcccagaggcttgagtccatccctctgccttgtcccaacagtactttgaatatgcttccaactgttgctgaaactggttgatttagttgtgagccttcatctttgttttaacaactctgtattactcagcttcactctctttttctttaattaatacaagtgaagagtggttaaaaattatatatttcactcagatatgttaaaaaataactttcatggtttattgcacgatgggaaagccggtaccaacccttttagaaagccttttagaaatctcactcagtggttattgccagtggtaactttgttctaccctcttttacttcaaaacaacacaacttaataaccgaaaacattttaaaaccatagccgaaatagtgtagttctccttataaaacaattactgagttcaattgttaatcctctttttggtgttcctaaaataatattcttttcatttatttctgctatgatgtagggtttatggctctctatcatataattcatataccttgtaggatttaataattaatggaaatagaaaatatatggctagaatgtgcgtttataggaagtaaatatttaatatatactctgagtaacgtaaaagtaaattttgatataatactctagcatattaaggaaaactattataagccagttctttgaaaatcatttttaacatagtatatcattgtatcttttactcacaggtgaaatcatattaaaccttggttagaattcttctgaaggtttaaatgagctatgatgatatagccagaatgacctcttgtatttctttaattagacagttatagtttatatatatgattcccaaacagatcaaagagggctgcttcacagcctagaatccttcagaagcttcccatggccttctattacaatagttggcaagtatatttagccaaagaaccctttctttaaaaaaatcttccacaaagttcatagaaaacattaaagcaaattccagtttaaagaaggatgggagttgggagtccactaattcaagcatcctcttcaaattttgcccaggctggtcttgaactcctggcctcaagcaatctgcccacctcagccgcccaaagtgctgagattacaggcattcaccaccacgcctggctggataccagttttttaaagatgacatttttgatttaaattaggcacataagtgtcttcttacatagcagctaagatctccctaactaggaagaggtagctacagatgctgtattattgagcttggtatcttgatatactgttgtgatagggtgggttgctgttacaaatattaaaaaggtgatactatgctaggcagtcaaattttaagatctacagggaaagttaagtgctgttgttgccaacttataaaggaaaggtaaataagtccattgctttttgaaaggttaaaaaaagcaacagcccaatgtgtcttgagttatataaaattctatactacaatggagtgctgtacaattcatcatttctttacaaatatttattttttattagtacatttaataagtgatgacagtgatcctactttcacacaagggatcttgagttgtacattcttcaatgtttgatgttgaaagtgtatccttaaataatactgaagctcttattggactttaatataagtagaaagtaaccatttaaatatattaaagtaccttactaactttatggagtttgataaataagagaaatattggttttacatttccatggtgatttcccagttagtagattttatggaaaatctgaagacgttgttactaatactactgtagtacagagtttagaggaaggttttagattcagaagaagggctcacattttgacataaacctatttactagttccatgactttggggaaataacttttctgattcttagttttctcgtgtaaaacaggaatggtaatactatatacctcactggattataaagaatcaaatgaactaatgtaattataatatgcttgagttataatgataataatgacacttagttgttactcaagtaattttcccccctagtgattataagggaaataacaacagcagttataatggccagcatttgttgaatacttacaatatgagaggcactgttctgtgtgtacaagaaaatatgtggaacactccccatagtgaaagttagcaaacatttgctgtctagaattttttcccccatggacatacttctaaaattaatatagaaatcagtagtaaaatacttaatgcacagaaaatcatccagtgaagaaacttttaagaaaaaactcaaaactttgttttatttacatttaagtctaaaataacctaaatttattttcccaattttaaatttgaccttcaaattctcttaaataattgaattttattgagttggtatttgatttacttttattaaaagtagttaatatataacatattcacgttaaataatggccatttaaattctgtagtacagtgaaaatattaatgtaagagtattttaattattaataggcttatttaccctattattcacttctatcaccaaaacaattctcgaagttgaaagatttttttcaacaaagttttttatttaaatattagaaacccaactatatgaagccctttataaattattcacattttttcaaattcttttcagacatttgttttaggtaattctcaaatgattttaaaacagcatttaaattctaaatgatagttttttacaacttaattcatagctcgactcgtttaaaatattgccagggaattcagcaattttttggacctccacatagctggggttgtcagctctgggaagtttttgagtatgctatagctgataaggtccaacagaagagcccatgtgtattctgtccccttgtatttattaggtatttgccaagagaatgtagaggtcatataagagctgattttgttatagcagcatcatgatggttgtcatctgcaggtagtttctgtctcatgaggtctgcagtgcagccaaactcagtttgctttatactcagaaaacattactgtcacattactgcttacatgtcgtgtgtcacaataaatctagctaccacttttctattttgtacttttctgagtatattttccagttgagagggtttttgtggttctctttactatcctcctttttttttgtcatttaaaatgtgtaactatttcttttccactttacttcactgttatacatttagtctatcacaaagagttttgtgctttatatgcgaggcttagaacaaatagcattcaatatattttgaatactcttatgaagttcctttttattccattatattttattattgatcactttcagttagtttactgggaagaattagcttttttattttatattgacaccatttaggaagacattttcaaaggcatatatgagaatatggtacagataatcatgaggcattatacaacaaaatcttacagcatacttggaaatttttaaggtgaatttccattgctcatttgccccatttgttgttaatcatctgtcacatggcctatttataaaagtaacgtattttacactcttctttgttaatttccttttatctttttcatgtgtgataaaataattttaaaaattatacgtatttgtatgtatatataagtaaataaatgaggcagaaataatataggcactcataagttgtcatatataggtggagatttaaagaacagtctgtaatgacgttacatgtagaagtgtaattattaatcctgccttttacatttatgtagtcttttacagtttataggataccttaacatctgttgccttactagacatgtgagttctaactaagactgccatttatttaaccctgaaagtgggtaagttatttgagtttcagcttcagtttataaatatgtcacctactttctgtgtaggtattactagaaaacaataaaagatagtatccctaaggaagattaatttaaattacataactttgtatttaaattcctcatataaaatataagataccaagatcgaaatttattcagatataaactgtactatataccaacatcttttattgttgtatttttattgtaaattatctaattgtttatcttacagattttctggctttattataaaatatattattctttagtttcattcctaacttgcttacccggccctattgtaaatttggttgttgtatcattttatgtttatagtttctgtgacaacctgtacagtttgatccacctagcaagtatttaattaattcttgattaatataattttttagttgttacataacagtagggctgaagacagccttatttccttttcaaacattaattttactaagctttttaaccaaatttattgcaatctagagatgtttaaaggaacagtcagtcagcaataaatttatttttctttaaatgttatcttttttccccctgcaaggaaatgtaacctagttcttataacacttgtgttgtcttgcctttcattttgtatgactaactttttataccaaattgaataagccattagcttttagtgtgtaggaatgtagatccatagatatttcccattagacaaaagaaaatctataaaagcaatatcccctggggcttggtcttcttagcggcctaatggtctaaagcactgctatactgtacccttatgagaaagaactatgttgggtgattcgcttggcatccagaaatattagttgaagagatatgcataccctttaagataactttaacgtttgtactgtaccacatttattaattaaatattccaattcagggaattcattcataaattttttatttcaaaaatcatttctaaacagaatgatacactttgtatatcttatgcagttttcaactagagtttgctgaaactgagagataatattatttagatagccacattgttttgataaggttttttttctaaagaattttacttcaaaaaagacctctattggtgatagttgtacaactctgtgaatacgtactgaattgtacaccttaaaagagtgaattgtttagtatgtggattacatctcaataaagctgttatttaaaaaaattttcattgcacaaaatgttttcataggtgtgagataatagaatttcaatttattttataattaattaaaaattattagccttaataaacgtttgaagctttagaaatataatattatgtatgacttaaaataatttttgctgttattcactagtaatacatgcttattatagaaacttcaggaactatggataagaaaaaatacattgaaaaaatgtgtgggtcatttaatattcacatttaccatgtattctattcctaagcttttactatacttcactacttcctttgtatccatacttttcctgccagctttcattaatagtaaatagcttttcatgatcatttctggaaacaatcaaatgtaagtattttcttataggagtagttaagtgaaagcattggttttttcttccttaacagagaaaatgaaggtaagcaatgacatcattatctaaaaagaaatgcaataaagatattatataatagcttttgaaatacagtcattttgggataccattgtaaaaatttgctttaaaacattttggatttaaaaggaaaactggaaatctttgataaataatattgtgacattggttcttgtgtaggtagaatatttttttctgctctttaaaagactcttgttatcatatctagccttaactttctaacagctaaaattgttcacaacactgtttaaagataaattcagtatcaggctttgaatttttttttcttggtaagtattaagacctgagtacaaaatgagggctgtattgtggattaagtgaaatatctcaaggctgtgctgttctgataactgaacctgaagtgacctttctcagacacaattacagagctgtatgtttttcctttaatttcatcaggggtttaattagtatacaaataaaacttcccttatcttcctttctacctaattggcttgtcttcacttatatatgaagtatgtgaaagtgggctgtaattagggtgaccgtgttaaccttttttcctcaaatgtactgttgcttaaaggcctcaaggcctaaaaacagtgctttggattattgctttgcaatcactatggctgtcccataggttttctcatgagcagaagggctttgggtgctgcaggttcccactgcttaacaggatcttcattcttctccccactaaatgtttattgattatctcgctgttccaggctcagcctccaacaacttaatatcaggtgacagtcaggagagttctccaagtaattagagttgagcattgggggaacaattaggagcagagttattaaacttgatttatcctattctctcctgaacagtttcttggatatcagaacatcacactttcacaatctaccctggttgagaaattagtggctaacctgctgcttatcattgttgccttgttgcctagaggcgcgccctcttggtttgtcattcagttggaaatattagagtccataaagtttatcatgggttttaattagatcaatctgaacaggagaaaagaaaagctgaatttaaaattatatgtgatatatggatatatatttataaatatatatgtgatgtgtatatgtatgtaaatatatatacacaaatatatttttctttaaagctcagtgttaggatttttaaatattctgtttttgttatttaaaaaaggttaagtattagggaaaagacgtattcttgaatcacggtttatgtcttggtgttttacacacatccccatcaatcttaggacccactgatgtattttatgatgtcattctcctcttttcaaatgagaattctatgtctataagttataaaactgtgatcttttttccaaaaaaactatatttttgttttcatactcaaggaagtatgaattatatcactttgtttataccactttttgtttcttttctatgcccctgaaatagtataagctttagaagagtttgatgactcctgtcgttgcccctgagacatgaaaatgaaagaatggaaacgagaagatttagctatgtagtagaaattctaatgttatgaggtatatcttctttgaaagtatatgataggattgttgaaaagtcaagtgtgggtttatgataatttcaaagtcatggattccctgagattggatcaggaagcttcagtctggataaggttagagataatatactgaatgctggatagtcccctcaccaatatgcacctctagtcataagagttattgagcagaagaatttgaatggactggcacaaatgtattgtttttgttggaagaactcaagctttatccataactggtgttggatcattagtttgatcttcatatttgaaaaattgatttttttgttgcttgaaagatgtcagaaatgctgactttaaaaggaactcaaaaggattttacttttttaaataaagaaatcttataatgctttagtgtctttatcttagcattggcacaaaattagtaggtttagcgtggttttaaaaatttattctttgccatctttttaaagttggtttgaatcagtgactatttctgtggtggaacgtttgtgaagatctgttaatagtgaagatttaaaacaaaatacaatgtctcataagtagtcatagtttgtttaattttttgatttatatttgtttgacggtaactcgactatttgaaaagtgaatgactgaattttaaaactttcaacatttaaaaatacctggtttgactgatgatggcttgcagttcaccagcatttagagggaattaattggtttaacatgtatgcagcttaagttttttatactattcttttttttatactacccattgtgaatgcactaaaagaatactgttagaagagttttacacatgaaattataacatttttgtttattctttactagatatttgaagcacagtgtggatgttaatgtgtggctaaactgagcaagaagaaaacattatgtgtatgcactcaattatttagctcaccatccaacaaatttaataaaaaactgtttgataagcttattctagaaattttttcggcaaaggagtaagaagatttttagtgctaagcgatcctctgatccctgtactattttgtatcctagaattttaactgaggtctagaaaatacttctctcaattgtgagcttctgattctaagccttcagtgtaaagttgcacaattgcatcttgaaatttttgtgttaagtaaatatttcagattaaagtagatagcaaatataaatcaacagatcttgtacttctgtgactaagaaaatatttacagaacacaaataattctgaatgcaagtattatttataactttattagttaaaacatgttgatcctatttgtgttgctatccttgacgtgagagttatttactgggaagcaagtagattttattttggagtccaatttgtttgtttgctgaaatgtctatagccacctaactatatatttataaagacagtagtggtactctttcatcttgggtttaccattttcttatagatatcctggtctatcattttctcaatcacatgcatagtttgggcatatgatagttcttaactctaattctatttggaataaaattgactctaaatttcatgtgctttctcccctgaaatctttattttttcatcattaaaagaaagtacaacttgagatttttataatcagattatttttagtaagaatacaatttgccttgcagtatttgaaaaaataaaatggaactgtattttgtaacaatttcccaaaccttatcagttctatcatttctaattagtacgtatataaaatttttgcagaaaatttgttaaactttgatgtgtaatgacccaagtctacttctcagtcagtctgtattcttctttgtttaatagcctatggcataaattgaagttaattatcagggctgacaagtaactctgttttctgtctgcttgcagagtctctccgaggcaaagatggagctgagaagaaaagatcaatctctgcgtcagctcaatagacatcttacccagctggagcaggacaagcgtcgactggaggagaacatccatgatgcagagagtgccctccgcatggcagccaagtgagcatttggaccttggggagatcacttaaaacagacaaaagatcaattcttactttcatgctccgggttttagccctggataatacagtgttagaaaacaaaagtacagctgtctttctttgaaattctctgatatatcctcaaaaaagaaaaactcttaacatactaaatgtatattttattgagaaacctcagaaaagtataagcttctatgtaacctctaattatgcttattttgggctctgttacagtgttacatgttagaaactatgttttattaatgtgaaatgtaagactctaaaagttttgcatagtatcttctgttatacattcctattctcttctgctccactgtctccgaaattttgttctgcatatattattatatactaatattgcgagtaatatttccataaagaaatgttagcatacaatcagcatgtgtatcatagcatttaaaaaatacaataaaacatattgaccatggaaaactcatttaatttttatagctgtatattctaatattttaagtagaaaaatatagttttcagagtagaccactatgtaaatgtgatgaaagtgtttttccttttttattttaaaccaggtaatcaagttgacatacattatgaagttcacattgaacagttctcttgggcatttttatttgttcctcatatcaaatttcatggaatactttaaagacagttctttgtacaacagcatggcttaaagaaaatctattttcaaggagtaaagaaacatctaattttgataaacgcagtgttttctaaatttagaattctgaatttctttacttgcaaaaatatacgttaaatattttttgagacaaactcttaaacataaaatatcgtcagatatgaatatagtctgtaaactgcagaatgtatataaatcactgaacaaggaatccacaatcttaggatattcataagctttgccacagggtttgtgacattgctcaaacataatgaaaacatgaattgacacaaggccaaaatgttggcatgtttgaataaccactgataattttttggaaaattgtaaagctatgtaacattgcaccaccatctgaggtgtatgtttttgtcattttttaaaatataagtttgactaaatcagtttttgttgttattgttcactcccagtttcatcatgtcaaatgagaggcttagcccaggtaatttccagtgagtcttatagcactgagaaaattctgagatgaatgaaaataggcttataagacctccagattcaaattgtattttcaaaacattgctgttaattcagtgttttgacatgtctatgatctgtgaccacgggcacatgtttttataaatctaaagaaagctaatttgaaatctggagactaatacattatttacagttttaaatttcaatttacaattagatttttatcttcattattttcattcaaactttttatttcattatgaaggctaaattcaatatactaggctgataggagaaactagtaactttgcatattcctagacaagtcacagaagagttttctgtgtaattattatagcataaaaagaatgtgtggaaaggaaaatactattttgcatagcatggtcatttattatatatccccatcactaagattttttaagtctttttcattagaaataaaagaataaagttttaccatttacagcacattttaaatgatcaataatgtaattgtgatttttttctttgtttttcacttttttacctttttattctcccccaccccaatttaggacaggcaacaaaatttaagatattagttaaatgtggaaatatatcagtgaatatggttagtttttatagttttaaaaggagaacaatgaattaaaaaatcaaaatttaaaaagttaaaataaattaaaaaaataaaaggagaacagtgatatcagacccttattttttaataccagtgacttatactaaaatgtgtaacagttgtagtaaggtttgagttttactaacacttaatcttttattttttctagagacaaagaatgtgttgctaatcacatgagagcagtagaaaatacgcttcacaaggtactgttatttttctttaatattgttcaatttgtgtcatgacacctagtcattatttttattagccacaaagtactttcattgattttgaaagttaaaaaaataaattaacaaaaagatgctttgtagatgactggaaatttccattacatggtgctatattgcatgctttttttcagaattcactttatatatctataaaactatgaaaatagtggtttccccaaactggtgtaattgcactaggaattatttgcggtctttgctgaacaaagcagaggtcattaagatccttatatgtctcataatgataaaatgttttaccacagtgtctaacctcttaccactcttaaaccaatggtcctatatatatatgtatatagagaaatatatattttatttagtaatactcatatatataaactaggtagtaatgttattcaaattgaaattttctttcttgtaagaatatattcttaaagtagaaatttaattatttaatatattctattgttttcaaatttgattactcctgtatgataaactctgagtgttaatttgtagtgatgaacagcataataaaagtattatgatactagtaaaaacataatatatttattgaccatgtattttgttagcactccactctgcattgaaagatgtgttcattatttcatcattcaaaagtagagaaacattgtttatgtgtttctgctactgtctgaaaggcaaattattagaaatgcaaacattaagtactttaaagatacatggaatttatgaatgaatcacatttagaataaccttgtgaatcaattttttatataatatcattttataagtcacttaaaataccctaaaactaaccttttgaagggcatattaaataaaattagcaaactaatagttaatgcattttaacattttaaaaacaatgggcccctgtattcttttatattttgacagtgaccagcattatttcatgtcaacaaaagtattttgaaaaaaaaataatctgagtgctatttcctaagcttctttgaaattattatttctcccccttcccatttaaaaaagtttagctagtcagtatagtttaaatatagtcacattaaagtcatatgtgccacaaatctgaaatttagatttgcagtgaaagagacatctttggtatgtttttttgaacttggtggatagaaaagtcaattacgtcatatacatggcatacccttttatatagttaatgttgactttgaaatccagttggtttttcatcatcccagttggagaaaaaaagagttagatagcagctaacttggggaatgaacttcgacgtcagggaaaaaccatcaccaatatgaaatgtaagtgttgtaccttcttcttttcttatgaaaatggcaaaatatatcgtttaaatataataaagactgactgcaacaggatgattataatcatacagttcttcagttgtagttcatcttttgatttttgtgtcatatggaaagaaagctgtctgtaaatctggtctatagccattgtagatttgcttttgctttatggcttttcctctcttcagatttagtagttaattattttgatttatgtctttagaaaattctattaatatagtggctttaaagttatgaattacttttcaagcttgtagtgaaaacttaggaaagataattggggataattctgttttctgtgaggtatgagtgagaatgaatgagtgataaggaggtggcccagagagtcctctgaaagtctcaggaagatgcaggcccacctgtcttcgtgccagagttcaataggtttatttttctggccaccttggacttcccattggcattttgctgtctttgatgaaacaaagagtagtatggaaggagggtccaggctctttcatgggatggtaaaaatggatatggatacatccaaactctttaacgaagtttactgtgcaccgtaaaatagtatcactatttatatttcttactgttttaaacacgtgtgttttcaaggtttgtaccattcattctagaataaaactaagtcttacccgctgagttgaattttaatactaacttctgacacaataatcaaatagaagaaagaacttgttttcctgcagacgttatttcttttcttggatgttaaggaacttaacctgaacatatttgttcttaggaaaaacaattacattttatttatacttgttagtttttaagcaacatatttcattcaacttttcaaatactacaactatattacacagaacagttgattagatattattttcaaaattccattggggactgataactactatttaataaggaaggtcagtcatttcagttaaaaacatatagttttttttcaaagaaatgtaaattttatattaatttcatttagatatatatttttatttatgccagtttttaatgtaggtcagaagttaattttaaaagacactcttttgggggggaatttcaagttattggagataagaaaaataagaacgagaagaaacaaaatcatcataacttttcatgaggtacattttttaaaacacacccttctctcttgagttgaaattttggccgctttttattttttttgaaaatccaaaactgttgaacttcttttgaaaacaactcaccagtttaaccattttaaagtgcacagttcagtggttttcagtatgtgcacccatcacaactaattctggaacatttacatcactgcaaaagaaacccagtacccaagaagcaattatttcttatatccctttcccctacatcctggcaaacactgacctgccttctgtctctatggatttttctgttctggacatttaatgtaaatggaataatacaatatgtgattttagatgtctggcttctttcatttagcataatttattcaagggtcattcatcttgtggcgtgtattgatacgtcatacccttttatggctgaataatatgccattgtatagttataccacattttgtttatgcattcatcagctgatagacactgggttgtttccacttcttggttattatgaatagtgaatgctgctgtgaaattttgtgtaaaaatttttgtttgaaggtctgttttcacttctcttgggtatgtagctaggagtggaactgctggatcaaataataataccatgataactttctgaggaaccacaactgttttccacagttgctgcaccattttaaatctccaccattatggataagcattcttatttttccacatccttgctcacacttgttagtttcaatttttgttaatggccatcctagtgactactatgtagtatctcactatggttttgatttgtattttcctaatgactaacaatgttgaacatgttttcatgtgattattgattatttgtttgtcttctctggagaaatgtctcttcacatcctttgcccgtttttaaattgggttgattgtctttttgttgttgagttttaagagttctttgcatattctggatactagaatcttattatatatatgaattgaaaacattttctcccatcctgtaggttgtctttttaccttctatttaaatagtgtcctttcatgaacagaagttttagaatttgatgaaatctaatttttttcttgctgctgcttatgtgtttggcctcatatctaataatccatgtccaaatgcaaagtcgtgaagctttcccctctgttttcttctaagaattgtatagttttagctctcatatttaggtcttcagtccatatagaattgattttatatattctatcatgtaaaggcccaacttcattttttttatatggcaatccaattattccagcaccatttgttgaaaaggatgttcttttcccattgaatgatcatgttgaatcattcatactcctgttgaaaatcagttgactatagatgtataggtttatttctggactctcaattctgttccattgaattgtatgtctctcttcatatcagtaccgtaagttttgatgacgatgttttctattaagttttgaaattgagaaatgtgagatttctagatctcaagattgttttgactattcaagttctctcataaaattccatgtgaattttgggatcagcttgtccatttctgcaaaagaaggcaatggaattttgaaacctgctatgttgaatttatagatcaatttggggagtattgtcatcttaacaaaatattaagtcttgcaattcatgaacatagaatgcctttctacttatttagatcttctttaatttctctcaaaagatgttttgtggttttcagtgtataagttaggcatcttcttggttaagtttattcttaagtattttataatttgcaatgctattttaaatggaactgttttcttaagtctaattttttattcttaattgctggtgtgcagaaaagtacaactgatttttgtatgtttatctttttgtatgttcatcttttctcctgtaactgctgaatttattagctctagtagtttttgtatgcatgtatagcttctttaggattttctacatgtaagattatgttatctatgagtatagttttacttagttctttctaatttggatgcctttagtttctttttcttatctaattatctggctagaacatccagtatggtgttgaatagacatgttgagagcagacatgtttgttttcttcttaatcttaaggggaaagtttttggtcttacaccattaagcatgatattagctgtgggttttttcatagatcctctttatcagtttgagaaagtgctcttcctttcctggttttttgagtgtttttatgaaaaggaattcagttttgtcaaatgcttttctttttctgcatcagttgagatgatcatgttgtgcctcgcctccttcatcctactgatgttttgtactacctaacatgatttatgtatgttgaacaccattgtgttcctgagataaatctcacttggttatggtgtatgatcttttgaatatgctgctaggtttggtttgctaggttttttttttttttttgagggttattgcatctaaattcataggacatattggtctgtagttttcttgtgatatctttgtcgggctttaggatcagagtaatactgatctcatagaataggttaggagatgctcccttctcttcattttttttcaagaatttgagagagattagtgttaattctttaaacatttggcagaattcatcagtgaaactttctgggcctggacttttcttatctggaagttttttgatactgattcattcttttctcgttatagatttcagattttgtgtttctttttcagtcagtgttggtagtttgtgtgtttctaggaattcgtctattttatctaagttatgtgacttgttgatatcccattgctcattttcttataattgtttttatttctgtaaggttagtagtaatgtcctcatttttatttctgattttagtaatttagtaacttttctcttggtcagtctaggtaaggcatgccaatattatttgtctttttaagggtccaacttttggtttccttgatttgctccattgtttttctgttctctattttgtattatctctgctctaaaacattattatttctcccttctgtttgctttgggtttagtttgcgctctctgtctctctcttaactgctccaagctggaaggttaggttattgatttgagatctttcttcttttttaatgtagacatttacagctatagatttctgtctgatgcagcttaaactgcatcccagaagttttggtttattatttttttatattcatctatttcaaaatattttctaatttctatgatttcttcattgacttgttatttaagagtgagctgataatttctgaatatttggaaattttccacactttatttttgctatggagttatactttaattttatatggattaaatacttcatttgatttctatcctttttaagtttgttaaagttcgttgtatgctccaatatatggtctgtctttctgaaagttaaatgtgcattttaaaagaatatgtattcttttgttaggtagactgttctatgtatgtctgttatgtctagcgggtttatgttgttcaagtcttctaaatccttgattgtcttttgtctgggtgtcctattcattagtgaaagtatgatgtcaaagtctccaaatgttattgttgaactctttttcctcttcaacttggtcagttttgcttcatatattttgagattatgtggaaattgttatatcttcttgatggattgactcttttatcattatattatctttgtttcttgcaataattttgactttaaagtctttcgtctgatattagtgtaggcgctccagctctcttggttactgtttgcgtgggctatctttttctgtcttttcacttttaacctattggtgtctttgtatctaagatgagtctgttatagacagtgtaaaatgaatcacgttttgaaaaacattcattttgctaacttctgactttcaattggatatttaaatcaatttacatttaacgtaattgtgataaggaaggacttctgccatttttttctgcatgtgttatatctgttttgttcctcagttcttctacgattccttcttgtctgcattagatagatctttggtagtgtaccattttttattcccttctcttttattttactatacatttttagttgttttcttagtgttacccttggtgattataattaacatcttaattcaaaacaatcttgtttgaattaatgccaacgtagtgccaattatgtttaaaaaattttgctcttaaatagcttcatcctttctcttcatgttgttacaaattacattcttatatattgtgtgcccgtcaacatagtttataatgattgttttatatagttgtcttttaaatctatagaagaaaaagaggagttacaaaccaaacatacattaatactgacttttatatttccctacgtagttacctttgctggtgttccttattttttcatgtgaatttgagttactgtctagtatcctttcatttcaggactccctttagcatttcttattgggcagatctagtggtgaactcccttagcttctgtttatcttggaatgtcttaatttctccttcgttagaaaaaattttaattttattgtggtaagaacacttaatctaagatctagcctcttaatggatttttcgtatgcaatacaatattgttaaccacaggtacaatgttataaggcagactttcagaacttatccatctggcataactgaagctttatacctatttattaacaactccccacttctccctccctgaccccagcccctggtaaccaccattctactctccgtttccatgagttcgactattttagatacgtcatataagtggaattatgtggtatttgttctgtgaatggtttatttcacttagtataatgtcctcaaggttcatccattttgttgtatttcataagatttccttcttttaaaaggctgattatttccttcctttgaaaacctgagtaatattttattgtatgtttataccatattttatgtatccatttatctctcaatagacatttaggttgtttccagatcttggctattataaatagtactgaagtgaacttgggagtgtatatatttcttagagattcttattgcccttcttttagataaatacccagaagtggttgctgaatcatatgtggtagttctaattttaactttttgtgaaatctccatactttttttccagagcatctgcaccactttacattcctttgctgttgtgtacatgggttccagtttctccacatctttgccaatccttgtcttttaaaaaaattttttgtaatagtcatcctaataggtatgaggtgatacctcattgtggttttgatttttatttccttgatgatagtgacattgaggatgttttcatatacctgtttgaccatttgtatgtcttctttggataaatgtatattcaagttcttagcccattttaaaatgaggttattagtttctttttgctattaagttgtatagagtttagaaattaacctcttaaattttagaaattaaaaccctcatgtggtttgcaagtattttctcttatcccacaggttgccttttcattatgttgattattattattattattttttgctaggcagaagctttttcatttgatgtagtttcacttgtctgttttcatttttgtttcttgtgcttttagtgtcatatccatgaaatcgttgcaaaggctaatgtcatgaagtttctcctctatgtcttgttctaggaaatttatagttgtaagtcttatgtttaagtctttaatccattgtaaatagattttttttaatatggtgtaaggtaggctccattttttctttctttagacaaagttctgctctgtcgctaaggctggagtacagtggcgtgatctcggctcactgcaacctctgcctcctgggttcaagtgattctcgttcctcaacctcctaagtagctggaactacagtaatacaccaccatgaccggctaatttttatatttttaatagaggtggagtttcaccatgttggccaggctggtcttgaactcctgtcctcaagttatccaccccacctcggcctcagaaagtgctgggattacaggcatgagccaccgtgcctggcccagtttcattctttagcaagtgatatctggttttcccaacactctttgttgaaggaaactatcctttccccattgtgtcttctttgcactcttgtcaaggatcaattgaccatatatgtgtggatttatttctgggctttctattttgttccatagaactctatgtctgtttctctgccaataccatactgttttaattactatagttttgatatatatatatgtatatatgcatatgtgtgtatatatgtagatgtgtatatatatgtatatatgtatgcatatgtatatatgttttttatttttatttttgagggggagtcttactcttttgcccaggctggagtgcagtggcatgatcttggctcactgtagccttcccctcctgggttcaatcaattctcccgcctcagcctcctgagtagctgggactataggcacacaccaccatgcctggctaatttttttgtatttttagtagagatggggtttcaccatgttggccaggctggtctcaaactcctgagcacaggtgatccacgtccttggcctcccaaagtgctgggattacaggcatgagccactgcatccagccatctttgtaatgtattttgaagtcagaaagtgtgaggcctccagcttggccctgatttttcaagctctttttggctatttgaggcagtttctggttgcatatgaagtttagaattgctttttctatttctgcaaaaatgccactgggattctgatagggattacattgaatctgtaaatcactttgggtagtatgaacattttaacaataataagtcttccaattcatgaacacagaatgttttttcatttgttgtatttttaatttcttttgccaatattttatactttttagtgtacaagtctttcacctctgttaatttgtaagtattttattctttttgatgtggttataagtgtgattttttttagtgtttaccttggtgtttacaattaacatcttaattcataacaatctagtttgaattaatactgaactaggatgttccatacgtaaggaatactcatctattctaaaggggtttctatgtagaagatcacgtcatctgtaatcagggacagttttacttcttccttttctgtttggatgcctattacttatttttcttgccaaatcacgcttgctaggacattcagtgatatgttgaatacaagtggtagaagcagacatccttaccttgttcatgattttagaggaaaagctttaagtttttaatcattgagtatgatattagctgtgaactctacatatatggcctttggtgtgttcagctacttttcttctattcctagtttgttgagaatttttatcatgaaaggctattgaatttttatcaattttatcaaatgctttttatgcatctattgattgtgtgaattttgtccttcattctgttaatgttatgtatcataattgatttttgtatcttgaaccattcttacatcccagggataaatcccactttgtaatggcgcctaatcctttaattgtgcttttgaattcagttgctaatattttgttgaggatttttagatctatattcatcagggatattggcctgtagctttttttttcttgtgatgtccttgtctggctttggtatcaggaagatgctggtctcataaaatatatttcgaagttttccctccttttcaaattttttggaggagtttgaaaatcattaacattaattatttaattgttttatagaattcatcagtaaagccacctggtcctgggcttttctttgtcagaagatttttgattactgagtcaatctccttactattgttcaagattttccctccctcccttcctctctttctgcctttccccctctgcccccaccccccgaatctttttgttttgttttgttttgttttgttttgtttttttgagacagtgtcttgctctgttgcctagcctagagtggtgcagtggcatactcatagctcactgcagcctcaaacccctgggctcaagagatcctcctacctcagtctcctaagtagctgtgactacaggcatatgccaccaaatcctgctaatttttaaattattattattttttgaagagacagcatctcactatgttgcccaggctgtcttgaactcctagcctcaagcactcctcccaccttggccacggaagtgctgggattataggtataagccaccacacccagcctctgttcaagactttctattttttttttttaatcattcagtcttgttaggttgcatgtttcttagaatttatccgtttcttctagattatctactatattgcatataattgttcatagtagtctctcatgattctttttatttctgtggtatcagttataatttgtcctttttgtgttttttttttagttttatcttttttgcttagtcttactaaaggtttgtaaatttcgtcttttcaaaatataaactcttagttttactgattttctctattgtgtttttctgttctttattcttttcctgttctaatctttattatttccttccttctgctaattttgggtttagtttgttcttcttctcgttcgttgaggtgccaaattaaatcgtttatgcgacatctttcttttttttaatgtaggtgtttactgctgtatgtttccccttactactgctttcactgagtctcttaagttttgatatgttgtatttcattttcattttgtctcaagatattttctaactttcctaatgatttctttcttatgccgctggttgttcaaaaatttatttctatatattgtgaattttccagtttttcttctatactttgtttctggtttcatttcattatagtcagaaaagaaacttggtatgattttaatattcttaaatctattaagacttgttttgacacctaacatatgatatatcctggaaaatgacgtgtgtacacttgagaacaatgcgtgttctgctgctgtatactggaacggtctacgtatgttcattaggttcatttggtctatagtgttgtttgtgtttgctatttctttttctgactggttgttctccccgttattggaagtggggtaatgaagtctcctactattattgtgttgctgtctatattcccttcagttctgccaatgtttgttttatatatttaggtgctctgttgttagggatgtgtgtgtgtgtgtgtgtgtgtgtgataattgttaaaattgttatatgttcctggagactgcactcttatatcattatataatgttattctttgtctctcctgacagtttttggcttctaatcctaatctattttgtatgatataaatatatccactcctactcttttttggttaccaaatggtaactaatggaatatctatttccaacactttactttcagtctatgcacatccttaaatctaaaatgagtttctcatagacagcgtatagttggatcttttttttttttaaatccgttcagccactctgtgtctctttattggaagttatatctatttatttatcagaagttaaacctatttacgtttgaagtaattactgataggaaattatttattattgccattttgttcatcattttctgtttgtcttatagttcatttgtttttggagttccagagctttttggaattccttagtgcacagttcttagttcatttttctcccttgctctcatcctttgtgtttcgttgattttttttgtattgataaacttttattaatttcttttttacttttgtgtaacttatatgggtattttgtttccagttaccctggggcttatataaaatacggttatgacagtttaagttgataacaacttaactttaatcacatgcaaaaactctacagttttactcctcctaccttcacattttgtcgttgatgtcacaatttactatatggtgtattcattcattcattcacatattttttacttatagttgtttttaatactttcgtgttttaacttttacattagaaataaaagtgatttacccaccaccattagagtaataaagcattctgtatatctgtatatttacctttgtgttctatactttcttatggtatcatgttgctgtacagcattctattatttctacttgaagaactgcctttagcgctccttgtaaggcaagtctgttagtgatgaacttcctcagcttttgtcagggaaatttttatgtttccttcatttttaaagggcagttttgccaggtatagtgttcttagatagcattctttttccctttcatccctttgaatatgtcatgttactgccttctggcttgcaaagtttgagctgaaaaagtcaattgatagtttaatagggattcccttgtttgtaatgagtcattttcttcttgcttctttaaaaattctctttttttgaattaaaaaaagaataaaaaagacttaaaaattctctttttttgaataaagacttaaactgtctttattctttattactattattattttcttcctccgactgggtgatttcacgtggcctatcttcaagttcaccaatttttttttttctgctggttttagtctgctgttgaacctctcttgaatttttagttgagttattatattcttctgccctaatatttgttcctcttaagttttcttattactgaaattctcactttgttcatgtattatttttctgagcttatcgatcatttttatgacagtattttgaattctctttcagataattaatatatctccatttcattagtattggtttccagagttttatcttgttccttttttggattatgtttctctgttttttcattttccttgactctttgtgttggtatctgtgcattaaggagaaaaaaaaaaagaacctaccatctctctcagacttcaaggattggctttgtaccagagaagaccttcaccaataaacttggccagagcttctatggggctctcaaacttctgtgttagtccaaactgtcatcttcttaaaggctccagggttctagagtatgctagaacctcatagaacctcatcagtactttgtagtatgcctcatcagtactttgagacaggcaagacaaaagatagaaatatcaccctctggtaatacttggaaaagttggaatgttgtatgtatggcccaattcttttcctcccaaggtagaggctgagagctgggcattttttttcactggtcctttctgtgccaagccaggggagagctgttatgaatatctgtgctctagtccaaaccaccaccctttttctcaaaccaccaccctttttctctgtggatctagtgtatgttgggtcatgtcagtactcaaacacaggtgagacaaaagccaatcctttaggtagaactctgaagagtgggacattgtacgcacagtccaattccttcccttctcataaaaagttgggagctgagagttccctcctggtaataacgatgctgtgctgggagtggggattacgattagagagtgtcttcagttttcccagtggtttcaatgtgactgatttcttgttgcccaggttgcaggagcctctcagctactttcttgaatttccataaagggaattgatatgtgccattgcatcagtgtgtccatgggggaaggagagtccagggtttcctattccaccatctggctgctatcattctccttcgtttttaaggacacttttgtcacaaacagaattcttggttgacacattttttttttctaactacccccaccccaccaccaaattttgaatgtgtcaacttcaaaatttatattttgcttcttttttcttttcatttacattttctattttggaagacattgttctcatggtttcttttagttccttgtacatggttttctataactttatatgcacatttaaaataattgatttaaagtacttatgtggtaaggtcaatgtttagacttcctcaaggacagttcctgttcatttctgtttttattggaaatgagctatactttcttttttcgtggcatacacagttttttgttgaaaagtagatattttgaaaattataatctgacaactctggaaataagattctccccatctccagggttgttgctgcttgctctagttgttgttttgtatttagtgacagattgtgtaaagtctgaactgattttgtaaaggctgtctttctgaactcattttgtaaagttgtatcctttgtcacgtatagcaactgaagtctctgttggcttagtagtcaaccactgttttgacagagttccttaaatactgagattcagatttttttcttggttaagcttttacctggttactgtaaactttcagttagcttctcgagttctgaaaaaagctaattctgacctttttttgccagtttatttgctagttttatggaacgactagcttttggagttccttagtccatcatttttgccaacatcaatctctaaaagcatatacttttgttttttaatagctctaccagtaggctttcaattttactgataatacaggaattattatttctttttttattatactttaagttctagggtacatgtgcacaatgtgcaggtttgttacatatgtatacatgtgccatgttggtgtgttgcacccattaacttgtcatttacattaggtatatctcctaatgctatccctccccccgctccccgcaccccacgacaggccccagtgtgtgatgttccacttcttctgtccaagtgttctcattgttcagttcccacctatgagtgagaacatgcggtgtttggttttttgtccttgcgatagtttaattagagcttctccaaatgtgcctaagtatttctattgtgtggggtaaagggaaagcacaacaattatattaaaataatttcaggataggataatgcctagatgagtaggataatgtctggattgtttaggattagatatgataaaaataagtacttattagatactaaccaagtgcctaatagagagatatctcagtttactgcagctaagagtaaaagtaagaaaacttaggtaaaattgaaatgtgaagaagaagctaataattttgtagtcatgtttgttgttggatgagtagaatggctgcattcttgaggcttttgagaaagcatgagtcctacaagtttggaaagattaactgaaatgttccctatgtacggccataacatacaggctttaaaagtaccaaagaatgttcactgagaagtcttagatgcttttatcgtaaatcatctaaaagataaaacaggaaatgacaatccagaaattgtaaaaactccataagaccttgtgtctataaatcctttaaatttatcggactgaaatgacactggaacaatatttaggaagtcacaggagtttttgctgacatctttttggatttgcttcttcagaaaagttatttaaaacctagaacccatcatgaaacacaacatttataataattaaattctacatatacatttttagtatgtataatgttccagaaactgtagtagcctctggggaaacaaatatacatacatacatacatatatatacacacacacatatatatatgtatatttgtcatatttgtgtgtgtgtgtatgtatgtatataaagttgacccttgaacacatgggttcgaattgtgtgggtccacttatacgtggatcttcttccaactctgccatccatgagacagcaagaccaacccctcctcttccttctcctcctcagcctattcaacatgaagaatatgaggatgaagacttttatgatgatccacttccacttaatgaatagtaaatatattttctcttccttacgattttcttaataacattttcttttttctagctttattataagaatatagtatataatacacataacacaaaatatgtgttaatcaactgtttatgttatcagtaaggcttccaatagtagactgtttgtagttaagttttgggggagtcagaagttacacatggattttcaactctgtgggggttggcatccctaacccacatgttgttcaaagttcaactctgcgtgcgtgtgtgtgtgtgtgtgtgtgtgtgtgtatcacagttctatatagatagttattctcatatgtggcatacttagaaaactcagggattgcctggagtttcttagaagaaaactaatgcctgggtggggcctcaaaatatgaggaagaagggaaaagtatgctagcaaagaaagtggcatgagcaacaagttcatggaagcatgaatgactaaatattctaagttcaatattaaatgcaaaaagagtaaaagagataaagctcaatgaggcaggtagtagctaggtcatggaaggccttttttgccatgctaagagccttggatcatataatggaaggagtggggagcaaaccagggtttaagctaggggttgatgtggttggattttcttataaaatttgagctctagagagcacattttgcaaactggatatagtgagtaataaaagtggttttaagagccacaagtctgaatagacaactctattaggaagctgtagcattaggctagatgggggctcagaagggttgaaccagaagagtgatggtaggtggtgtcagaaggaaggatgtgaaacttattcagcaaagtggcatatgatgatgagaaagaggcaggggaggatgattcccctgatggggcaaaggacgctgggaatacagaaagcagcctttttgctttaattatttttattaagtagggagaaaggagacaatgatgagttttgttttggaaatactgaatgtaaggtaatgtggaatgatcagcaggatgtgtgagtctgaacctcaagggaaagtcagggctaaagataaaggtttgagattgactaacataatactctggcaaagaaagaaggcagtatagcaattgacaggagaaacaagacattatagataaatgggaagctagaaaatgcatttcaagagattaattatgctactagagtttgaagtccttgagggatggaattctgtctccttaatttttatattcttggcatctatcactgtgcctggtacccagtaggcacttaatgaatgtttgtggaatgagtcaaattttaccagcatatagtctctaaatataacataagccatctctagattctaatggaagttttgctgatatggtcacctgctttgtttatttgattactaaaaatagcatctgtatttcactttgcctaatcaagacctagaggagaaagcctaaattcagttgtcagaatatctcttggaaagaggtgtgctaacaatgaatttgcaggtaatgtaatgactagtttgattcctatgagatagaaagatgattacttctattcttagagtggattgtggaatggaatagtgtcaaacaggatatgatagatgaagacactgtataaccaaatctttaaatataattttataattttacattaacagtgattaaccagagtaaataataatatatagttatttttgatttttagttttccgtgcatttataaggagtacaaagaataatttttaatttatgaaactgacagtattttaaaagttgaaacatgatcctctgcctctaaaaaacccaatttttagtggcttgtcaatgactctctaaatgttacttacggtctttgaactctattctcagtttcttgatcttggttcctgaagatcagctgtgcaggacacacaggtgttaacacagctggcttgctgatgacaactctgtccatatagctgtcttgtgtgtcattattcatattgttcggtgtcattctgacctagccaagctaaaaatgatactccagctcaagagggattttaaaaccttgacaaactaaagataagacactacagaatatcatgtacatgtgcttagcagtttttagcttaaacacatctaaataactaatttcagcgtgtatctgtctttatcctttaaaataatttatcttcagaatgaaaatatatctgtgtggatgagtgttatcaattctattctcaagtatggtttttttgtttgtttaaatagctcaaggtcaaagcactctgtgaggtgcattctatagtatatagcctatgctacagatttatcatgttatatagtgactttataagatgtccatgattaaatcaccctattttccagcttgataatttgatttgaatagtcagttttttagatctttaattgggatgtagccagattgataatttgattcaagagatcagtttttttatttctgtaattgggatgtaactataatgtgtggtgtggttgtggtggtggattttgccctcttttctggtgacagcagctggcagtcatgggagagttctggctttgctccagagttgtagattaagttaaataacctgccagcaaaagagggctagttgcttacctcccacttttcaaattatgagtttctatgcttgctgcagtgccaatggaatgcctgcttctgctgagagagtgtcaaggtctctttccagtaggtgtggaacacagctggaactgttgcttatatcctgggacattgtggtttggggatcctccattatgacattgtgatcattgtataaggatgattgctacacaggtaacttgtttcttagtgtaataattgtgttcatgtgtgtacacgtgtgtgtgtgtgagagagagagagagagaggatatgaatgaatgaggatgcccacaggtgcaaggaaactattgaggaaaataaagatgtttaatattcattgattatcacaaaaccacttttatgaaacaaacattgttgctaagattgccagacaatagatataaagaaaaaagatagggaaatggaagtaccaaaatcttaagtaatttcttcaactgttaattgttcatatatagatattaaaacgcattattgtttggcgctaagagcactagacttagtatcctcatattagagatggcaataactatttcacaaggtgggtaacagaatcaagtgacgtagtatggagagtacggttgtcccttggtttccttggggattggttcccaaaccttctgtggataccaatatccatgatattgaagttcctgatataaaatggtgtagtatttgcatataatctatgcacatccttctgtacactttaaattgcttctagatttatttatagtacctaatacaatgtaagtgctatctaaattatactgtattgtttggggaataatgaaaaggagaaaaagtttgtacatgttcaggacagatgcagcttaaaatatatactttcagttcatggttgaatccatggatatggaacccacaaatatggggggccaactgaactttgaaaagtatgaagtacttttggaggtactaattgtattattactaatagaagtagtattattatctgtctgtccatttgattaattagatagttaaagaaaaggttaaagaaggaggaaagtatccatttagatgtaaccatcctatccctgaatatcattttcattgcattgacacactttgatgcttcctcctatcactgggtacatatcagagtcttggaactgtctaattttttttaaattattttttctttcttctacattgtagaattcatgcgtttataacggtgttcttatctgatcatacttactaagagcctctgaaagcgtagtgttttttttttgtttgtttttgttttttttgctactgtgtattacagagtatatggttaactctggctagttcccttctctttgtatttacaaaagactctccagtatgccttttctacttgtttaaccagaatttctgttaattaggtactagaataagtggtcagtagttgtgaccaggaaagttagccgtggtcaggaaagttaggaccagtcaagatgtgtactagactatataaaacttgaaaatgtatcaggagacggtatacagatttctggaaaaattgaagaaaggaaacaaagtgtctttgagatggcaccctgtattggcgatataaacttgactcactagaaattgtttgtagattctctggtgagagatagtcatttaaaaaaaaactttataggtgataaaagaatattatctttcttctatatctccagagcaggggatgaccaagtttttctgtaaaggccagatagtaaatatcttaggcttggtgaaccatatggtctttgtctcaactactcaactctgtcattgtaacaggaaagcagccatggacaataggtaaatgaatgggtataactctaataaaactttatttataatagacagtgggctggatttggttctcaggctgtagtgtgctgactgtacactgctctttggtgcataggttgaaaaatagtatgtaggctgttctagtgcatagaatgaaaaataaaaggaagaaagggaagcagtaaggaatcagtgggaatggaaggaagtacaagggagggagtaggacaaaggagggcaagaaaatggaggcaaagtacaacatgaatgcaggataatgagaatggagattataagaaatattatagaggtctgttttcatatggatctatatctggtaaaaaggtttattttgaagcatcggaggccataatagattggagtaaatacaattgaagcagattaaaagtatgacatgaagccctaatatcagttgcctttcccaggcattcaggattcagacactgtatacatcttcttacatgtgtttttaagtcaacctcagtttttatatataccttgaggtcttctggcttggtatccaattggtaaaaatacagctagtaaatcatttcatgagtgtgtgttttttttttaattggaacatagagtccagagggatttatagctgtgcatgataaaagatggagggagttgagcaatttttctagaaatgactaatttaatttcatagttgatatctagcagaaatagcttttttttttgttttggtaggagcataaaaattagaaaacattgtttacttgtgagtaaaggctaatcagagaaataggaatagtacagtatggatcttgtggatcacttaaaatctagaactggattattatagtaaaatatattttaaaatatatttatcttgaaataaatatatttcatggaactgttttgactttttagaaagttttatttattttcttctcctgttttttatgatatgtctattagagatatctcctttctgaaagcatgtaataagaaagggagaaagtaaactgttctttctaaaaatcaaaattttagagtagaagtaatataggttttaaaaattattctaaaatatgatattgcatgattttaaagaacgttatagaatgtataacatttgataacagatttatattgggaaattctatatgttaaaaatgagctgttaggcgttttgaagaagaaaaacattgtatacatgtattagtcatattgataaatgagaataaaaaggcatagaatcttgattataggatgaataataatgtattataaacataattaaagattggcttttgaaattataatttaatctacagacaggtgactgctggtgaattttattcctaattcacactaaactcagtactttaaaagataaacttttccttttaggaaaaaaataatttgactattctaatattacttcaaaactttttttgacagtaactaatttgctttagatcctcattcttgaaaataattttgtatccaataagctgtacttcctaaagaaattccaaattatctctcttttaatatgttagttactttgttctcagcctgcctgttctatttcttttcatgaacgaacttaatgcaacaaggtaagagtcctttcttactgttctgtgttgaatctccctgttgacaccttgaaattcagacttgccttctgcattctttctgaagtctcttccttctaccctttatttcttccgtttcttgtcatctttcttttcttctcctttgctgcatgattttatttttgcttgtcttagtgtcactgttttggattctttcaacatgatgctttcactccctttactcattaaaataaaattatggataattcttttacaagacttttctaaaaacttttcctagaaatatttgagaacattttagatacttactctcaaagttctcgtttaatttaaaagtggaaaaaactcttaaaattttagtagaagtatttgtgatattgcatctattatatatcatgggtctctcactcttgatggcactgtcaagttgattcaacagataatttgtaattaaatggaagtattaaagcatgcatattattcaaatgattatgatgttcatcattaggtgtagcaaaaatagctgcattttgcaagttttttttattcaatataaagaattatttaatttggcaaattaagtaatgttataccaaaaatattgaaatgacaataaatcagtttcaaaagcaagatgccacagcttaacaatgttcataaagtttatttagagaatataaaatgtggcttactgttcactgtatgtcaagcttcgtggatgaagtatggtgcctgatgctaatcaggttaaaggacctccagtgctcgaactgtgttgtggattatacttacattgcttatggtttttttcccctctctttgcccgtattagcaatctgcttttgtactttgacatccaggatttccctagtgaattttgtcacagaaaaaagagaatcatcaatatcgcagttaaacttgactttcaaagctaatagtatctcatttgggggctcaaatttaataaattttctttgattctgggtgagtttttaaacatcaaacaatgaattggccagggtgcagtaaaatatttagatctattgactgtggttcagaagggtagaaggcaaaacactagtggtttgatgttgataaattctcagaaccttaatccacattaatgttttcttttatctgagtgcacattggtgacaaaaaaaagcaagagaaggtattcatacatgtaaaatataaaacctaaaacaaatgtagttgtaaaatacgatttgttttgttatgctaagtaagtttaacagcattcttatcctgagtgaagactctggagagtgtttgttgcagataaatatacattgtgaattgagactccagcatgcatgtggtactcacatcattataaaaattacatcatagtgtatgttttacagcatacactttgacattctcttattgacagaaagtcttcagatcagcttgggacatataaggatttttatgcccatagattagcgtgaacagttaaagatgccgttatatgtttgtgtgtgtttgctggcttaaagaaactcaatagagtttgttttgtgaaatgtgtgtatatcctaaggaactaattaatacaataaaaataattcaaacagttttacaagcttcccaagtaggctagaaaaatggaggagaaattttctatcttgtatttttgccaagttatatttgaagttgcttggataaaactagagatagaaatatatttatttgagcagttaatgcaatttttatagttaaccttgtttttgaccttcgctacctgataaaaaactttttgttctgtggcattgagctaattgtataatatttattaagtatatggtaacaaatagataaaattttaaaacctattccaagcataaggaaagttagaaaatatgcctatgtattgaaaactcctattattaaactatatgattaaaatgagagctttttgttcttaaatgcaaacgaaactatggaattcttaaggcttttactaagtttggaaattaaaaaccaaaatatctgtttttgaatgtttccatttatattatataaggaatattttctcatttgtccagaaggtggcagtgtgatatcaactgcatgtgattccatactgactagagaattggtgtttttcccatatcggtgatgtgtttgtattgttgctttctgaatacttaaaatagagtacaaatactactgattttatctgttgtattgtttagaaattgtgtgactgtgttggtttatatgtatttaatcattaagactcaagtttaataaaatcctgcaattctagaagagtgaaaagggcaaacaaacctctttcttgtatatttttaagtctccttttgtgttgagtatatttgttttgattctagagtacatgttattgaagttttcttttcaaagactagtacctaataactatcttgtccaatatgtatcagttcatatcagttaaacaccacatgttactaagcaggtgataatgattaggagatggctgttgtttttgattttgtgaatgttttttcttttcttcctttttagggtggaactgtgaaaaaataattcaaaacctcttgatcagaagagctctagtgactcttcttcccctccctcatttcaagcaggaggatgctttttcttcttaacattctcccccagcactctgaattagagatttatttgcaacgaaaaatcaattagtcctaaatttattcatggatttcaggtccagcgatcaatgcaagtccactcagtgggctcaaggggacccagttcatcccagttaatgtgtctgaaggggaattaccattgatgctgtttttttccctttaggtcagagatcagatctcgctgtcatggtctgcggcaagtaggaatgacttcaccctacagctacccaaactgcacctggagacctttgcaatggaggggctcaagggcgggccagaggtggtagcatgccaggttagagtctaaataacattgtttgctactgagacatatagaaaaataaattgcactaactggagagaatgaaagcctcaaagtattgtgaataatttaaaggagatgcaaatagatgtttcttcatttttcttctatcatgtaacagtatactttacaaaatattgtttttttctttaaagcctagaactagcctattaaaataatccagaaaagtgtttttaccaaggaaaaatgtgttttatggcaaagtacagtattaaaagaaaatactttcctatcagcagaggacaataagacactaggctgttacctctttaagcaagtctcaatttgttgcttttattgtttgaaaataagtaattttagaaaaaaaataaaataataaatcactttagttgtaaacatcaaaagagatacctgaaatatctcaatattaattccaaaatatatccaacatttcttatgaagtaatttaatttcagcaaagcttaaacttatctgtgttttctattgaagagtattttaccctttaatatttagttttagtgaacattgtaagatgtgcaaattgggtcatttcatttataaaacttaaaatatcaaatcataagaactcaaataactttaaagtacactaataaacttatttttagaaacattcattttcggatgctgtaggtatccttctattttatgtcactattgtattaatattattgtgatcaattttttccttaaggttatttttcttaatctgacaaaatgaaattcagtgtgtccttttaatgcccaaaaccttcattaaaaaaagaaaactatcaacattatgtaaattataggaagcatgatatttcaaaagagactgtccttgttcaatagcactctattttttagtgtatttaaaaggagaaatatctcttaaaacttagtgtgtctttcacatgttgagatttaaaataatctttttcattttagtttatgaccctgtggaattttaattttatagaaaattaatgtcagtgtgtgtgtggagcaatgttaattttttatatgctccatatcctaatttaatttgttattagtaccaaattaatgctctacaaggaaaaaaatactcattgcttctttcattagattgtccaatatgtctaaaatatatataattataaaagtaagcataaaatatttttcttctctgttatagggtagattgctgtactgttatttaagatgagatttaaaatgtgtattttaaatttgattgtcagtatttatgaattcatcattactatgaatacagtctgatttgagatttttctagtggttgtaaaataatcctttacttggctatttcaattcagaatctcacaaggcttagtatttgtcgtaatttacaagtaaagacttcctcaaaactagatgttggtgatttcgaaagaggttgattccccaaaatgccctttttgggggttatgatatctgggaacagcaagaaggaaatgtagagacccacagtttaaactactgtcttttccaggttctaataaaaatattagactcccacctggataagttccattgatatgctgtaatatatattgtagtttagtagtatacatcatagttggaaaattaggagacattagtgataataatagtacctacagtttcagcgaacacttaactatgtaccaggtaccatgcttagctctttgaatatatcatcttatttaattctcacaatgagcctgtcaaataaatggcactatctccattttacacttcaccaccaccaccacaacaaacacaacgggtaactcctcagatcaacagcaaggaaaaggcagagcctggatttaagtctaatagtatttgactgctaagctgaattaataaatctgatactaaaaaatgtagacacatatgttacatggtaagagtaaaaccttagatatctataatggaatttttcttccatttgtaaaaaattatgcatctatgtatgatatagatcatagtttatgctgtattgtagactaattatgggctaatagtatgaaactctaatttcacctttttttttgcagtataaaaatatgtgcatttatactaagtgtggctactgacttgggaattcagtagttgtttaactttgtactctgactctgtactgatgaagtggactattcagagttctcaacctttgattatgaagagaggatcactcagcagggtgtggtggtatatgaaccatttgcccaacttactcagctgtcatttacagaagtaggagctgaagttttctgtctttttcaatgggggcaaactttattataggtataatcctgaatggaaagagaccagtgagcattattactgagtgaagaggatgagtggagtacctttgttctctgaacctggaagagcatgtgactgatgcttttctatggagaaaacctcagttcaacttgtttctgagatctgctagctttcccctccaactttcttagctgaaacaaacaaacaaacaaacaaacaaaaagtaatgctactgatccccgagacttgcagtgggattgaatacagcaatggatgtaaagtgtagtacagtgcctagcctagagaaagcagacaatgcagggtggctgttgttattgcagccgttataaggcccttgtaaagatgaagtaagcaacagtagcttgttttcattacgtttaaggtgtatgtatgttttattttgaggaatcgttatttaagatctttttttttctgtatctttccatttagtttcttcacccttccctgtttcttcaaaaactttaaataattttgatcaagcacagcctaccatagcttcttatttacttttccatggcataggatgttccaatgaggccatgtctccagtgaaacctttcgtttaagttcctgcagcaaatttaaacctatactagtgttttatcttccaaataacagcaaataggctttcattataatagtgagaagaataaaaacacccctattagaccaattagctttaaatgaaaagtccagtgtagtgtgaatgcagagaactttgcaataaaaaagattctacttatactttataaagataatacctattattcattatcttatactctgaattacaatttttcaataattatgatatgtactattggtaataactggcaaatattagtaggcatccagtaaatatttgtgttttcatttcgattcagtagtaaacaataaataataattaaacagtaacaatagctaatatttgttgagtgcacaaaaatcaatccaagatggataaaagacttaaatgtaaatccttaaactataaaaaccctggaagccaacctaggtaataccattctggacataggaaccagcaaagatttcatgatgaaggtgccaaaagcaattgcaacaaagacaacaaatgacaaatgggatcaaattaaatttaagagcttctgtacagcaaaagaaactatcaacagagtaaacagacaacctacagaatggggaaaaatattgcaaactgtgcatctgatgaaggtttaatgtccagcacctataaggaacttaaatttacgagaaaaaaccaaccccattaaaaagtgggcacaggatatgaacacatacttttcaaaagaagacatacacacaagttaacaggagtatgaaaaaaaaaactcaacaacattgctgatcattagagaaatgccaatcaaaaccacaatgagataccatctcacaccagtcaaaatggctattattaaaaagtcaaaaaataacagatgctgatgaggttgtggagaaaagggaatgcttatacactgttggtgggagtgtaaattagttcagccctagtggaaagcagtgtggcaattcctcaaaaagctgaaaacagaactaccatttgacctagcactcccattactgagtatgtacccaaaggaaaacaaattgttctaccataaagacacatgcaggcatatgttcactgtagcactagtcacaatagcaaaacatggactcaacctaaatgtccatccatggtagaatggataaagaaaatgtggtacatatacaccatggaatactatacaaccataaaaagaacgagatcatgttttttgtgggaacatggataaagctggaggcgatcatcctcagcaatctaacacgggaacagaaaaccaaacaccacatgttcttgtaagtgggagctaaatgatgagaacacatggacacaaagaggggaacaattggggccttgagtctggagggtgtgggagaagggagaggatcagaaaaaataactattgagaactaggcttagtacctgggtgacaaagtaatctgtacaacaaaccattgtgacatgagtttacctatataacaagcctgcatatttacctctaaacctaaaataaaagttaaaaaaaatcatttgaaattctgccattcagacacaaccaatgttaacattttggtatatattcttcaagttattttttagccataaatacaaactcacatgcacatattatttatatttaatacacctatatatatttaaacaacaattgggccatacagtttttttcactttttttcctttttattggtatgtaatagttgtacatgttttggaggcacatgtgatattttgatacctatatacaatgtgcaatgatcaatcagggtaatttggttatctgtcccctcgaatgcttttctttatgttgggcatattacaattcttctcttttagctattttgaaatatacaataaattattgttaattataatttccctattatactattgaatattagaacttataccttctagctaactatttttgtactctttaaccaacttctcttgggccatactatttgtgtgcattgttttttaaacctaataacatatctttcttgtcagtaattacagatttatgtaattatttttgatgcctgagttgtgctctgctacatggctctaccacagtatattttgtcagttttctgttgatggatatttgaagttattttgagtttttggttattatgaataaggtggtaattactatcctcttgcatacattttttcattattctcttttttcccctggaataaattagtagaatgattgcatcaaatattatgtgtactctaaggcttttaatacacattctccaattgcccctgaaaaagataagatggttccactttaccccctgcaagacttctattagccctttaattttctttttaaagtgtggttctttaatttctgataatagaagaaagttttttcctctttttataattttggtcttccctgaatttgcagacatccattcttactaggtccttattttacacagagttgctaagttttagtctaagagattctccttggtgaagtaaagaggatacattttgtggcagctgcttgtctcacagattttctttttcattgctttctaagtccatgactgtgctttgaatgtttgagattattggaattggtaagtgacatcattttaatagtaagttatcaaaaagattttggattatccaaagttgttgtctataggagtttgtgcaattctctttattcttttacattttttacttgccaattgataaattgtagttgtgtatatttacatggtacagagtgatcttatggcttatgaatacaatgtgcaataattaaatcatgctaatgaacatatctgtcacttccaattctctctctctctctttttttttttttgagacggagtctctctgttgcccaggctggagtgcagtgacgtgatctcggctcattccaacctcccgcaaccgggttcaagcgaatttcctgcctcagactcctgagtagctgggactgcaggcatgtgccaccatgcccgcctaattgtttttttttttttttttttttgtaattttagcagagacgaggtttcaccgtgttggccaggctggtctcgaactcctgacctcaagtgattcacccgcctcagcctcccaaagtgctgggattacagacatgagccaccacacccagcccaaaataaaaatatcttttacattgaaaaatattaaataattttttaattgggttgtggaatcgaaaataatgttggaatgtcaccttcttcaaaggtttgtaaatactacccagagaagagctatttgttagggaaatacaattagctggcaaagtcatatagttcatctgagaataaacgaatttgatggaaaaataccatcctttgtctcatctagctacttgacaggtatagactctagttcttcagaatgtaaattgtgccaatgagcaatctaaatgtcctagatatggggcctaacttgaatgtgaatataagaagtagtgaatttggtgcttttttcggttgttgttgacagtaggaagagtttgctacttggtacttgaaattttagaattctactctgaagatttcatattgcacaagtagaactaaaatttcttcaaaatttcctgagtagagccctaagcaatgctaaacaaaacaaagtattacaagaaatgaaatactaaggtgcgtagaagaacttattatttttctctttttgtttctttttctcattaagaaatttgatgcataatagatgtacatggttttagggtacatgtgataatttaatacattcatataatttgtaaagttcaaatcagtgtgcttgggatatagatccatcaccttaaatatttgtcttttctttatattagaaccattcaaattcttctagctatttaaaaatacaaaatagattattgtaaactgtagttaccctactgatctaacactaggtcttattatttctatcacaccatatatttgtacccattaatcaacttctcttcatccccttctcaaccactacccttcctggcctctggtaaccaccaatctatatatcttcatgagagtcacctttttagctcccacatatgagtcagaacatgcaatatttgtctttctgtgcttggcttatttcatttaatgacctgcagttctatctgtgttgctgcaaatgataagatttcattcctaattcattgtgtatatctatatcgcattttctttattcatttattaacggccacttaggctggttccacattttggctgttgtgaataatgctgcagtaaaaataggagtacagatgccttgtgatgtatttctttcttttgtacacatacccagtagtggagttactggatcatgtggtagttctatttttagttttttgaggaaactccatactgttctccatagtgccttactaatatacattctccctaatagtgtgcgaggattctcctttctccatatttttactggcatccattattgcctgtctttttaatataaattttaaccggggtgagatgatagctcattgtggttttgatttgcatttctgtgatagttaatgatgttgagtattcttttcatatactgttgaccatttgtatgttttcttttgagaaatatctattcagatctttttgccacttttaaattaaattatttgttattttgctattgagttgtttgagctccttgcatattctggttgttaatcccttgtcagatggacgatttgcgagtgtattctcccatgctgtgggttgtctcttcactttgttgattgcttcctttgctgtgcagaagctttttaacttgatgtaatcccatttttctatttttggcttggttgtctgtgtttttaaagtcttaaaaagaaaatctttgcccagatcagtgtcctggagtgtttccccagtgtttggaaaaacttattttaagggcttgttgcaaagtgagataacaatagtgatcttagttttaattcaatatcagtataaatagcatttaaacgtcggttatagtcattgtgagttatgccttgtcatcctcaatctgtatcttctcctaagattttagtgtttcatgactgggaaaactgcttgataattagctttgcgtatcagctattactagagcagttttcgtattatcccataagtcttttcaccatccttttctcccattattcctccttctctttctgtgcctgttgtctgatttctaggttttttatttgtttgtttgatggtggtggaggggggatgcatcagatttttaggacagaatcttgagggtaaaaatataaaattatactctttttgttcagatattttaccagccgataaaagccagcctgcctgcctgccttccttccttccttccttccttcctcccctcccctccccttccttttcttttgagacaggatcttcctctgttgctcaggttagagtgcagtggtgtgatcatagctcactgcagtctcaaatgccagggctcaagcaatcttcctgcctcagcctgctgagtacctaggaccacaggtgcgcaccaccatacccaggtaatatttttaattttttgtagataatattttatttttaaatttttttgtagaaacacagtctcgctatgctgcccagactggtctgaaactcctggcctcaagctatccttccatctcagcctcccaaagtattgggattaccggcattagccaccatggctggctcttttattttaaaagatttattgtaataaggtattttctgtatatccattattaaaacatagtcttgcacactaaggtagtgccttctgtctctcaactccttctgataggtagaaggagttctataaagttttctttttaatactagcagatgagatatcttacatcttgcatcctgggttgtatttcagaccagtgtgtttgtttcttgttttttcttgttgagatttttatctctctttgccttttaaaaaggacaagatgacatttaagggcaagtaattgcatccgtgtaaagcttctgctacagttttaaagaatcttataactttgtactccttaattcagcttaatgtatgtatgaattatataccttgcgggaatgatctggtataactgatctgaactgagattaaggaaaatctggtaggacttctttaaaaacaaggtagatttataaattcatttttctagttttgttgtttattattccttttcttaataggaaaaaataattaggaaggaaataaaatcatagcagaatcagtattacagaaggttgaagcagttatgcaactttgctagaaagtagtaggactggcaataaagcagttgaaatccttccccctgtagacacaaattacaccagtagcagggattctcattattttatacaattgttttctttttgtgtgtatgtggaatacaacattgtcttttcttgtgaaggatgagtatgtattacaattcttgtggtagcactggatagaattccagtgctactggagttctatcctagaatcactattttctgtgaccccttgaccctgaattcttccagcatgtcagtttcctcatcagtaaaatggaggtgatattacctggtctggtgcatctttgggtgattatgaggatcctataacatgtatgaaagaacttagaaaattaaatcgcactaataaatgtttttgaaataatttttctttaaatatttgccatataaacatcccttggtcaggtatatatagattgcttagttttcaatttcaggttaatatttttacccctttaaaagacaagaaagtaaatcagattatatggaaattggcaaccataagtctgtgcaatttactgtatgtcattgagttatgttgattagaatgggaattattttcttaacagcatagtatttggaaaagttgaaataatttcattttctggggaaggagtcagcaaggtagtattagaaaaagcttgtgtggagagtcagaatgcctggattgaagttctggccctgtaatttaaccacctcggtaagtcactcaacagcacagagccactgttccctcatctgtaaaaggtgacagtgacgccagtcttgcttttgctcacaggactgtagggagatcagatgagataatgtgcatgtgaaggtgattttcacattaaaaaatgctatattagtaaaagctaagttggactgaactataaaaggcctaaggtcaggaacggtgacccaactatattgagaaaggttttagtgttttgacttttggaggtttttgattgatgacctgttcaacatgtgccttcaaaaaaataatatgttcaacaactttagtgtttccttccagttaagtatacagccattgccaagacccaggtggtaaattcatgccatatactactatttaaataatcatataaagtaatgcaaacattactactgtttccatattttgaaacattttgtcaccttttcatcatttaattttgggatgatttcaaattccaactcaagtggtgacagtatttgcttttatgtgaaatgtttgagatgcaattagtaaaaaacaaaaatgacaaaacgtatcaaagtacagtacagaattttgttttttgttacaactctgagttctaggtggccctaagtagaaaagctgctgacatgatgtgaacataatttctttgtcattaatgttaagaggcaaaaactaaattctaaacttgatgctttatctttttgttcattttaaggccactttttaaatataactagaactattatatcttttaatacttattattgagagaacgaagcctgtgagcagttgaactttcaagtgctataaccagaattgctattcattttagctacttggacaaaaaacagtgtttgatggactgcctaggtgaagacctggaaaaggaagggttatctacaaatgagtgagtttattatggcttagtgatttgctgattgatttcatttgctgtcagttaaggctctcttaatgtcagttttctttgcataatgccttgaaatgaagactgatgaagttcttcaaattgatgccgcttatataaactgaccccgatttgccctattctgcatgacaacttaagtgacagcagttagaagaaaatacagcaatgaatatgcaacttaaggattaaggaagatgcagtaaatcagtctaaagctaagtacaatgataatttcttgtaataattccacagatgccttacatttgttaaacagactgttattactctcaaatactcaaatatatgttttcattatatacatgtatttgaattgaagaagagaactaaaagttattccaacagagatcctaattcttttccctcttatttaaacttggaattatcaaaatcacagttttaaaaatattttatttaggatatccacatgcaaaagaatgaaattggaccttggtcttacaacatgcacaataatcaactcaaaatggagtacacaatgttagaaagacctaatgccataaaacaaaggaaacaacaaaatggaaaggcaacttgtggaataggaaaaactatttataaactgtatatccagtaaggagtttaatatccaaaatatataaggaactcatacaacacaataacttttttaaaaaatgggcaaaggacctaaaaagacatttttccaaagaacacatgcaagtggccaataagtaaaaaggtgttcaacaccgctaaccattagggaaatgaaaatcaaaaccacaatgagatatcacatcacaactgttaggatggctattaccagaaagtcaaaagacaacaagtgttggcaaggatgtagagaaaagcgaacctttgtgcactattggtggaaatgtaaattggtatagctattatggaaaacagtatggaatttcctcaaaaaataaaaatagaactaccatatgatccagcaatcctacttctgggtatacatcaaaaggaaatgaaaccgttgtcttgaagacatgtctacacttccatgttcattgtagcattattcacaatagccaagatatagaaacaacctaagtgtcctctgatgaatgaatggacagaggaaatgtttatacacacacacacacacacacacacacacacccagaggaaaattcagctttaaaaaataaaggaaatcctgcaatgtgcaacaacatatatgaacatggaggacattatgctaagcgaaataagccagacgcagaaagaaaaatactgcatgattccatttatacgtagaatttttaaaaatcttactcacagaaacagagtagaaggtggttgggggtggttgggggaatgaggagataattggtcaaagggtaaaaacttttggtcataagatgaataatctctggagatcatggtacagtgctatataatgcattgtgtacttgaaatttgctaagagagtagatcttcagtattctcaccacatacacaaaagagggtaactctgtgaggtgatagatatgttaattagcttgattgtggtaataatttcacaaagtatatatatattaaataatcacattatatcccttaaatatatacaaactttatttgtcaaaaaaatatttcatttgagtttgcatagtactgtatattaagtaaccagtgaaatgtagagtaattttagaaatggtttagaaagtacttttcagttttggagccttctagtaacagtagtaggtttttttcccccttttcccaccaaaagtctcatagtgctgactaaaaggaggcataagtttttgagggaagactaacttaagaagtaactcactgaagaaaacattaaaaggtaaactgtggcatataaaattttaaggtatttgtttgagtgaacagcaattcatgagttgtacagctccaggccagaagtagtttggaggtcctgttgagagaacgcactcaaatttctacacgtttgtagacactaagccaaaacccaaatcaactctttatctgaaataaaagattgttgcttaattcatttattttcaaaggaaaaataaaaatgaaaaattaaataaattctcataataatttcatttagaaatagtattattatttttcttaacaaagtaccctttaaaaaaaaactcaaaagacttgccaatactagccaatcaaatccttccttcaattttagaaaacaggaattgcatgtaaacaagtctgggccaactcttacaacctgctttctatatcctcctcctctgttctccatctttcctagttctttgagccccagtggtcaggctgagctgagtatgagagagggccctcaagaggccctggaagcatattccctcagctcctaaatgaagtctccataaggtgaccctaggagactgtgcagcgtgactggccgcttgttttatcccagactcttttccaggtagaaacacttacctctatggagatatttgctctgaacaacatgtttcttttcttgctgattattagtatggacttaaaaaaataagagaaggtaacacatttttaaaggagtactacttaacttttaaaacttgatgtgattttcacatcctgacttaattttttttggttgcaataattagaagaataattggaagccatacatatatcttttgattgatgacctgttaaacatgtgccttcaaaaaaataaaatgttcaacaactttagtgtttcattccagttaagtatatagccattccaagacccaggtggtaaattcatgccatacactactatttaaataattacataaagtaatgcaaacatttctactgtttccatattttgaaacatttcgtcacctttatttacaccatttaattttggaaagatttcaaattccaggggtatatgttgacttgtagctcctctgaaactagcagaatatcataccagaaatttacacaatgaattgttaaacaatttagtagaattgtttcgcttattatatggatttgtgtatgctctagtaaaatatgaccctatagacttaagcatatattgcaacaactccgaatgatataattttgttataacacaggagttatttttcatcattcagacccaaatcccacatctgaaattccacactccagaatgctctgaaactggtaacttgaaggcaaaacctgacctgccctaattttgtggcaaaacctgagaaatatgtttttgattaaagggtgctattccagatcttgatgagcttgatgagagtgttatttaatatatggtatatgcctcatttttcttttcttttttttttttttttttttttttttgagacagggtcttacttctgtcatccagactggagtgcagcagtgcgatctcagctcactgcaacctccacctcccaggtttaagcgactctcctgcctcagcctccacaataactgggaccacaggtgtgtgccaccacacctggctaatttttgtattttttttatggagacagagttttactgtgttggccagggtggtctcgaacttctaacgtcaaatgatccacctgcctcggcctcccaaagtactgggattacagcccacatttctaaaataggaaaaatcctgaactgagaaacacattggttccaagggtttcagataaaggaatgtgagaattgtactagcattataaaacaggttctatgcaaaggacatatactgttgtttccatgcattgtgtcaatgcaatcaaacaaaggttttttgcttatagagaagcacattcagtctgtgggatggtatatttgagtgaatttttgctatctactctctcttgcatcttgttttgagtcataaaggaattgtgtagtattttatgccacttgaaaactcgaaagacttcaacagttgtgttatgtgcaaatcagataaggctctaataggctttatcttgcttgtgtatagtacctgtttgcaaactaaaggcacattttcactccatgccagtaggaatcctctgaggcattattttttgggcccctcccactttatgtactgaaagcagaatggatgaaatgccttgacacataacttacttatcttttcttactcaacattctaatgtgttctcactggtaaaggaatgcagattttttgaaggatctggagaagccagactctgctggtattcagacaattactctagatagagagaggaagtcctcttgttgtgagtccagtggcttggtggttcgtatcctggattcctggtagtccataggagcaacagggactagaaatggctttgtttcaaagttctctgcttattctagagaggaaataaaaatatcacttaatagtatttagagaccagtgtgaactaagatactggctttaaaccaaaatggccagctctgttgatcatatagatttgaatgtggctaacatcattcagtgacgtactgagcacctaccaaatgtagggcattgcgctgtactctgggacacaaaggtaactcaaacttttttttttttgaggggaaagagagaatgtgaaatttaatatgaaagttgagactgatatgaaatgaaagacatggttgccataggagaggcatagataaaagtaccattgcttgccctttagagatgaatgaaatttgttcttgctgggtgattaggagaggcttcatagaggaggtagcatttgagtggaccttgaagtttatgtggctacaaattccttttcctataaaatgctattgtcaggaaatacaaataggaaatatctggagtttgagtctcatccactaggtagctctgcagcagtgaagtctataggatgacttttaatctgcaaaatggggattgacctggaggattggtaaggttttttttttttgcagctactgaaactctgtgatactgcaaataaactatggtcttaggagaatttcatggcactcttattatttattccttcacaatgtacaaaataaattcattgctttagttgaaaatcagaaggcacctgggaatcaatttgtccttaaaacaaaatggctatttattaaatatgtgcaattctttgtttattaattatacctcaataaacctgttttaaaaactaaaatggtaacaatatttttttcagagtgatatagtttaacatacttcaatgaattttgttatagaatagagattatagggattattgaagtagatgataaccctggctgaagcatgcaaattcccaaaccaatttgctgtattatatcagaatcagagtggaatcatggtgataaaaggactggctcttaataaaggcataaaatattttctctctttctctctttgccaatttgcttttcttcaggtatattgaaaattgttcatattatatttaagtaaaccacaaacaagtacatcaaattcttataattctagctaaatgtgtttttagcacctctgtccaaattaatataaagaaaccaattatggatgtactttgctgaaattcataaataaaactaacagtttgatgtgaaaagaggaaagataaggcagtcaaaaatgtgtggatgtgtggatgtatttactctgagtcagtagcttaaatgcactttctgaggagctgtttgtttcaagataatggattgagcagtttttctttgatagtgaacaactagctctcaaccctgcaagctatttatttctgtagcttttctttttgcactaacactactctttaagacaatttttatattgaaccccaaaaggtcagaattaggatgtgtctttggtccattgtcagatctgatcaaagcagttggatctttgtaggtcgattatggaacagacacacgggaggtgctggttatcactttgtttagtctgcaaaaagtgtaaatcagaaagagataattgagatagaaagtgcctttattaagccccaaatatcttttgaaggggttaaataggcacttcaaatataatccacattattaatgaaattgaaaggctcactaactaaaatgaagaaccataccaatattttataatcttaatgtaatcaagtggaataagtatgtatggaactcctgttctttatttaaccctgtgcttaataggtgactgggtgagatgacagagaatgaacgagcatgcagggaggatgaattaaaaagaaagaacctcagtgttaccattcctaattacaaggagaacaaaacaagcactaatacgggaatcactgagtaccagcatgtatgctgggagcctatgggacgcatgaggatgggaaagggcctgaatagatcactaaccttgttttggacctttccccaatcccccatctttttcttactaacaagaggcatttggcttttaaaaggaaataatctttattagtgttttatccactgcgtttcaatatgaaattttaaaatgttttatttccccaacttgaaaaatgtgaatcagatataggatcatgtcttctgcaaacaaagataatttgactttctctctttctatttgaatagcctttatttctttctcttgcctgattgccttagccagaacttccaatactatgttaaataggcatggtgagagagggcagccttgacttgtgccagttgtcaaggggaatgcttccagcttctgccaattcggtatgatattggctgtgggtttgttacatatggctcttattattttgaggtgtgttccttcaatacctagtttattgtgagtttttaacatgcagggatgttgaattttattgaaggccttttctgcatctattgagataatcatgtgttttttttctttagttgtttagtttatgtgatgaatcacgtttattgatttggttatgttgaagcaacctggcatcctggggatgaagccaacttaatctcagaccaaaccttcttaagcaacttcagcaaagtctcagagtacaaaatcggtgtgcaaaaatcaccaacaacaggcaagccgaaagtcaaatcatgaatgaatttccattcacagttgctgcaaaaaacaaacaaacaaaacctaggaatacagctaacaagggaagggaaggacctcttcaaggaaaactacaaaccactgcccaaagaaatcagaaaggacacaaacaaatggaaaaatattccatgctcaaagataagaagaatcaatattgtgaaaatggccttactgtcccaaataatttatagattcaatgctattaccattaaactaccattgacattcttcacagaattagaaaaaactattttaaaattaatatggaaccaagaaagaacctgaatagccaagacaatcctaagcaaaaagaacaaagcttgaggcatcatgctgtctgacttcaaactatattacaaggctacagtaatcaaaacagcacggtacttgtataagcacagatacatagactaatggaacagaatagataatccagaaataagaccacacacctgcaacatctgacctttgacaaacctgacaaaaacaagcaatggggaaaaattccctatttagtaaatggtgctggaagaactggctagccatatgcaaaatattgaaactggaccccttctttacaccttatacaaaaattaactcaagatggattaaagacttaaatgtaaaacccaaaactataaaaaccttagaagaaaatctaggtagtaccactcaggacgtaggcatgggtacagatttcatgatgaagatgccaaaagcaattggaactgaagcaaaaattgacaaatggtatctaattaaactaaagagcttctgcacaccaaaagaagctatcatcagattgagcagacaacctacagaatgagagaaaatttttgcaattcatctgacaaaggtctaatatccagagtctacaagcaacttaaaccaatttacaagaaaaaacaaacagccccatcaaaaagtgggcaaagaacatgaacaaacacttctcaaaaggagacatacatgtggccaacaaacatatgaaaaaaatctcaacatcactgatgattagagaaatgcaaactaaaaccacaatgagatgccatcttgtgccagttagaaaggctattattaaaaagtcaaaaaacacagatgctggtgaggtcgtggagaaaaaggaacacttttacactgttggtaggagtgtaagttcaaccactgtggaagacagcatggcgattcctcaaagacctagaggcagaaataccatttgacccagcaatcccattactgggtatataccaaagatgtataaataaatcattgttataatgatacatgcacacgtatgttcgttgtagcactgttcacaatagtgaagacatgaaatcaacccaaatgcccttcaatgatagattggataaagaaaatgtggtacatacacaccatggaatactgtgcagtcgtaaaacagaacgaggtcgtgttctttgtgggaacatggatggagctggaagccattatccttaacaaactaacataggaacagaaaaccaaatactgcatgttcttacttataagtgggaactgaatgatgagaacacatttacacatgaagaagaacaacacatactggggcttgttgggggcgagttgtgggggaagagcatcaggaaggatagctaatggatgctgggcttaatacctaggtgatgggatgatctgcgcagcaaaccaccatggcacacgtttacctgtgtaacaaacctacacatcctgaacatgtaaccctaaacttaaaagataaaaaaagaaaaatatgagtcatttttgccattcctcccttcttatacagctaaatggcttcccatcacccttaaaatgaacttcaaacttctcactttggccttgggctcttcatgatctgggccctgctgctctccaactccatcaccttaacattctccatctcattcactgaactatagtgacactgacctttttcctgtaacttgaacacagtgcacataggcccattttagaggctttgtgcttggtggtccctttacttggtatccctttctctcgaatttccacaaggctcactccttcacttcatttatgtctttgcataaatatcacctcattgaagacttctctcattccttactaaaataacctcccttctccctgcatattttatagccctgacgtaatatgtttggctgttatctatttgtcaccaaaatgtaagatccaacagggcagggctttatatactttaccacagtatcttcagcacctagaacataatgggtgctcaataatatttgttgaatatgttaatgaatgaaccaggattttctcccttgtggcctttttgagaggcagaactgcatgcaaattaaggaaaaaagtaggaggtttgaaatcaaatggacctcttatttccagccatgtcactttttagcaatgtgcctgtaaggaagttatttatgaactctgagccttgggacctttatatctaaaatattgctaaataattcctgtttttcaaggactgtgtaaaaagtaagagattatgtatgccatcacagaaaacagactatgttcctatttgcatatgctttatttagtagagtcagagaatggctgccttttgagtgaggagcctaaccattctgcacaggtgtatctgttacttgctaagtgttagagaaagtcaaagtaactgtgatctccaaggagtgtactcttagatatcaaaaattcataagaacatttccacttatcgaggccagatgtcatgattttgacacttgagcagaggtggactgcctgaattgtagctgacaccattgcaatagaatccaaatattcacctatatactcacaccaccatactctgtcttatctatatgtcaatagactccaaagtctccaaagcagctctaataatcttcattgtaaaactcctaatgatgtcaagagagagaaggtgctgaagaaatgataaccataataatatatttttgtgtgtgatggagaactaaagtaatgaagttaagcttcttcttgttttcctatggcccacaattctgctttagtcactaaccaagcaacttccagtttatcagaccttgttttgcaacacattaataaagccagtggcaattctgtaatttaccaatatgacaagcatttttcaggctgcttaaatttctaagtccctaaagtaaggcaatttattagtattggtgttatcatcactgatctagtagtatcttctgagaaactcattcctctgactttttctaagattattgttgccttttatggttttcatgtccatatgcaatggttttcactaggaacttttctcattctctgattattttgatgacctcttttccatatttttgtaggaaaccatgttggtttttttctatgtaattgtccctttgctctttctttacagtaatctttagcataataagggcaataatcaccatcaatctagaagctgcatttgcccttagaattagccttgattcagttctacttggaagtaacatatttgaaaaagtattggtcttatttttggcacatttaagttgtatatgccatggttgagtggaagccagaaaaaagtttagagtctaaacaagatacaaagaaaacatcatttaaaaaaagtctgctgcaaaagtgttctgcaactctgctgaatatggtttcccatgagactccttctcatacctgaagagctattatatttacatccttcaaagatggtgccagtaaaaactttgagtgatgggataagtcaagtccagggccatttcaaatgccaaaaaaggaaaatgaacttagattctctttttcttgtataaaataacaccaacaaaacagctgaactacatgcagcatcacatcaagtcagtttacaattttgccttcagttgtgcttgactaaggaggttgcatatttgcaacaaaattttttctcttctactgacctgatacatttgctatccttatcaatgtcaccattatcactaaaaagcccttcagtatctgtgtatacactgcattcagtatctagttacacattgtttttaccatagcctgtaatagtcatatacaattttaactgaacagtggtggcccagaccagtctataaaggaataaaattcttgtatatgtacacaaaccctaatacatgtaggaccgaatatgggctatccagaaaacttcttataaataacgaagggagaggaacttggttcactaaaatcctagtttttatataaaagaaaggtcatttttttctgtcagataattttccgggcagtgcaagatgaaagccttccccatcttagtagttaaaatggaaatggaatataatgtctctgagtcccattccttctatacatatatccagcatgtatagatctcattcagaattagaatttatgagttagatgagctaatcctatgtgggcaggatttgggatatcactgtcttggtattttgcttgtcaagtcctttactgatgctaacaggtccttttagtcaggctgctgagagatacatagcacattatcattttacatgtataagttaatcgagtataccagaagttgttttccttttttccaagtcatctattgtgtggataatagatgatttgctataatttctaagcttaattttttcccattaaaaaaatctaagtcttcttccaaattatgtatgtttttagcatcaaaagatgttttgatggaagtgtggaagttatatggcatgctttgatagaatagagattcattattttgttacaaatgtttattgaacaactacagaatgaatgaagttcccaagaaaatatcatttgaagttcttttatttgaaatatttatttacataaacaaaaatctgtagctcagagtcaatgcagagtaatacttattaatgattgtgagatctttgaaaatcctggtgtcatagcaaaattcaaaaggggtttgctttgtatctttttcagttaataaaggagagaacatggatcaataaaagagagaatatggattcaattgttgttatatgaatgttgtaataagttagctgtgcactttatgaaacttggaaagcctggattaagtctactgatttcactgagaaacaaataaacaaacatcaaccagtccaaatcaaaccaggaaacttggaacacattgagtgaacatgggctttggaattggacaggcatggatttgaatcccaattctgctctttattaactgggtgacactggacaaggtacttagcatcactgaaccacagtttcttagtctataaagataatatgagtcttacagcattattggaaggcagctataatcctggtgtaacaccaatacacctacaggattattgtcagaattagaaaaaatacgcaaagcttataacatggtgtctggcctgcagtagctgttgttataaccagggtccaggcaaaccctggaacatgggaactacagaggaagctggaaaacctttgagcaaagatttggtaagagcataggctttatttacttccatacattctaacttatttggcaattcctgattgtagagtgtggggttcacctcctttggggcttacatgggtttgcctttgagtggagaattgagctgagtgcatatacccctcagattacattgactcttttgaggcaacaggctgcagagggtctcagaatagctggtgttgctatcacagtcagtgagcaaatatagactagtatctgataatctctcatgttgagtgtgatgagcaaaatgctaggtcgttttattcaagtatctgcataagaagttatgtgcagaagactggttggtctagtccatgcctttgcccgctaaatcagtatcatttaaacaaaattttaatgttttattctcttcttgtttatttgtttctaaaataaatatagacatgtctataaatttgtatatcttcccttttaaatattagaatgctatatatttgcttttttacccttttattttgaaataattatagattcacagaaaagtacaaaaatagcacagggaggtccctgtgtacgctttatccagctttccccattgttatatcttacatcagtttaggaaaatgtcaaaaccagaaaattggcattagtacaatgggtaaatacagttttgtgacattttttcatgtgtatatttgtatagacactaccacaatcaagatacagaaaggtaccaacaaaattctctctcaagtaaccagtttatggacatatcaccccctgtcctgccatcatccctaactcatagcagccactaaatagtttccatttctataagtttgtcatttcaataatgtaatataaatgcagtcatacagaatgtgactttttgagttggctttttcactcagtgtaatgctcttgagatccatccaagtttttgcatatatcaatagtttattcctttatttgtcaatattgattaatagtttattggtgacttgttttcgtggtatggatgtatcacagtttgtttagccattcattcactgaaggatattttgttgtttctggatttcggctattacatataaagttgcattgaacatttttatgcaagtttctgtttgggcacaagttttcatttttctaggataagtactgaggaatgtgattgcctagctatatgtaagttacatttaatttttaaaaaactgtcaaactgtttccagaatgactgccatttttttcattctcactatgaatctttaagagatccagtttctctgcttcctcgccagcacttggtgttatcccactttttttctgttagccattctgataggtgtagtgatatcttactatggttttaagtttgcatttccctagtgcttagtgatttttgaaaatatctttatgtgcctgtttgctatttgtatattctcttttgataaaatttgcgatttgtatattctctttcgtaaaatgtatcttagtgccttttgctcattttctaattgaattgtctttttactgttgagttttgagagttgtttatatattctagaaactatcagatgtgtggtttgcaaatattttttctctgtcatttactctttgtgacagaattttttttcatggcaataatttttaatgaatagtttctgatgaagttcagtttattgtttttttctttcattgatcacacttttgattttgtgtctaagaactctttaccaagctcgagatcccaaagattttttcatatattttcttctaaaagtttcatagctttatgttttatatttaaatctatgatcaattttgagttagttttggtataaggagtgtttcaggctgcagtaatcagaattctaagatgacccctttgtcctttcccatgttgtacatctgctataaaattagtcttctcccctcgatggtgggtgataccagtaaatgtaatggataccactcctgtgattaggttactcatcaaaagagattgtcctggatgggcctgacctaatcaggtgactcctttcaagaagccaaggtgtctgagagatgttcttctgagggactggaggaaagcaaacagccatgttgaaagagggcggtgggggcatttggcaaggagctgagtatgccctttaggggcagagagtgatcctgggtgacagccagcaagaaaatggggacttctttttcacaatggcaagtaagtgaattctgccaacttgaatgagcttgcaagaggactctgcttctcaggtgagatcacagctccagatgataccttgatttcagcctgctgagacacccgagcagaggaccccactaacctatgctggactcctggcccatggaaattaagagataataaatttgtgttgttctaagcctttaagtttctggtaatttgttatgcagcatgcaatacagatttcaataccctagagtgaggtgctgcttttatgcttctttgtagatgtagattttgattattggagcttacatctgggtgtgagggaaagaagtaggacatacatgctgtgagacacagtgaatagatagactgtcttctgggtttggaagcttccttaggctctgctctgctttcctgattctagggtccttactcatggtttttgtttctggggacaaacccagctgctgccaccctgcacagccctaagtacgggaagagtcaactagctcagttgcttccagtgtacatctacagttagtcacctgatgccacaggggagtagtctccaaactttttcatagcacactcttatttttaagtcagcttccctaacatatatacattcattccttaataacttatatatgtgttgttattaaatatgctccataacatagaaaaagaaaattttaaaggtatgatttttaaaggttttaagagaaacattaaaaagtaattataaaaactattgagaaaatgaaaaagatcagtggttgccaggagttagaggggagcgagggatgaatctgcagaacacaggatttttagagcagtgagtctattttgtgtgatactaataatagtgaatacatgtcactatacatttgtaaaacccatagaatgtccaacaccaatagccgtaatgtaaactgtggattttgggtgatagtgatgtgtcagcataggttcatttttgttgcaataaatgtaccactttgtaggagggtattgatatgaaagagggtttatgtgtataggggcagagcatgtatgggaactctctgtacttcatgctcaacttttctgtgaacctaaaattgctctaaaaatagtctatttaaaaagtaaatataccataaaatctatctgtggacatcctataattttttttattttaactcactttgttgactataaatacatgccattaattatacaagataataaattataccttatttataaagtaagaaataacatatgtattctttactatagtttggcactgatgtcttcacttggtctatttgttaaacattaatgtgtcctgtaaggtacgttcaaggaagagtggaaggcttttgcaatgtagaggggctgaaagtggcatcattactcatttatttacttttgtgtttcaacatgaaaatatgtatgtaactgttaagtgaatctatatattaaattattttacatagtacagtctttataatagtttataatgagatgagagactttaaaatcttctctgtaaagttcactgttgtgacagcatgcttcaaagtactcttgaacttgtgtaagaattatgcaattttctttcaaaaaagatgagggttacaaatctgtagaacttttctttgatggcaagtggctaacagaaacattctagctagaagatattaaacacatactctgtcacttcaaggtaaagtgacatttgtaaaaaaataaaaactaactgctctgagttttgcagagaaaacattgtaaaatagttgtttggaaatatttccagaattatggactttttttctcaaaatgatacaaagctataaaattcatatatatatatatatgtatatatatatatatatatacacacacacacacacataaaaatttcagaaatgtaattttctagccacagtgtcttttgaacttttgttacgaatgtagaaagtatttaatataaaaggtttttgttaaagaataattgattaattcagggaagttggaaattttctaggcaaaatttaaattacaacttttgtttgattgataggtagtattgaaacatgaattccctgatttagtaaacacaactgtattagggcattcttgcattgctataaagaaataactgaggtggagccaagatggctgaataggaacagctccagtctacagctcccagcatgagcaatgcagaagataggtgatttctgcatttccaactgaggtaccgggttcatctcactggcgagtgttggaaagtgggtgcaggacagtgggtgcagcgcaccgagcatgagctgaagcagggcaaggcatcacctcacctgggaagcacaaggggtcagggaattccctttcctagtcaaagaaaggggtgacggacggcacctggaaaattgggtcactcccaccctaatactgcacttttccaacagtcttagcaaatggcacaccaggagattatatcctgtgcctggctcagagggtcctacacccacggagcctcactcattgcaagcacagcagtctgagatcaaactgcaaggcggcagcgagctgggggaggggcgctcgccattgcctaggctagagtaggtaaacaaagcagccgggaagctcgaactgggtggagcccaccgcagctcaaggaagcgtgcctgcctctgtagactccacctctgggggttgagcattgccaaacaaaaggcagcagaatcctctgcagacttaaatgtccctgtctgacagctttgaagagagtagtgcttctcccagcacggagtttgagatctgagaacggacagactgcctcctcaagtgggtccctgacccccgagtagcctaactgggaggcacccccctagtaggggcagactgacacctcacatggccgggtactcctctgagacaaaacttccagaggaatgatcaggcggcaacctttgctgttcaccaatatccgctgttctgcagcctccactgctgatacccaggcaaacaggatctggagtagacctccagcaaactccaacagaccttcagctgagggtcctgactgttagaaggaaaactaacagaaaggacatccacaccaaaaccccatctgtacgtcaccatcatcaaagaccaaaggtagataaaaccacaaagatggcgaaaaacagagcagaaaaactggaaactctaaaaatcagagtgcctctcctcctccaaaggaactcggctcctcaccagcaacggaagaaagctggatggagaatgactttgacaagttgagagaagaaggcttcagacgatcaaactactccgagctaaaggaggaagttcgaacccatggcaaagaagttaaaaaccttgacaaaagattagacgaatgctaactagaataaccaatgcagaggagtccttaatggaccttatggagctgaaaaccatggcacgagaggtacgtgacgaatgcataagcctcagtagccgatttgatcaactggaagaaagggtatcagtgatggaagatcaaatgaatgaaatgaagtgagaagagaagtttagagaaaacagaatgaaaagaaacaaacaaagcctccaagaaatatgggactatgtgaaaagaccaaatctacatctgattggtgtacctgaaagtgacgggcagaatggaaccaagttggaaaacactcttcaggatattatacaggagaacctccccaatctagcaagacaggccaacattcaaattcaggaaatatagagaatgccacaaagatactcctcgagaagagcaactccaagacacataattgtcagattcaccaaagttgaaatgaaggaaaaaatgttaagggcagccagagagaaaggtcgggttgcccacaaagggaagcccatcagactaacagtggatctctcggcagaaactctacaagccagaagacagtgggggctaatattcaacattcttaaaagaattttcaacccagaatttcttatccagccaaactaagcttcataagtgaaggagaaataaaatcctttacacacaagcaaatgctgagagattttgtcaccaccaggcctgccctaaaagagctcctgaaggaagcactaaacatggaaagggacaaccagtaccagccactgcaaaaacatgccaaattgtaaagaccatcgaggctaggaaaaactgcatcaactaacgagcaaaataaccagctaacatcataatgtcaggatcaaattcacacataacaatattaaccttaaatgtaaatgggctaaatgctccaattaaaagacacagactggcaaattggataaagagtcaagacccatcagtgtgctgtattcaggaaagccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcactcagattcataaagcaagtccttagagacctacaaagagacttagactcccacacaataataatgggagactttaacaccccactgtcaacattagacagatcaacgagacagaaagttaacaaagatatccaggaattgaactcagctctgcaccaagcagacctaatagacatctacagaactctccaccccaaatcaacagaatatacattcttctcagcaccacactgcacttattccaaaattgaccacatagttggaagtaaagcactcctcagcaaatataaaagaacggaaattataacaaactttctctcagaccacagtgcaatcaaactagaactcgggattcagaagctcactcacaaccgctcaactacatggaaactgaacaacctgctcctgaatgactactgggtacataatgaaatgagggcagaaataaagatgttctttgaaaccaacgagaacaaagacacaacataccagaatctctgggacacattcaaagcagtgtgtagagggaagtttatagcattaaatgcccacaagagaaagcaggaaagatctaaaattgacatcctaacatcacaattaaaagaactagagaagcaagagcaaacacattcaaaagctagcagaaggcaagaaaaaactaagatcagagcagaagtgaaggagatagagacacaaaaaacccttcaaaaaatcaatgaatccaggagctggttttttgaaaagatcaaccagattgatagactgctagcaagactaataaagaagaaaagagagaagaatcaaacagacacaataaaaaatgataaaggggatatcaccaccaatcccaaagaaatacaaactgccatcagagaatactatgaacacctctacgcaaataaactagaaaatctagaagaaatggatgaattcctggacacatacaccctcccaagactaaaccaggaagaagctgaatctctgaatagaccaataacaggctctgaaattgaggcaataattattagcttaccaaccaaaaaaaatccaggaccagatggattcacagccgaattctaccagaggtacaaggaggagctgttaccattccttctgaaactattccaatcaatagaaaaagagggaatcctccctaactcattttatgaggccagcatcatcctgataccaaagcctggcagagacacaacccaaaaagagaattttagaccaatgtccttgatgaacatcgatgcaaaaatcctcaataaaatactggcaaaccaaatccagcagcacatcaaaaagcttatccaccatgatcaagtgggcttcatccctgggatgcaaagctggttcaacatacgaaaatcaataaacgtaatccagcatataaaagaaccaacaacaaaatccatatgattatctcaatagatgcagaaaaggcctttgacaaaattggacaacgcttcatgctaaaaactctcaataagttaggtattgatgggacttatctcaacataataagagctatctatgacaaacccacagccaatatcatactgaatgggcaaaaactggaagcattccctctgaaaactggcccaagacagggatgccctctctcaccactcctattcaacatagtgttggaagttctggccagggcaatcaggcaggagaaggaaataaagggtattcaatgaggaaaagaggaagtcaaattgtccctgtttgcagacgacatgattgtatatctagaaaaccccatcgtctcagcccaaaatctccttaagctgataagcgacttcagcaaagtctctggatacaaaatcaatgtgcaaaaatcacaagcattcttatacaccaataacagacaagcagacatccaaatcatgagtgaactcccattcacaattgcttcaaagagaataaaatacctaggatgtgaaggacctcttcaaggagaactacaaaccactgctcaatgaaataaaagaggatacaagcaaatggaagaacattccatgctcatgggtaggaagaatcaatatcgtgaaaatggccatactttccaaggtaatttagagattcaatgccatccccatcaagctaccaatgactttcttcacagaattggaaaaaacctactttaaagttcatatggaaccaaaaaagagcccacattgccaagtcaatcccaagccaaaagaacaaagctggagacatcatgctacctgacttcaaactatactacaaggctacagtaaccaaaacagcatggtactgataccaaaacagatatatagaccaatggaacagaacagagccctcagaaataatgctgcatatctacaaccatctgatctttgacaaacctgacaaaaacaagaaatggggaaacgattccctatttaataaatggtgcttggaaaactggctagccatatgtagaaagctgaagctggatcccttccttacacctcatacaaaaattaattcaagatggattaaagacttaaatgttagatttaaaaccataaaaaccctagaagaaaacctaggcattaccattcaggacataggcatgggcaaggacttcatgtctaaaacaccaaaagcaatggcaacaaaagccaaaattgacagatgggatctaattaaactgaagagcttctgcacagcaaaagaaactaccatcagagtgaacaggcaacctacagaatgggagaaaattttcgcaatctagtcatctgacaaagggctaatatccagaatctaccatgaactccaacaaatttataagaaaaaaacaaccccatcaaaaagtgggcaaaggatatgaacagacacttctcaaaaggagacacttatgcagccaacagacacatgaaaaaatgctcatcatcactggccatcagagaaatgcaaatcaaaaccacaatgagataccatctcacaccatttagaatggcaatcattaaaaagtcaggaaacaacaggtgctggagaggatgtggagaaataggaacacttttacactgttggtgggactgtaaactagttcaaccattgtggaagtcaatgtggcgattcctcagggatctagaactagaaataccatttgacccagccatcccattactgggtatatacccaaaggactataaatcatgctgctataaagacacatgcacacgtatgtttattgtggcactattcacgatagcaaagacttggaactaacccaaatgtccaaccatgatagactggattaagaaaatgtggcacatatacaccatggaatactatgcagccataaaaaatgatgagttcatgtcctttgtagggacatggatgtagctggaaaccatcattctcagccaactatcacaaggagaaaaaacaaaacactgcatgttctcactcataggtgggaattgaacaatgagaacacatggacacaggaaggggaacatcacacactggggcctgttgtcgggtggggggaggtgggagggatagcatttggagatatacctaatgttaaatgattagttactgggtgcagcacacctacatggcacatgtatacatatgaactaacctgcacgttgtgcacctgtaccctaaaagttaaagtataaaaaaaaagagaaatatctgagactggataatttataaagaaaagaaatttaattgactgatggttctgtaggcttctagggaagcttcaggaagcttaagattctggcagaaggtgaatggggagcaggcacgtcagtaggcaaaagtaggagcaagtgatgtgttggggagagggaggtgccacatggttttaaagcaccaagccatgagggatctccgctcatgatccaaatacctcccaccaggtcccgcttccagcactggggattacaattcaacatgagacttgggtggggacatacatgcaaactatatcaacaaccaactgtgcacttcttccatttgcattacctgtttaaccatgtatcatgggtgatgggcatggggaatcagaagtacgactccaattgagtatatcacagagttatataagtctttaaaaataataaagcttatccaatcatatttctttcactatgtaacaactttttgttgagagtaaatgttttagggctattaataaagcaaggctaaggccttctaccccgtctcctacctgtttatgctgagcttcaagcctaactgtagttggtgttaccattgtagaagtattctcttattttaaatagggtttctctaaaattttgtttgtgatcctttctactttctattccttattgcttaatcaggattcttctcagctgatagcatttttagcagcttttatgcattcatgtacatgtgcgtacacacacacacacacacacacgtgcacataattccactggcaaagcgagaaggtggttggcagtctgacatcctgatatagtccttcttacacaactttttactggaatggaatgtcctggcgaaacaagtatttgtgggcaggaccagaaaccaaacatcaaactagagtacaattccacatctttgatggggattttattggagtcacagttgctgtttgcgtgctattagtaataggccgtctgtatctcattccctcctatatccttaaaatttgtaaaatattattaaaatattggaatgaaagtaagtctaataaatgagcaaccatatcagagtaactttttgataatgaagaaaataatgaaatttcctttaattcctggtgccaatgaagacacatttttttctaatggtggtctttttatttttatttttacatatttaggaggtacaaatgcagatttcttacttgcatatattgcatagtggtgaagtctgctcttttagtatatccattatgtgagtagtgaacatcatatcctgaccaccctctcaccttttgtaatctccaatatctgttattccactctgtacttccatgtgtagccattgtttagctcccacttataagtgagaacatgcagtatttgactttctgtctctgagttatttcacttataatggccttaattatatccatgtggctgcataagacatgagtttcctttttttaatgcctgtgttgtattccatggtatatatgtgcacacacacacacacacacacacacacaccatattttctttatccaatcatctgttgacggacagttaggttgacttcatatctttgttattatggatagtgctacaacagacatatgaatgcatctgtttttttgttataacaatagggtataatttccccagtgtatatttttattgactttgtcaaagatcagttggctgtaggtatgtggctttattcctcgcttctccattctgttccattgatctgtatgtctgttttgtgctagtaccatgctattttgcttacgatagccttgtagtataatttgaagttaggttatgtgatgtctctagctttgttctttttgcttaggattgctttggctattagggctctttttttaatatactttaagttctgggatacatgtgcagaatgtgcaggtttgttacataggtatacctgtgccatgttggtttgctacacccatcaactcatcacctacattaggtatttctcctaatgctatccctcccctagccccccaccccacaacaggccccggtgtgtgatgttcccctccctgtgcccatatgttctcattattcaactcccacttatgagtgagaaagtggggtgtttggttttctgtccttgtgatagtttgttgagaatgatggtttccagcttcatccatgtccctgcagaggacatgaaatcattcttttttatggctgcatagtattccatggtgtatatgtgccacattttctttatccagtcttcattgatggacatttgggttggttccgagtctttgctattgtgaacagtgctgcagtaaacatatgtgtgcgtgtgtctttatagtagcatgatttataatcctttgggtatatacccagtaatgggatggctgggtcaaatggtatttctagttctagatccttgaggaatcaccagactgtcttccacaatggttaaactaatttacacccccaccaatggtgtaaaagtgttcctatttcttcacatcctctccagcatgtgttgtttcctgactttttaatgacagccattccaactggcgtgagatggtatctcattgtggttttgatttgcctttctctaatgaccagtgatgatgagctttttttcatatgtttgttggccatataaatgtcttcttatgaaaagtgtctgctcatatcctttgctcactttttgatggggttgtttgtttctttcttgtaaatttgtttaagtcccttgtagattctggatattagccctttgtcagatggatagattgcagtaattttctcctattctgtaggttgcctgttcactctgatgatagtttcttttggtgtgcagaagctctttagtttaattagaccccatttgtcaattctggcttttgttgccgttgcttttggtgttttagtcatgaagtctttgcccatgcctatgtcctgaatggtattgcctaggttctcttgttggatttttatggttttaggtcttacatttaaatctttaatccaccttgagttaatttttgtataaggtgtaaggaagggggtccagtttcagttttctgcatatggctagccagttttcccaacaccatttattaaatagggaatcctttccccatttcttgtttttgtcaggtttgtcaaagatcagatggttgtagatgtgtggtgttatttctgaggcctctgttctgttgcattggtctacatacctgttttggtaccagtaccatgccgttttggttactgtagccttgtggtatagtttgaagtcaggtcgtgtgatccctccagctttgttctttttgcttcagattgtcttggctgtacaggctctctttttgttccatatgaaatttaaagtagtgtttttctaactctgtgaaggaagccaatggtggcttgatggcaatggcattgaatgtataaattactttgggcagtatagccattttcatggtattgattcttcctattcatgagcatggaatgtttttccatctgtttgtgtcctttcttatttccttgagcggtggtttgtagttctccttgaagaggtccttcacatccttgtaccttatattcttaggtattttattctctttgtagcagttgtgaatgggagtttgctcattatttggctctctgtttgtctattattggtgtataggaattcttgtgatttttgcacattgtttttgtatccagagactttgctaaagttgcttatcagcttaaggagttttgggactgagacgatggggtttttttaatatacagtcatgtcatctgcaaacagaggtaattgacttcttctcttcctatttgaataccctttatttctttctcttgcctgattgccttggccacaatttccaataaataggaggggtgagagggcatccttgtcttgtgctagttttcaaagggaatgcttccggtttttgcccattcagtatgatattggctgtgcgtttgtcataaatagctcttattattttgagatatgttccatcagtacctagtttattgagtgtttttagcatgaaagggtgtttaattttattgaaggccttttctgcatctattgagataatcatgtggtttttgtcattggttttgtttatgtgatggattacatttattgatttgcatatgatgaaccagccttgcatcccaaggatgaagccaactggatcatggtggataagctttttgatgtgctgctggattcggtttgccagtattttattgaggattttcacgttgatattcatcagggatattggcttgaaattttctttttttgttgtgtctctgccaggttttgctatcaggatgttgctggcctcataaaatgagttagggaggagttcctctttttctcttgtttggaatagtttcagaaggaatggtccagctcctttttgtacttctgatagaattccactgtgaatccgtttggtcctgggcttttttggttggtaattactgcctcaatttcagaacttgttattggtctattcagggattcgacttcttcctggtttagtcttgggtgggtatatgtgtccaggaatttatccatgtcatctagatcttctagtttatttgcataggggtatttatagtattctctgatggtagtttgtatttctgtgggagcagtggtgatctcccctttatgatttgttattgtgtctatttgattcttgtctcttttcttctttatttgtttggctggcagcgtatatattttgttaatctttacaaaaaaacagctcctggattcattgagtttttgaagagttttttgtgtctctatctccttcagttctgccgtgattttacttatttcttgtcttagcttccttgtgttgggttagaacatgctcctttagctcagaggagtttgttattacctaccttctgaagcccaattctgtccatttgtcaaattcattttccatccagttttgtttccttgctggcgaggagttgtgatcatttggagaagagggattctggtttttggaattttcagcctttttgagctggtttttcctcatcttagtggatttgtctaccttttgtttttgctgtcggtgaccttcggatggagtttttgcatgcttgttctttttgttgattttgatactgttgctttctgtttgttagttttccttctaacagtcaggtccctcttctgcaggtctcctggagtttgctgggattccactccagaccctgtttgcctaggtatcaccaacagaggctgcagaacagcaaagattgctgcctgctccttcctctggaagcttcgtcccagagggacacctgccagataccagccggagcgcttgtatatgaggcgtctgtcaacccctgctgggagttgtctccctgtcaggatgcatgggggtcagggacccccttgaggaggcagtctgtcccttagcagagctcgagtgctgtgctgggagatctgctgctctcttcagagctgacaggcaggaacgtttaagtctgctgaagctgtgcccacagctgccccccttcccccaggtactctgtcccagggagatgggagttttatctataagcccctcactggggctgctgcctttctttcagagattccctgcccagagaggaggagtcaagagaggcagtctggctacagtggctttgctgaactgcagtgggctctgtccagtcagaacttcctggaggctttgtttaaactgtgaggggaaaaccgccttctcaagcctcagtaatggtggacatgtctccccacaccaagcttgagcatcccaggttgacttcggactgctgtgctggcagcgagaatttcaagccagtggatcttagcttgctgggttccatgggggcggtctcttctgagcaagaccacttggctccctggcttcaggcccctttccaggggagtgaacagttctgtcttgctagtgttccaggtgacaatggggtatgaaaaaaaaactcctgcagatagcttgatgtctgctcaaatggccacccagttttgtgcttgaaactcagggcccttgtgatgtaggtacccaagggaatctcctggtctgggttgtgaagactgtgggaaaagcgtagtatctgtgccggatagcaccatccctcacgtcagggtccctcatggcttcccttggtttggagagggagttccctgaccccttgtgcttcccgggtgaggtgatgccccactctgcttctgctcaccctctgtgggctgtacccactgtctaaccggccccagtgagttgaaccgggtacctcagttggaaatgcagaagtaacccaccttctgcattggtcttgctgggagctgcagactggagctgttcctattcagacatcttgccaggaatcctctatttttgttttatatgaattttaggattgttttttctaactctttgaaaaatgacattggtaatttgatagagattgcattggatctatagattgctttgggcaatatggtcattttaacgatattaatccttccaattcatgatcattggatatttttccaattgtttgtgttatctacaatttctttcatcagtgttttgtagttctacttatagatctttccgtctttggttaaatatattcctagtgtttttttttatagctattgggaattggatagctttcttgattttgtcctcagatagattattatgggtgtatggaaatgctgctgatttgtgtacattaattttgcatcctgaaactttactgaatttatcaaatctaagtgttttttggtgggttctttaggattttctggatagaagaatatatcatcagcgagcagggataatttgacttcctgtttgccaattatgatacctgttatttttttcctcttgcctgattgctttgtcaaggacttcagtactgtgtggaataaaagtggcaaaaagtggacgtccttttcttgttccagttcttagaatgctttcaacttttcttcattaagtataatgttggctgttggtttgtcatataggccctttactatgttgaggcctctcccttctctgcctagttctttgaggatttttatcatgatggtatactgaattttaccaaatgccttctctgcatctattgagatgatcttatggtttttgtccttaattctgtttatgtgatatatcatgtttgttgatttacatatattgaaccatccttgcattcctgcagtaaatctcacctggttatagtgtattatctttttgatgtgctgttggattctatttgctagtattttgttgagcataaccatgttatcattgtgagatcttcttccttaggaatgacataataaatagtaacttttattatcaaagagaaataaatatttaaatattttatatttaaaatattcacattatgtctaataatttacacctctcagaaatattgaatctttcttttatgagcttaaatagtaattttcctatttgatatcattattacaggtaacatttacctgagcctttattatatgccaggtagtttaagctcatttcatgtattaatactcatttaatttctataaaatgttataaggtatgaatttttatcctgattttgtgagaatgtattacatttcacatatttagtatatttggcatatgtgttttacacaatatatttacgtaagatatagaaatgaagtatgtatataattatatgaattaaagtcgaagtgatagagttttttgctttccaattactcaaaaatgtagataaaatatttgatattttggcatgtaggctttatgatatttttcactattttcttcttctcttaatatcagtcccccaactatcccattgttcctgatgttcaaatttgaagtcagtctaaactacttaataatatgtacataacaaattatataaatggtcttctagtcttcaagtgacatgcaactgtttgtatcttataactttttatattctaatgcacgtacacttttaaaaaatggatagatgtggaattttatgtttgaattccctcgtcttattactgtcaattataaacactatagattatcccttaaacaaaggctattcttgttcagaaactgtcttttgttcttcatatactaaccgagtctcactgagatacagatctcactgcatggtatagtcaaaataagcccctggggccaaggatgacaacaggataagttctcaaatcctggacttgctgtatataatatcatgctgttttgtcattgtttcctaatgtaaaataatgtgatcttttaataagggaacaggatatgtcgtagagggttagacagtcagactgtcatttccatttcttctgccaacttgacacctttcttttgtattaaggagttgaatttttcattggtatgctttactgtatagtttgaatcacttattaatactggaagttaacattctttattcttcaaaggatatgtggcttctttgaataattgccatttcagtgatactcctcataccttccagttttgaaggagacttttgtttagaagagcatagtatattttatacatattagtaacatgaaacctgctttctgtattgatcattgtaccttgctgctctgaaaaagtatcatatgcactattatacaaattttattttgtctctcaaaatactactttaagagagttggaatgtttaagatttgaaatcctaagaaaaattggattattatattctttttagtgttataaagaagtagtatgtggtttatattaatatttcgctgaatattagaatttagttattaaaagtagatcaaggaagagttatccactatataaaatttctgacattacttctcaaaaaatttatttttaaagggagatttgaaggaatatcatttatattatttattccttttagaatgtcataaagatgaaattcataaaatgtgtttctccaaggttagaaaatgggataacttttaaaatgtggaacttttaatcctaaaatattaaaggtcaattctcttgtgacttacagtgaaataataatccaggagcctattactgatggaagggaactttcttaccattcaataagcatttatgcatgtttcagccttttatacattttaggtccttagacaataaaagtatatatctaagaaccacatatttcagattgtctcatttagattttagtggagaatttaaaaatagaacaatagtaataatactacaatgaaattcaatagtttaccatttttagagtgctttcttatattaaatgcaacataggtgaagggttaagagagtgagtttgcttgagaaatacttggatttgtatcctgaccattgtacaactaattgtaaacttggactagttatttaatccctccaagctcctgtgttttgctctgaaaaactagattaaaaaaagtatctactccatatggttactgtaaagataaatgaaattaagcatgtaatatgctacatggtccctgcacttcagtaaatccctagtaaacattagctattttaattttctgagccttacaacagttttggaagtagacaagaaaacgactctttttcccattttatagagggaggagatggaggctcagagggattatgtggcatttcccaacaacatagagttgaatcaaagtaagactcagaaaaaaaaaaaaaaccaggacttgtgatttctggtctactatctcaatggagaagatacatgaatttataagaattgagagagacttgacataggaaaaaacagatgtaattcaagtttctgattttcacatacttttgagatgcagagatatagtttgtattagtattagctataaacttgccttgaaatgattcaaaggaagataggttaggatatgtcagatattcccaggtaagaagtcatataatgcttatgtagtgttggttaataaattaacatttgtgtacttcacccttttatgcctagcctatagttatgcttctgctttttttcaacttgaacagagtattattaataatttattcattagattaggtgttaagattatactttcccaaacatcatcaccctttcgtagaaggcattttataacaatatatggtttcaacttatggtttttatcttttctaatttttcatccattcattcttcaaagcagtcattaattcaagcagtcattcaaacaagtactcactatccctgaagctccaaatatgtataggcagagtatcttgccttaagtagcttctcagtctagtaaagaagataaacatgtaaactaataaatttctactaaagcaataatatgcaacagtagaagcaggcatgaaggatccacagaaaaccaggatagaagttaacactgccttttttgggctcacaagaggattcttgaaaaagatctgagctggttttttgagggcaaataagaatttattaggccaaaaggtctgaattttcttactcttacctgcaagtaactaacttacctctgttttgcatacatttactatattgtttcttactctgtctttgttcactaaattatttttcacatgcattcacaactgctcaaatacataatttctcaaagctttcctaatttacaaccttaagatagaatgtaatttgcaaattctcagactgtctacctttatactaagttgtggctgttgtaggaacatttttcttgtaaacaatatagtattatttttgaaaatgtctttgaaatatgggatttattttgctatatttgagttattttgaaagtctcctttaaaaaggcataatagtatcctggacttaaaatttattacaaattgctttagaagaaaaattctataaaatatgattaaactgtgatacaataattccctaaatatggtactgtttagaggagataataggttaccagaacttgcttatgttaattgttttattatgtatagtccaatgtaagggcatttctgtgttacatgaatcaacataattatacttttcttacaaaataagaatcacatttactcttaaaaatcacaagattattttagctccttttgtttcaaaacatttgttttttaggtggtttaaaaattttactaactcagcttattttgaaataccttgtttgtatacccattaagattgcacctctcttaagatggaaatttaggtcaaattacaacttgaatttaactttactacagaaaataactgtgccatcttttaaaaccgcattctaaattttaagcacaatagatcaaagtacatcttatttaaataaatactctggaatgaagtctcaattattttctcacaaactttcttaaaatagtcactgttctcaatataaaatgttaggtttagctttattattttaaagaaagatgaaaagttgtttattttaaaattttaatggttttgctttcaaattatggaaattctcctttggggacatatttatttgaattatatgtgacattatttttatttcttaaggctatgattaaaagtttcatggatgtctaccagcttgcaagcactagaatcatgacattagagaaggaaatgacatctcatcgaagtcacattgcagccttgaaatcagaacttcacacagcttgtttacgtgaaaatgcaagtttacaatcagtaagtccttgtctaacaatatttttataactttttgaatcttgggttacatttacatttatgtttttaatgttcataagatcatttgccaatatatataatttagggtaaatgatcaatcaagtgacataaaattatttgtgtggagaaaaatttgaaagaagaaaagcaattaattttttcattgtattatgtataaagatatgcatattgttatcaatgctaaaacactacatcaagattcctttgtgtttggcagtgcagctgacagttgaatttggcagtatgcatagttaaagcttgcaactgtctgaagattcagtgtgtcccattaagacagaatattattaattatgcgtataaccaaaatggtaattagaacatgtgattattctctgtagaaatctagacttatccataatacatgcctagctaaagatgcatgttgtgattcatctatatgattaaaattcagtttcagcagctattttcatgtcttaaaatttcagcccatgatgaagtttgggctcacttaacactaaaaaaaaaaaaatttctctacttgaaatatatttttggggagttttaaaaaatgaatgtattgtgacataaaggaataagtaaacatttaaactttccctcaaaaggctgatatgtcaacagtagattcagaaggttaccaataattggaatgtctttttaattttttttggtttgattacagtgacttataaagaaaaacagtatcattttgctattccgctgttgacccgcttcaaatgctacattcaacagaaaaagagttagcattaaaacaaatagatgcatggctgtggtctgattcctcaccttctagtcttggctcaagtgccagcgtccaaataaatcctttgtaaccagggtattcaaaatcacaaccatcaactctccctgccccctgaaaaactgtctctcttttgccccatatttcctgtctaccttccacctttcttatttttttcccctctagcagttatcgtcaaactgacatatggtgcattttatttatttgcttattgtttgtttgctccttcctcagtagaatgtaggttccataaagaaaggcagttttcagtgtttgcttcattgctgttaagactttccagttctaagagcagtctggcttatagtaggtgctcaataaatatttattgagtgaaaagtacgagtaatctatccaataaatgtaaaaagacagttatttgggaccagagttgtgagttcagtttttaaaatgactttgttaatttcttaatgagagattagtaaatttgacctccaccaagagaaattaaaatgaagaggaaactttttaaaattttggagtatttggaatttattctagcctttttcatatttcttcttgctatctctgatttgattggttaattttacattatactgtttaagttgtatcagctttgttgggtcatactattactactttttactgttatttaatatgaaaacaattacttgtattttaagaagaccaaacttggtaaggtgagattgtttctccgtgggttccaaaaatttttaccaattgttacgctactgatatcttaatgaaagtgtgtttaatatacttcacaatcataccaaaactctacttttcaacactttttcccctttgaacatatctacaggatacattcatcatttcatttagaagagatggttcaccctgtagtgattcttcatctatagaatgcgaaacattcccccaggtgattctgatgtatccttttaggagaatgctgcccaattccatgtcttgacaggatgtgtgctctcctgtcttttcccttagttgagaatcactgttttaaaaataataaacttgtgtgatggtttttatttttaaaagatatttgtatatgcatttactaacttgaactttttaagaactctctaaaggaaatagaaaaacaaacctttgtctttgtatttcgtagatgagaggcaatattgtttggtgggtaagagcatgggctttggaggtatatccattaggaatactatcaggtgtaaataacagaagatctgactagcacaatttaaaaaatagaggagtgcgcatatctctttgacctactgatttcatttcctttggatatatacccagttgtgggattgctggatcacatgatagttctagttttaattttttgaggaatcttcatactgttttccatgactgtactaatttacattcctacaaccagcgtgtgcaaagattcctttttctccacgtcttcaccaacacttatcttttgttttttgttaacagccattgtaacaggagtgaggtgatatctcattgtggttttcatttgcatttccccgaagattagtgatattgagcattttttcatacacaagtccatttgtatgtcttcttttgagaaatgtctatttaggtcttttgcccattttaaaaatcaggttatttgttttcttgctattgttagaggtccttacttattttggatattaatccctgtcacatgtatagcttgcaaatattttctcccatcctgtaggttgtctcttcactgtgttgattgtttcctttgctgtgcagagctttttagtttgatttaatcgcatttgtctgtttttggttgtattgcatataatttttaagatcatatcccaaaaaatcattgccaagaacaatggcatggagttaccccatgctttcttctagtagtttcagagttgtgatatctgcgctcctatgtttatcacagcactgttcacaatagccaagatatataatcagcctaagtgtccatcaatggatggatggatgaaggaaatatagtatatatacataataaatactattcagtcgtaaaaaagaacgaaatcttgtcatttacgacaacatggatgaatctgtaggacattatgttaaatgaaataagccaggcatagaaagacaaacactgcatctcactcatatgtagaatctaaacaagtaacctcatagtagagaacagattggtggttaccagaggatggagtggataggggagagagagcaatggggagatgttggtcagagaatatataattacagttaggtaggagaaataagttctagatctcttgtacaacatggtgactatagttaataaagacgtattcttgaaaagtgcaaagagtggattttaagggttcctaccataaaaacgatacctatgtgaggtattacatttgttaatagctagatctaacaatttaacaatgtatatatacttgaaaatgtgttgtacatgataaatacatgcaatttcatcttgcaattaaaaaatagagaactttttttctcgcattacaggaagtctagaagtaggtggttattgttattagtttagtggctcaacttttctgtaatttctctactactccctcattgtcataagattgcagcccagatctaggatttgtagtaacattccagtgagaaggatgggatagcccaacaacagcttatatataatgtgttactcagttatatatatgcctccaaaggcatgtatatagatatatagatataggtatatagatagatctctatacacaccttaaaaggcttttccttttaaaaacatatatttaatatttatatatttcaaagaagggaaaatcttctaaagaagctccaaacagatttctgcttatgttccaatagctggaaatgggtcatgtggccacacatagctgaaataagttaagggacaagggagttaggaaggagtggatattgtgttaaccagttaatagtgtgtgccatagaagtcaaataagtttggattcagattctggttctgtcagttgctaactatgtggcttgcatgtcagggctttcatctgtaaaatggggttaatgatattgctacctaatacagatgttgggcagtctagtgagaagtgttaaagtacttaggaccttgcctcacacttagtcaaaaaaaaaaaaaagtcagctattattctgataaccattatcttgatagaaagtcattggattataccacaggaaaagattatttactaacctaacactttcaactacaaatttcatcattttatcctgcttcctactacagccttgagcatgtaactcctcttctttgatcaccattagcatattccagtgactgagctctctgctcctttctgcagcctgttttcctctcctttcattgatacattcttaaaaagtaatctatacttgcttctatatactcactttccatttattcttgagctttggtaccatctgacttttgagtctgtcattctgctgagactatttttcaaaagtcaccaataattttatgcttgctctatccattagttcctttccatccctttcaatttttatgcaacatcaggtctttagctactcctttcttctttaaacactcatctcctttgtttcacatgtctacttttcctttgttgactcccaggcctctgcttacttgtgctcggccttctttgtattattaattcttttctttatctattaattcaaaatttattaagcatctgctttttggtgggcacagttctgttcttggagatatcatacgaaccaaaacagacaatccttgttctcatgaacttaaaatctagaagtggaattatttttcatataatcacactaaataatgtgtaattactaaccaagacaatgcactgaaaggaaagaacttgaccgattatgagttttttaaacaatggggctgtcctagactagggtatgagtaaaacattttcagagtcagtgatgcttgagctagtgactgaagattggataggaattatccaatgatgcaaaagaacagtgatctagatcaggaaaaggggagtggtgacttctacaaagtttctgtgatggaaagaagaaactgagaaagaccagtgtggctggcggaagaaagcaaaggcgagagaggtctaatataagaatggtctggagaaaagggcagaggtcagactttgttctttttcctaagagcaaaggaaaactcactgaaaaattttaaaggaggaatgagctcagatttgcattttaaaaaagatcactttggctacagtgtgaggaaccagctagacatgaagaacaagagaaaatggtgtgcctgggacaattcctagttttttgcttttggaaatggatcaatggtctcatttactgataaagaaaacagtggaatggggggaatattgtgaatgtagttttgagtatgttgagtttgagtttcccttaatctaatgttttggaatgttaatatccactgacatagatggtttgagcatcagggacatataggtagtactttgtaccatcatctctgaaaagcactgaatgtgtgctcatttcctttcctttggaactcacacgtctctgtgttccttattgcatagaccattttctacctgtatttaacaatatagaaataatcattaagtggacattatttgaggtatggagacagaggtgaataagacatgctctgcccttgtgagttcctcttctagctagggaaacagagacataagcaaatcacaaaaataggcatataaaaaaatctgtggatgcacaaatgagagaagagtacattctaacattgtcagaagaaagtgctgagaagataatgtatgtgtaggagtctctgaagaatgtatagcaatttgacacattgtaaagtgggaagagcaatcaaaatatatattttatgttgacttgggtcttatggatagtacatatgtttaatgaatgaaattatcattttgtataataggaaatgtattgttattttagttccattccccctcttaattaaagccacccaactcacccaaacagcccgtacccagtgagcccaagactgcttgcaatagtcattccaaaccttaccttcatcggttcccaatccattcttgcaccatccaattccagctttttactttataatctgatttgattccacttctgaccattttgtttttgatgctctttcttgacctctctcatatttattttggctactctcaaaactattaaccagctgccattttccccttctcacagaaggctttagaatcaggcaggcctggatgtacattctgacactgttactcattagccattaaaacactctaatcatcagttttgatatttgtaataagtagatgaaaattcccacattgtagtgttgttatgaggatgaaacaaagacacagtgtctggcatattagtaggtgatcaataaatattctcttatctgtgtgtaaaaagattttctgatagttatatgtatttcctatagctaagctatactataattttaagaaatatgttaactatgaggaaatctttttatttgtaggcaaaagaactaaaacaacccttatatcagtgcttttaccatataataagtactgtattaccattacttgttgttgttatgacttatttaatgaatcaaggcagccagtatgtactcattactatcctatccagccatttcaccagatacaaaataaatattcattatttatcaaaaacatatgtcatgtcattgtaatgcatataaagagattgatcatattgtagacataattatctttaaaaactatccctctttaggtaacattttcagtttttttagcaacacacaataataatgctggagttcatgtaagatttctcatcagttgtacacttgccagtactttaacttttccggtatgttggtctttggcccattaacttaggactgctccagagcttttatcttgagttataataactagaaagggctttgagtaaagagcttttgagtcccatacagcccagtagagaacagtacagcagtcagaaccaattacttgtgggtgtttggagaccagcacacccacagctatggagaaacatgatacttcagtcttgaaacatagaatgccaaacccaaatactttgctgtgagttatgatgctgcaaactacggtactgatttgcttcatttccactgtatgtttaagcagtatgtttttaattttataggactttatttatgagtaaataataaattacaatgcagaggaccattccattagtgtctttgcgggagaaatatctttgcatcattgttcagattatgtcagatttgatacttgtcaggtggtattatattgttaataaaagtgaattgtttagatattttggttcagttaagatgaaaaaaagggatcctctttctcttaagttccaaaatagcatttcaccacatttattttagttatactttacggatagcagagggatcatttgttaattttagtgttgtgtagctagagaaactgacacagaattaagtgtttttctccaggtaagttgcttccacaaacattcatataccttatcttagttgattattgatactcattattgagtttttagccctttaagaatatttttttgaaacagctgttagccttgacaatttgttgagagaggctatacagtgcacttcaatggtataaagtacagattctggagttcaactccctggcttttaattagaaaccaatcagattacaagccaagacctctgattccctgtcaggtgctttccgatgagactgcaatgtggaataagacaaatctttaccatcatggcacttcagatatagtggagaatacaaccattgtacaagtaattaaaagagggctgttaaagtacaagcgtagggtgctttcagagcatataactgagggacttcacttgggctgtggtgaggaaaggcctgcctggggaattgaaatctcagttgaaaaaaatgaagattacgtcggagttgacatgagaaagcatggcaagctcaagggattgaaagatgtctagcatggttgaagcagagtggattagatggagaattgtgagagatgacactggaggagaaggggccagctgtgtggcatataagctgtgataaatttcactgtttgagaaactctcactgtgatatctctgacaactacattacaaaatatttactccttttgctttattttccttacccaaatttcatttttttcctattctcaaaattcacctgcattttatgtcataacagtgctcattttaccctttgctaaatacttcttagttagattttcattaagttctctcatatttttattgtgactgccagctctggcttttggatactaatagagctgaataaggaaaacataaaatatcaaaaactggacagctcagtcagcatgcaaaatatattttttttgatccttggcatatatttccaaacttttaaaggtttctcatattctagaaactcaagagttgtttgtataggaaacaggggcctggagttattggtgcatattccaatggcctcataccttctttctagaattttgttttatgtaatgcagtttaagaagatgcactttcatcatggtgactaacccaaatcctgatagtgacttttgggacatgatataaattttgtatttatgtaaatataagtatacattcatataatataaaacatattagatatatattattttgcatatcagtataaacattaatatatatttatatagttctattccacagtgatgaagttttacaaggatggagcaagaagtgccagaattaaaatttcaaagtgatcagtataattgattagtaattaagttgcagaaaatatggatagtaactggcaacataatgctctaattattcctattagtttttcaaagaatggcaacaactaaatatgcttctgagtgtctcccctactattttgtcttttttaccaaattgagttctttaagggtttcaattacctattaaacatctgcactttgattttctgcaaaagcctgaaattcactgaggtcccaaactgaacacttttttcaacacttctgtgccctgtttctcctaattctcctttgcctgcattgcttgtctctgaaataactgtccaccttgcagcccaaggaagagtccttaacttttgttccactttccctctaccaccaatatttaatttattgctaagccttactgtttctaccaccacagatctcttagacccatcctcttatttctatctgtgtggtcacatgaccatttccctgggctattgcaatggtcttccaataagttttctcatatctagtcttttttcttctattcaccctgccttattagtgccagagttatccttccaaaacacagatatggtcaggtcatagcattactgaaaacattttcaaacttttaaagatttctcatattctagaaactcaagagttgttttttctctacagtttccccataataaagtatgagttttttaccattgacattctggcatattctgactccttctggtttttttcaccattgttcaattggcagaagaagtaagagttcctttgttctgatcgtttgtcactgtatttacatgtgtgagttctgtatagtagtctgacttacgtaaccaattagttgtgtatgtattagcatattgtgagactttgaggtgatgtcttagtcatatttataatccattataatgatcagattttaataaatgctgcttgatttgaattgaaattaatgagaaggtcactcatttcataatatttgttcaatctatacttgttattggacctatactttgcataaaccatgattccctccgaatttttcccacaccaaattttctttaatttccatcaaactgttttatattattctgtattagcacttaatgaaaatgagtagaataatttacatattctatatatggtaaaattttaagtaaatacttttaaataatatacattggatgtttcttctcactacttttcctaaaaaaaaaagacaacacagaattatttgtgacaaagaagaacattcttttcaacataccacttaaatgattttctcagatattttggcacccctacctctgggtgtttatgtagaggtggacatacatagacataaaattaccatcataataccttttacttacatggtatatactcagtaagtgtttgttagtgacgatatactgagttaaaatgaactctacttaggcctagcaaaaagtaagactttatgttatttcagaaatagaggtctaatttacataaatcagtagaaagtttgttttcaaaaatgtgtttccttgaagtcttccctcacactatatacagaaattaactaaaaatgaatcaaagacctatttataagagctaaaactataaaattcttttttaaaaattatgttttgaactgacacattataattgcacatatatctggggtataatttgatgttttgatgcatatttatgttgtataatgatccagtcagggtagttagtgtatccataatctcatgcatttatcatttatttgtggtgagaacattcaaagcctctcttctagctattttctaatatacaacattttactgttaaccatagtcacatccatgcaataaacattggagtgcagctatctctttgacctactgattccatttcctttggatatatacccagtagtggtatttctgggtcatattgtagttctatttttaacattttgaggaaactccataccgttttccattaatagctgtactactttacaaccctaccaacagtgtgtaaatgttccctttttctccacatccttaccaacatttgttttcttttgcctttttggtaataatgattctaactgaaatgaggtgatatctcattgtggttttgatttgcatttccctgatgattagtgatgttgagcattttttcatatgcctgttatctacttgtatgtcttcttttgagaactgtctattcaggtcttttgcctatttttaaattggggtctttctttctttctttctttcttttttttttttttttttttttgctgttgagttgtttgagttccttatatattctggatattaaccctttgagaggtgtatagtttacctatattttctgccattctgtaggttgtctctttactctgtccatcatttcctttgctgtgcaaaagctgtttagtttgatgtaatcacatttgtccatttttgtttttgttgcctgtgtttttgaggtcttactcaaaaaattcttccccaacccaatatcatgaagcatttctcctatgttttcttctagtgttatcatagctttgcattttacatttaagtctattacctattttgagttgatttttggatatggtaagaggtagggggtctaatgccattcttttacatgtggatatttagttttcccaatactatttattgaagagattgtcctctccccaatgtgtgtgcttagcaccttaggtgtatgactttatttctgggttctctgttctgttgcattggtttatgtgtctgtttttatgccagtaccgtgctgttttgcttactatagctttgcagtatattttgaagtcaggtagtatgatgcctgtggctttgtttcatttgctcaggattgttttggctattcagggtttttgtgtgtgtatgtggtctcacatgaattttagcacttttttttccatttctgtgaagaatgtcattggtcttttgatagggactgcattacatctatagatcactttgggcagtatggccattttaacaatattaattcttccaatccatgaacatgggatatcttttcatttatttgtatcctcttcactttattttattaaaatgttatagtgttcagtatagagatttttcacatctttggttacgttgcttcatagatatcttacttttttatagctattgtaaacggaattgttttctttatttctttttcagatagttgactatttgaatattaaaatgctgctgatttcttatattgatattatatcctgcaactttactgaattcatttattacttgtaaaagtttttttggtgcagtttttggggttttctatgtataagattatgctttctgcaaacagagacaacttgacatcctcctttccaatttagataccttttgtttctttctcttgcataattgctctggctaggacttccagtactatgttgaatagaagtggcgaatgtggatgtccttgttttcttcctgattttaggggaaaaacgtcttctccccatgcaatatgatgttagttatgggtttcccataggcctttattgttttgaggtacataccttctattcctcacttgttgagagcttttatcatgatagattttgaattttgtcatcctttttctgtgtctattgaaatgatcatattttgtctttatgttaatgtggtatatcacagttatggatttgtgtatattaaaccatccttgcatccccatgatgaattccacttgatcacagtgaataatctgtttaatgtgctgttgagtttggtttgatagtatcttgttgagaaagtttgcctctatgttcatcagggatattggcctgtagttttttttgtctgtgtgtccttgtgcaattttggagtcaggataatgctgacctcataaactgaatttaaaagtattttctccttttcaatttgctggaatagtttgagtagaatttttatttcttcttctttgaatgttagatagatttcagcagtaaagccatcaggtcctgaacttttctttgatggaagatgtttaattaagatgttcaatttcctcacttgtttttggtctgttcagattttctatttcttcgtaatttaatcttggaaggttatgatcctttatatttctgtggtatcaattgtgatgtcttctttttaatctctgatattatttattttttctttctttttcttagtcttgctaaaggtttgtcaattttgtttacttttccaaaaaacgaatgcttcagtttattaatcttttaaattatttttcttagtctctacttttaaaaattatttccatccttctaccaattctgggcttagtttgttcttatttttctagttcctggaggtgtatcattaggttgtttattagaaatctttcttcttttttaatgtaggtgctataagcttccctgcaagaatggcttttgctgtgtctcatagattttggtacgatatgtttccattctcatttgtctcagaaaatttaaaatgtccctcttaattttctttaacctttaccttgcactatatacaaaaattaagtcaaaatggattaaaaacctacataagagatctaaaactataaaatgcttagtaaaatgcataccaataaatcttcatgagcttggatttggcagtggattcttatggattcttagatatgacaccaaaaggataagtgacaaaagaaaaataataaattgggcttcttcaaaattaaaagcatggaaagactctatcaagacagtgaaaagacaacccatagaatgggggaaaatatttataattatatatctgattaatccctgatatccatactatgcaaagaactcttacaactcaacaacaaaaagacaatctaatttttaaaaaatcacagaggacttgaacagctaattctccatagaagatatgcaaatgctttgggaggctgaggcaggaggatcacttgaggccagggagaccaccctgggtactatagtgagacctcatctctacaaaaactaaaaaagattaactgggcgtgttggcatgtgcttgtattcctgactacatgagaggccaaggtgagaggactgcttgagcccaggaattgaaggctgcagtgagctatgatcatgccactgcactccagcctgggcaacagtgtgagaccctgtctcaaaaaaaaaaaaaaaagaaaagaaaagaaagaaaaggaaaaaagaaaaggaaatgcaaatcaaaaccacagtgagatgccactttacacccactaggatggtcataattaaaggaagataacaagcattgcaaggatatggagaaactggaacccctatacattgctggtgggaatgtaaagtggtaaaccactgtggaaaatgattcctcaataagttaaacttggagttaccatatgacccagcaaatttactcctgcatatatacccaaaagaattgtaaacaggtattcatacaaataaatacttgtatacaaatgtctatagcagcactatttacaaagccaaaaggtacaaacaacccaaagtccatcagttgatgaataggtaaatgccatacagccaaaccatggacgaataataaaattcagcaataagaagggaagaagcactgatacgtgttacaacatggatgcactgtgaaatcgttatgctaagtgaaagaagccagacacaaaaggccacatttgtatgattccattttatatgaaatatccagaataggcaaatccatggagacaagaaagcacattagtgattgacagaggctagggggaggagaggatggagaatgactgcttaacgcatatggaatttcattctggggtgatgaaaaggttctggaactacatggtggtgatggtggcacaatgttgtgaatgttcctgatgccattgaattgtacactttaaaattgcaaaactagtaaattttgtgtgtattttatctcattaaaaatatttctttgagttcttgggtggtgtaggataggcaggtagattgttgcttacacaggatggcaatatgttgtagtggaaagagcatgacagagactcagaggaaatttgagttctagagcaaactttactattgactcacctcaaagctttgggaaataaattgtgctatctccctgggtcttggttttcctggctgtaaaatgaagggttgctatttgatgaaatctaaattccctgtcagctttaaaattcttcaattgaagttacaaatactgattttgaatccaagagtctaactatgttttgtcttgttcctgtgtcagtttacaacaatagattaagtgtgtttctaaatttataataaaattatatgttgaatttggttatattagcatataatataaatgtaagtcatttacaaatgtataccagttatgtgagtctcacaatgtgacttgtaactaggtagtcaataaatccccaaagtaataaaaaaatgtattagcgtatttgtaaggagtatttcctttttttatgcaacattttttgatacttaatatgttaggaatgtgaacttttaactcatcagactgttgtaacatatttgaaaattatagtaatttgattaaaatgttgcctataaggcaaaagccttagttaatagaatccatatgtaattaaaatgcagaactaaatgtaatcagactccagtgactagtgccttcatattgatagttttacaatggcctctggggttgaaagtttaaatgttacagaatgtaacaacattgcagaaaacaacttaggctggcaatttagctgtttgaaagtcatcaacatagttacttgataagatgtgactgtcacattctagattctcatcattttatgaataggtactgttggcaggtggtagaagcacaagactagtgttccagtggaggactatgctttgcagcactgttatataaacagacccagatgaaggtccctgctagaagccaagccactgccttcttttcttttttctttcttaataacagagttgcttaatttgggtgaattcatttgaatcatatgaaagttatagacacgacactatgcaccaagccacaaaaaaaaagtcaaaaattttttcctgaacttaaagaaattattttctctggacagttttaagagttgacatcctgtgttagagttctctaatcatcaccagcacaatttacaatcagaacacacagagagccagttcagaccagctcatctgttgatcttggcagagacccttcatctcattgtgtgcagctgccacttgagagttgaggggactcagcagagagcgagaggagggtgggatgcaaggctggtcaaggcatgaacacttgggcctgctgcatttcaacagttgtatgttgcttgaaaaaatagtcttttttattatactgcctccccacctccccttaacctgaaattaaacgaggacctctcatgagccactgcgctccaggcataagaaattgtaatgtctggcttccagaaactgtcccgtcaaaatgtgcttctgattaggtggcttaattacagctgtgaaaacaatgttgatttaggcctcaagattccagggcatgtcagccgttattagctaaccttggactgaatccatcattttaaaactctgtaccactaaagtcaccctgtttgacaactttttttttaggtggaaagattgccagaagcaacacattttatgcaaaatattgctcagtgcacaatttcaactgcagcaccattagtggacattaaagggatagttaactttgcactttatcaagaacaaggaagtgctgtttgtaaaaacagtaagttttgaatagtatttttaaagagttgactgacataagaattaattttaattcctttaattcagttttatttcaaatccagcatgttggtttaaccgcccaattttattacacctaaattttcctgacagtttcatttgctgttaggaaataaaattgcaatttttttcaacatgggaaataatggctagtttaaaaaatgttgtgtttgaaacttcctttgcctcaagctggttcagagacaacctcagtttacttttggaaggaaatgaacctcattaaacagtttttaatattttaatataagtaaattttttcatagtgagaaaaaagcttattagactcatgtatttacaccttccagggaagtaaaagttgtaataattagatgattccaatactttagaattttctatacaattgtcactggtataaatataactatgtattgtaaggagttccaattccattgtattttagatgtctaaaatcccccttatatactatgaatacttttttgtcagcagttttaaagtagacattattttaaaagtcattactaaaaaagcacactggggagttgaacaacaaacataaagagtcataattctcattataattttggaataaagttttgcttgaaaatgctgaatttatgccaagcttaatacctaagagagagagctaaatgatttctttaaaaggaaatctcccacacccaagacgttaaatacagtgatgtgggtggtcaaggcacatctttttctactgggtaaactcattgagtatttaactctgtcactgtgaatcatgtatggacaaggaagcttttgtccaagttaagagttaatacatagataattaattgtgaggaatggatgggtgaagagatgggttggtaatatagtatgtacgtcttgaaagagaaagatgagcaactgattcaaaatagagaacaaattagtaatcccgtaatctaaataatatcagtaacacctgattgccagatactgaagagacactttacactggtatctacctcatctattatttaatttaatctttataccagtcttatgagggaaatgttatttcctcaccttgcagatgaggaatctcagtcccagagagaatatgtaatttgctcaataccatgctgtttgggtctagactggaaccattatctgtgtgtccaaaacccgtgctctaaactaaagatgggaatagattttctttttgaaaatgaattccaggttatgaaatagtggggaaaaattaagaatgaccaagtttacatggagtgtgccttactctgtgcatacactattaatagagaagagcatttaagcttaaataaaagttttacagttttctacgaaaaaaaatcctaatttttttttcttttaaaaaatgactgtatataaagactcacaaattcactgggtctatggttaaggccttttacctagaacaaaaggatctttctctttccttttgaagttactttatgcacagagaattgaaagtgtacatccttccatgttagactggtttgaagtttggatatattgcatttgttcttaagattctatgttagctgagaaattgggaagaaatagctgtctttcccagaactttggcttagggcatactttgatagaatctgaattcagcttattcttttggatattcttttgttctccatgtttgcctgacaccaactggaaagatactcttccagaatgtaaggggccagctaaggttacaggactttatttttctagtctctaccactttatttttgattagttctaactaaaaatatgaatttgtttgaaaaaataatgccatatggatagtatacacaatagattttatttaattttttcatgataaaatgattgctttgatatatcattttgtggtgacttatgacttaatttttcacgatcttttattaaataacattaatattatagattcttatgattataattatgtacaccctagctggttttgcctcttcttgataatataacctttttttttttgagaaaagaaaatggcccaagaaggagttttgaagaattatgtctacacctatttatatctatatactgtgtctaaatagataatatccatatagatataaatattctcactatttcatggtattatactattttggctatggagtaatcactttttaatatcttagttcatgtacttatatatcctgattcatatttatttgcatacagaatccttcagttgtagaaatatggtatttatcctacacaggtaaaaaaaagaaaagaaaaccctgcagaatatttgaagtcagattattgaaacaattcaacttttataatcacatagtttgtttccttaatggcactgcaataaaggacatcaggtatatataatgcttcttagcagtgattcaaaagagtttaaattggtcaccatttcaataacaaaagtgcatgaaaaagtatagggtagttatttattagaagcagccattaaataagtctcacagtcttgtttatctctatctcatatggatacctcaggctgggagtgggagaagcctagagaacagaatttttacttccaccacttccccgagcagaataactttacttttatgtcatttagaaattaaattttgaaataagatttcatgtaataaatgcattctgctgcttaaaaatttggaagcggtagtccaccctggaataactgatctgttaaataagtagttatttgagacaccccggaacaaatgatctgttaaaaaagtagttaagtatgtcataaagtatcaattacatactcaaggcaaaaaataatgaaaagggatggataatttcatgataacttctacactttgtaaaattattttatttgtttcatgactgcttgaaagcctgaaaatttaagacttgtttttgtttcttccaacaaaaatacttttgctttactcaatgcgtacactctttttggcactacttggtacagatcttgattattgatgccatacaactttatatcatttgtttagtggataaaagcaatacacataattttgctaagagtgtaaaattatctttgaaataatgaaatatatgtaaatacatgttttacagtctatattttgtatttgacctttataaacttaatgaataaagacttttcatagtaatatactgaagcatggatttcccacccatagtatttgatctacctgtagaactcagaatcttatctaattaagctgcaagtcatttaaggtcatttctctttttcaatgattgaagggaattttccaggaaattaccagttacactggtaactgacttgacttctcaacttcccacataaggaaggatatacacaataatttcttaatggaaataagggttcggtccctttgcacaaagtcaaacttgcagaccaaatgtgggaaccaacaaggatataaaaaggtactatctatcatcaaacatcttgtactatttgagtacaataaacaattttctctctccatctccctcaccagaagttatacatattcactgttactatagctttatctcctcaatatttctcccctttatttttgaggtacagagaaattgaagggatatgctcctaattttgtgtggtggaaagcaaactggactgtggagtcaagagctaagaccttgcctctagtcccagctactcaggaagatcaggagaattacttgagtctgagagttcaagaacaaccaagggcaacctagtgagaccctatctcactaggttcaaaaaacaaaacatagcgttaagaagttaatctttgccctgccaacattagctatatgatcttgggtgattaacctctctggtagttcccacgactgtaaaaggtggagattggactagataatctctaaggtgccttctggtactaaacaagtgttttctcattcactttattattattatttctgtcatagccttccatgccacttaaaggtgtccctctcagggccttgtgccacctaagtgttacctcacccagccggcagactattgcagaggattcagatcattaacaacagtaatagcatatgtttcagtttctattttttagaataacaaacaaaatgagtatttaaatatttaaagtttttcacctttgaaattgaatatttggcagtcaggaatgcatagaaagttagtgtattggttaatggagctcgccggtagcgattcaatacttggttaacttattactttgtttaacacttctggacactattgtaatcttaaccattttcagtttaaacttgtttttattgttattcacatttaatttgcacccataatataccattgaatagataggaaaccttaaaaaaaacactgagtttgaaattcagtgataataaggaatcttaaaaaagataattagggaaatttacctcagtcttcaacagatccacaagttccattcatctgatcaaaattcttataccaacgcttgatatttttaatgtttcaaagccagtgttaagaagagagaattgtgataactttatttagattggctgtacatttattgaaaatcaagtgctacaatatataatttgaaagaagtgctagacagtagcagcctgaaatgctctcttttaactagccatttagaaacaacatactcaatattatataaaagaagacaattcatttttaagcataaaatgcaaagaactaacataaggttaccagttaaaagggttacctatctattgtttttttaaattggtttgtttttacttacattcagtttttattatttaaaaaagcacacattgaccacattgctttttaacatgttcagccacatttgaattctttttctttttaaatataccatgctctcccccatgagcctttatgtatatgctgatttcttgcttggaatagtattttcagcctttcacctacttgattttttcccaagttttaaatcccaagtctctccccaaacatcctcttgtataattataacattaattgtatcatattacaattgatttttagttgactaatcctattctagaagtgctatgtgagtaggagattgctctattcctagatgtcactacgatacctaatactggtagataacaaatagtttgctaaaaattccattataaattccaaattatgtggatcaagttaaagttcataagcctatttggaagttcagatatcaaaaagcaatggctgtaattggtcttctgtctctatgggtccggaatttctttattaataaggtcgtctggtatgtcagattattactgaaaatgtcatatttctgtggtctccctgcccctttcttaagggaaggagaaaggaaaggagagaaattgctgttgtgtgggttgtatttgaattgttcacctgagatcaggaattgtgtcttgtttttaccttattcagtgcctagcatactactggagtacaataaataagtaataatggtgaggaatatactagtagacaatctgtagcgctgaaaaataatgcaaagaatggaagaaatattcttttaagttctaagttcaggtaaagagagtgctttgggatatgtttttgagtttagtaggaatcataatttctgcaacagattgtccttatgtgttgacattccatatccttaagaagaaaatactgaattattgtgctttcccagaagaaatatagagaaagatatagggtattatagaaattttaaactatgaccaaatgctcctacaatattaatagcaatgtagaatggtaagtttaaaaaaaagaaaaagaaacaaagcaattcaggaggcagatggtaagaatgtcagcccacctgagaatagctctgaactctgagctttaactgctgaacccaaaccaagccgtataaggagatgggtcctgagttaaactgctggctgtcttgtcagctttgtttgatgttacttttccctttgaagattttgtgtttcgtatcaagtttgtggcaacataagaatggttctatattacatgtgtgtttctcagcattgttaacagctttgtctttattgtcactgatatatttaattcagtgatcctagttcgcatggtggcagtgtggtattttcatcagtttaaggatgagaagagcagagatatttaaaaggaaatgtcaaaagactttttctttagatctgtgccagaaaaaaacacttatttatgatttagaacttatgagacacatatagggtacattagacaggatgataagaaattgtgcttgcttttatttctgcaaatggtgggaacattgtatgtttaaaaagatcaggttattgatatgaaataatttaacaattaaacatataatagcaatgaattaatacttgtatatttagaaccagatgcaggtctaagtatatttttgattttgcaaagcttgggatctcgaagtcagacattgtgtattatttaaccttatagccttagcagcacccacactgtacctgactcattgccaagtgcccaacgaaggtttattgaatcaatcaataaattatcttcccttttgaagagttctaaaatcttttagagctctttctcttcccatcttttatgcaggcaaggtagttgtatctgcacatggattgaatacaaaaaggcataatgaagagttgctgatttgatggaacttataatcagttggtgagtcaggatagactcctgtagtgcaataaggtgataaatgctcatggggtttgaaaagataaatttattgaaatgagatggttagggaatatttttaagaagttgtatttgagcttgattttgaaggaatgatagggcttgaacaaggaattccaggcagggagaactatgtgaaccgaaacaggatgccactagcctgtaagagagtaaggttaaactatgtgttgttttttcttttgcagtaatgttgatgtttttatttctttctgcagttctttacaatttttgaaatatacccatatacatacccttacaggtttttttgtgataaacgtgatatttgtaagattcagaaaagttgggggattttctcagcatcatctagttattaaaccaaagagctgagagtgctggctttttgtaaaccactgtggctattgcttttctttttggccaaagtcatctacacttaattattgaagccttcttgtgaccactggaaagtatctttcaggtaaaggcataatctgtgaacatgaaacagaagaggacttgtcgatatatagtttttgagccagagggttgctaaaatgctgtaaaaggaaaggatggggaggaggagaaggattagctaacatttatctaatactttccatgtgtgagacattgtcagggccttaaatgtgttaatgtattcaatacttacaacactcttatggggatatattatttttatgaactcttattatgctgtattgcttattacgtattgaagcaaatatttgaacacaggcagttcagctcaagagcccattcatagtagctaggcatgcgggtttaaatgaaaggatgcctgtaaggttcctgttattattgttaatgccatttcctttatgttataatcaattgaggatagacataatttttacttgttttcaaagtaggaaggaactaccaaggccacaaagtaactcctttattctaggcagagcatggtagttgggttagaattctttttctttcttttttctttctttctttctttctttctttctttctttctttctttctttcttttttatcattatactttaagttttagggtacatgtgcacaatatgcaggttagttacatatgtatacatgtgccatgctggtgcgctgcacccactaactcgtcatctagcattaggtatatctcccaatgctatccctctcccccgcccaccccacaacagtccccagagtgtgatgttccccttcctgtgtccatgtgttctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcgttgttggacatttgggttggttccaagtctttgctattgtgaataatgccgcaataaacataggtgtgcatgtgtctttatagcagcatgatttatagtcctttgggtatatacccagtaatgggatggctgggtcagatggtatttctagttctagatccctgaggaatcgccacactgacttccacaatggtagaactagtttacagtcccaccaacagtgtaaaagtgttcctatttctccacatcctctccagcacctgttgtttcctgactttttaatgattgccattctaactggtgtgagatgatatctcactgtggttttgatttgcattgctctgatggccagtgatggtgagcattttttcatgtgttttttggctgcataaatgtcttcttttgagtagtgtctgttcatgtccttcaccccctttttgatggggttgtttgtttttttcttgtaaatttgtttgagttcattgtagattctggatattagccctttgtcagatgtgtaggttgcgaagattttctcccattttgtgggttgcctgttcactctgatggtagtttcttttgctgtgcagaagctctttagtttaattagatcccatttgtcaattttgcctttggttgccattgcttttggtgttttagacatgaagtccttgcccatgcctatgtcctgaatggtaatgcctaggttttcttctctggtttttatggttttaggtctatcgtttaagtctttaatccatcttgaattgattttagtataaggtgtaaggaagggatccagtttcagctttctacatatggctagccagttttcccagcatcatttattaaatagggaatcctttccccattgcttgtttttctcaggtttgtcaaagatcagatagttgtagatatatggcattatttctgagggctctgttctgttccattgatctatatctcagttttggtaccagtaccatgctgttttggttactgtagccaaaatctccttaagctgataagcaacttcagcaaagtctcaggatacaaaatcaatgtgcaaaaatcacaagcgttcttatacaccaataacagacaaacagagagccgaatcatgagtgaactcccattcacaattgcttcaaagagaataaaatacctaagaatccaccttacaagggacgtgaaggacctcttcaagtagaactacaaaccactgctcaacaaaataaaacaggatacaaacaaatggaagaacattccatgctcatgggtaggaagaatcaatatcgtgaaaatggccatactgcccaaggtaatttctacattcaatgccatccccatcaagctaccaatgactttcttcacagaattggaaaaaaatactttaaagttcatatggaaccaaaagagagcctgcatcgccaagtcaatcctaagccaaaagaacaaagctggaggcatcacactacctgacttcaaactatactacaaagctagaattcttatagttttgaattagatgccttttgatgggcatttttgtacctctgcctaagtaaatgttgtttagttaggtttcaagatatgttgttaaatgcttgacttattgatgacggggagatagcacttttatatataaacactttttttctgaattacagggttttgttgtttaggttgtacaattagcattttaatctgtctcagttttattgtatcataagaatctgtgataataaaattacattcatttagaaactaaaaaacatgattctaacaagtcaaactaagttgggattttagaaagacaacaaatacctataatatgaatttggataatggaagaacaagtgatgtgtgtcaccattgttataaaccctttctacatatatttattagaaaattatagttgcatatatatcatagaaattctgagaccttaacattcatagacgttaaaaacttatagggtgtttgtggaatttatggataaaagcttatgttatgacatcactaaatacacttttaaaataccctacttgtatacccattaaacagtaatttcccatttcccccatctccctagatcctggcaatcaccattctattttttctctattattttgacgactctaagtatttcatataagtagaattctacagtatttgtcttttcgtgcatggcctatttcacttagcataatgtcctcaaggttaatacatgttgtagcatagtagcatatatcagcatttccttcttttgtagggctgaataatattccattgtatgtatatagcacattctgcttattcagtcatccattgatggacatgggttacttccttgttttagcaattgtgaataatgttcctacgaatgtgggtatacaaatatctcttcaagaccctactttcaattctttcagggttatacccagaagtgaaattactggatcatttggtgattctatttttttttcccagtggttcataatgggcatacaagtatgcttccatattttttttaatttttttatttttttttaatttattattatttaggttttagagtacatgtgcacaatgtgcaggttagttacatatgtatacatgtgccatgctggtgcgctgcacccactaactcatcatctagcattgggtatatctcccaatgctatccctccccgctgcccccaccccacaacagtccccacagtgtgatgttccccttcctgtgtccatgtgttctcattgttcaattcccacctatgagtgagaatatgtggtgtttggttttttgttcttgcgatagtttactgagaatgatgatttctaatttcatccatgtccctacaaaggacatgaactcatcattttttatggctgcatagtattccatggtgcatatgtgccacattttcttaatccagtctatcgttgttggacatttgggttggttccaagtctttgctattgtgaataatgccgcaataaacataggtgtgcatgtgtctttatagcagcatgatttatagtcctttgggtatatacccagtaatgggatggctgggtcagatggtatttctagttctagatccctgaggaatcaccacactgacttccacaatggtagaactagtttacagtcccaccaacagtgtaaaagtgttcctatttctccacatcctctccagcacctgttgtttcctgactttttaatgattgccattctaactggtgtgagatgatatctcattgtggttttgatttgcattgctctgatggccagtgatggtgagcattttttcatgtgttttttggctgcataaatgtcttcttttgagtagtgtctgttcatgtccttcgccccctttttgatggggttgtttttttcttttaaatttgtttgagttcattgtagattctggatattagccctttgtcagatgagtaggttgcgaagattttctcccattttgtgggttgcctgttcactctgatggtagtttcttttgctgtgcagaagctctttagtttaattagatcccatttgtcaattttggctttggttgccattgcttttggtgttttagacatgaagtccttgcccatgcctatgtcctgaatggtaatgcctaggttttcttctctggtttttatggttttaggtctaacatttaagtctttaatccatctcgaattgattttagtgtaaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctcagttttggtaccagtaccatgctgttttggttactgtagccttgtagtatagtttgaagtcaggtagcatgatgcctccagctttgtttttttggcttgggattgacttggcgattcgggctttttttggttccatatgaactttaaagtagttttttccaattctgtgaagaaagtcattagtagcttgatgggtatggcattgaatctctaaattaccttgggcagtatggccattttcacgatattgattcttcctacacatgagcatggaatgttcttccatttgcttgtatcctcttttatttcattgagcagtggtttgtacttctccttgaagaggtccttcacatcctaggtattttattctctttgaagcaattgtgaatgggagttcactcatgatttggatgtctgtctgtctgttattggtgtataagaatgcttgtgatttttgcacattgattttgtatccagagactttgctgaagtcgcttatcagcttaaggagattttgggctgagacgatggggttttctagatatacaatcatgtcgtctgcaaacagggacaatttgacttcctcttttcctaattgaataccctttatttccttctcctgcctaattgccctggccagaacttctaacactatgttgaataggagtggtgagagagggcatccctgtcttgtgccagttttcaaatggaatgcttccagtttttgcccattcagtatgatattggctgtgggtttgtcatagatagctcttattattttgagatacgtcccatcaatagttaatttattgagagtttttagcatgaaggagtatcagcgatggaagatgaagtgaatgaaatgaagcgagaagggaagtttagacgaaaaagaataaaaagaaatgagcaaagcctccaagaaatatgggactatgtgaaaagaccaaatctacgtctgattggtgtacctgaaagtgacggggagaatggaaccaagttggaaacactctgcaggatatcatccaggagaacttccccaatctagcaaggcaggccaacattcaaattcaggaaatacagagaacaccacaaagatactcctcgagaagagcaactccaagacacataattgtctgattcaccaaagttgaaatgaaggaaaaaatgttaagggcagccagagagaaaggtcgggttacccacaagagaagcccatcagactaacagcagatgtcttggcagaaactctacaagccagaagagagtgggtgccaatattcaacattctgaaagaaaagaattttcaacccagaatttcatatccagccaaactaagcttcataagtgaaggagaaataaaatccttaacagacaagcaaatgctgagagattttgtcaccaccagacctgccctaaaagagctcctgaaggaagcgctaaacatggaaaggaacaaccgataccagccgctgcaaaatcatgccaaaatgtaaagaccatcgagactaggaagacactgcatgaactaatgagcaaaataaccagctaacatcataatgacaggatcaaattcacacataacaatattaaccttaaatgtaaatggaccaaatgctccaattaaaagacacagactggtaaattggataaagagtcaagacccatcagtgtgctgtattcaggaaagccatctcacgtgcagagacacacataggctcaaaataaaaggatggaggaagatctaccaagcaaatggaaaacaaaaagaggcaggggttgcaattctagtctctgataaaacagactttaaaccaacaaagatcaaaagagacaaagaaggccattacataatggtaaagggatcaattcaacaagaagagctaggtatcctaaatatatatgcacccaatacaggagcacccagattcataaagcaagtcctgagcgacctacaaagagacttagactcctacacattaataatgggagactttaacaccccactgtcaacattggacagatcaacgagacagaaagtcaacaagtatacccaggaattgaactcggctctgcaccaagtggacctaatagacatctacagaactctccacccgaaatcaacagaatatacatttttttcagcaccacaccacacctattccaaaattgaccacatacctggtgattctatttttaatttcttgaggagctaccataatgttttctacactgttgtactattttacatttccaccaacagagcaaagatcctaatttctccatcttccatttgcttggtagatcttcctgccaacacttgtgattatctgttttttgtttgtttgtttgtttgcttgtttttttaagtagccgttctaatgggtaggaggtagtatctcattgtaggtttgatttgcatttccctaatgattagtgatgttgagcatctttatatgtgcttattggtttgtttgttttttggagaatgttgatttaagtcctttgcccattttttaaatcaggcattttgttgtcattgagttttagaagttttctatatattctggatataaatcccttaacagatacatgatttgcaagtattttctcctgttctgtgggttgcctttttactctgttcatagtgtcctttgatgcacacaatttaaaaattatcaggaagttcaatttgtctgtttttttcttttgttgcctgtgcctgttgtgtcaaattccacaaatctttgccaaatccagggttgtaaagctttcaccctgtgttttcttctaaaaattttataatttttggtcttacattaggtccttgatccattttgatttaatttgtgtacatagtgttcttcattctttcttcagtgaacttcttcaacttcattcttttgcatgtggacatgcagttctcctagcactgtttgttgaaaagacgtattttttccccattaaatggtgttgacatccttgtcaaaactcatttgaccattatctgatgctttacttctgagctctctattctgttctattggtctctatatctgtctttatgccagtacacactgttttgaatactgtagcttagtagtaagttttgaaatcaggatgaatgagtcctccaactttgttctccttttttcaatcttgttttgggtatttccagtcccttgagattatatatgagttttaagatggattttgctttgtttttttagagacagagtctcgctgtgtttcccaggctggagtacaatggcgtgatctcagctcactgcaacctcggtctgctgggttcaagtgattctcctgcctcagcctcccaagtaggtgggactacaggcatgcaccaccaagcccggctaattttgtacttttagtagagacggggtttctccatgttggtcaggctggtcttgaactcccaacctcaggtgatccacctgccttggcctctcaaagtgctgggattacaggcatgagccaccgcgcgcggccagattttgctatttctgcaaagaatttcattgggattttgatagggagtgcatcgactctgtagattgccttgagtggtattgacatcttaagaatattaagtcttctaatccattaacatgagatatgtttccatttcttcatgtttttaatgtctttcagcaatgttttgtagtatccattatacaaatgtttccacctccttggttaatttaatgcctaggtattttattctttttgatgctatttaaatggaattgtttttgtaatttgcttttcatatcatttattgttagggtatggaaatgtaactgatttttttgtgttgactttgtggcctcctactttgctgaattcatttattatttcttacagtattttgtgtggaatctttagggttttctacatgtaagagcatatcatctgcaaagaaagataatttcacttcttcttttccaatctgagtgccttttctttttcttgcctaatttcctttgctaggccttccagtactatgttgaatgcaagtggtgaaaggagtcaggtttgccttgttcctgatcataaagagaaagctttcattctttcaccattgagtaagatatatgctccgggcctttcatatatatgacctttattgtgttagggtgatttccttctattcctagtttgttgagagttttaaattaggaagcagtattaaatttaatcaaatgcttgtatgcgtgtatcgagatgatcatgtgatttttagccttcattctgttactgtggtgtatcacataaattggcttttgtatgttgagctctccttgcatcctggggtaaacccacttagttatggtgtttggtcattttattgtgctgttgaattcagttgcttgtattttgttgaggatttttgggtctatattcactggggatattgacctatagttttcttttcttgtgatacatttgtctggctttagtaacaggataatgctggcctcataaaatttatttggaagtgttcccttttcaatttttttggaagagtttgaggaggactaatgttaattcttctttaaatgtttggtagaatttatcagtgaagccatttggtcctaggcttctcttgttgaaaggtttttgattactgagtcaatctgtttactagttatagatcttttccttttttttaactaatttgttagttagtcctggtaggttttatgtttctagggaattgtctgtttcatcgagggcattcaatttgtcggtacaattgttcatagtactcttacaatcccttttttccccctgtggaactggtactaatatccccactttctcttttgatattagtaatttgagtttctttttttcttgcctatctagctaaaagtttgtcaattttgttggtcttttcaaagaaccaacttttggtttcattgatttcctctacttactttctttttttttttttagtctttattttgtttatctcttctctaatcttttttcccccttccttctgctagctttcagtttagctttttattttctagtttcttaagtagtaaagttaggttgtcgatttgagatctttcttgtttcttaatgtaagcatttatagctataaatttcccccttagcactgcttccactgcatctcataagttttgatatgttgtgttttcattttcattcatttctaagtattttccagttttcctcatgatttcttctttggaccattggttatttaagagtgtgttgtttaaattccacaattttgtgaactttacagttttacttctgttattgatgtttaagtacattcttttcattctagatctccacagtgcatatgttgctctgcttattgttatcccacaggtcccttagactctgttcacttttcttcgatcatttttctttctgtatctcagcctcagtaatttctgtggtcctgttttcatgcttgttgattttttttttgcctgctcatatttgcttttgaatcactgtagtgaatttttcatttcagtcattttaattttcagctccagaatttctttttttgttgttgtttgtttctttctaggctttctatctctttattgatatttccattttgttcagacattgttttcttgattttcttcacatctttctttagttctctgagcatctgtaagacagttgttgtaatgtctttgtctcagagacctgccatcaaatcttcttcagggatagttttctattgatttattattttcctttgaatgagccatagtttcctgtttctctgtatgctttgtgattttttttgctgttgttgaaaactgaacatttgaatagaataatatagtaactctggaaatcagattttctcccttccctagggttttctgattttttaaaaaattgctgtagctatctgtgtgtcaaggatcagcctgagatgtaaacttacggtcttctcaggtcttttctggatctgcacctttccctgggcttgtgtggtcactttctaattttcctcacatatgtagttgcttttaaatcttagttcttaatgtctggtcccaaaggggggaaaagagaaagatgaagaggagggaagaaaggatgctggccctttaaattccctggatgtcacttcagctgagggggagttgcaatgtggggaggtgcaacaataatggtcacctgccttttggtacctctgtgataagaagcgacaatcagagcacagatcctgatatttggagaacaaggttctttttgcctaccctggctcctgcaagttatgtgcaagctgttccaagaacatttgcacatgtgtctgtcatggggctggaagtgggagatggatagctgctgctgtgctaagagctaaaattgactgaaattaatcataatttactgtccaagccttcccctggaagttgcaagccttcaatagactccagaattccaaaatgctttcatcagacagattctgccagtgcaattgttgtctagctggttcctggtgcttactactctgccatctttccagaatcctctcaaatccttgctgcactatattatattacatttttaataagatgtgataaggtgctttctatcagggacttatagctttagtgaggaaacagacgtgtgtgtatgtgtgtgtgtgtatacttataacaaattataataaggaacattaaagcagtacaagtaagaattgagaattatctgtgtgaggacagtaacagtggagatagaaaaggattcgattctagatagatttagatgaaaaatgtggctggacttaatgaataaaattgatgcagggcaatttcctaattacttagtaattcattcaagatctctcccttccttgaacttctggtaagaagtgagcagtgttcaatataacaaatttgcctttatgtaaagaaagattttctgcgatttgaaggcatgtcacgaaagcactgctacttggagacctgtctttgaaagcttggagcatcttctcacattcacagaatggcaagttatggtctaactgtgctttgcctggtgtgaaatagtgggaaatatctgctgggattagttcatgatgatggaggctaggattccccatcttgtgattagtttttcagctttgattactgataggatacttggaattgaaatcataattctgtcttagtaactataaggatctgcatttggatgtcagtaacaaagagccctatctttaaggttttgtgtgtggcctctttatcacacagctttacaaatgtaggtttccgaaggcagcgtagtttatattacttttccttttctttatataacattgatttttaaaataactcaaattttcagagtgcaaataaatgaaaactgattatatgcttagaagtgaacatattgggaggtgagaaaaaatgtgcaaaatacttagatcatttttcaaaaaaggattaaaattttatttcttagccaaacatatattcaagtacaatgtatttcatctgaaagcctcagtaacatgacaaaaatttacagaataattattgttgagtttgtccataagtgcatgtttatgagtagaggctgaattccatacttttgaatgtgcgtcgacctttccgcttttacttgtcagatgccccttttttaatgccaggtagtctttatacaatactattattaatgatgtaatggaaaaattaactataaattggttgttaatattaagttttggtagtctaaaaatcaaatcttttctctcagtagggccgaaagaactgacttgaaatttaactttaatcatctagaagtctgtttttttttttttgaggagcttaatgtatcactataatatttcctagattcctgtctaattcaagatatggaatgactaaactgtagccatactagttctgagcatacaggcaagaagagaagtcgttaaacatcttgctgtgtgtgagcagttcgagggcaggcagacaccatgcaccttgaccacctattatgaagctttttgctgccgtgtcaagtgaaagtgagttaattgggtgaagctgtggagcatgttaggggcctggtaaagggttgctgtctgacagctgaatgtcagcgaaagccagtcaagtgtggctgagagacagagacctgtcacaaagttcccgcagactggaacacagttaggaagctgaaatatggttccgtctcactttctccctcattgaatccaagcaccttaaaagattttacactgtatatgtcaactcttgttctctaagctgtttccccctaactgtcctgcattcaaatgattgaacaaaagatgctaatgttgagcaaagtgaatgtaaattccctcttttccccttttctgcccaagcagatagacattcaactcaaaggaaactttgaaggtttacatcaaacaattagatttcttcaaaatttagcttataacagaatctctttctcaagagagtatgaaaattgacaattaaagcagtagaataagcaatgcattttcctctgatatagaaaatcaagctttagggagctaggactcctgtctgaatgtcttgagaatggacactggccaagataactttcctcttatcttttgtcataggcttctttctttctttttcttagtggcctaaggtaaaatgcaataattatagccaccagaagaataaagattagcatagaaaggaacggtaagttcccttctgaagcttgagacacttcgaaaggaggaattgaagaaagttggaattaaagaaaatgaagttaaactctgtgaaataaaaatatttgcagaaagaggagtttaatattaaaagatgccctgttcattttctttagaatatggattagaataagtccattaactcactcatccattcattcattcattcattcattcattcattcattcctcaacaggcaggtgtatagagtacctgctctgtacctgtcactgtgcaggccactggtaatacagaaacaagcaaacaaaatagcctgtggcttcaaggagtgaacactctaagccagcactattcattagaacttactgtgatgatagaaatatggctttggggcacttggaatgtggttagtgtgactgaggaactgaactttaatctttaatttaattttatattaaattttaactaatgtaaattaaatagctacatgtggctaccatattgaatagtgcaggtctaagcaaacataagactgtgatactgtgctattataaaagtgtgtatggggtgttataataacacggaggtgaggtattatattatattatattatattatattatattatattatattatacaaggtgacagaggccaggaaaagtttggggtaaaggtgatacctgaggtaagctttgactaacagtaggagttaacgtgatgaagaagcctccttctaaatagaaagggcagcatgcaaaagtggctccaagacaggagaaagcagggcatgcttcaggatcagcattttgattagtacaggagagcaaagctgttttatgagaaattacgttaatgcaatggtagtgtccaagaagactaccagtcaagttatccaaggggtcataacagaaggtgtcacagaccaaattagtataccgaaatcacatggtttgtggaattaaacacacagcaaaaagcaagaagagatatagcagggagcaagcagggggaaggatcataacctgacttcttggttgtgcagtgttcatgtgccctgtctctctccactgcctcagccttcttcactctctgtgagtttatgaggatcagggttgaagtttgaaacagggggcttggaagaccgaaggtgcctgaggccacttacacacacttgctatctaggagagatgcagggacaaacatgcctggccaatagctataatttgccactgaggctgctgaatagctttgtgttttatctgcagttctagggtcattgtaaggatgacattaactaaaggtggcatatctctaccttacgatgtggcctttccatccatttctatctataaagtaacaggtcttaccatatggattctgcctatgtcccacaaactgcttgctaattcattatctgtgcttactaatatttcttatgagtttcatctatcctatttttctagtctttaatctcaaatttgaatattttcaaatagtaagcaaacatacagtaaagaagagatgaagtaggaaacagcgaagtctgaagagatgacttgtttacaaaaataaaagtatgtttaggccagaaaaagtgaaaagacaaataactgatgaaaaatatttagcaaagagctttgaaacctgtgtcaaaattattatctagtagacaacctactccaagcgcagactgcatttcaaacaagtctaggcctttttgaaacaccattgtgcggactctagagagttaatctgaatgagggctctggcagttggagaaggactagtggagattttatgggcaggcacccagagaaggagatgtgaagtggagagaacgacctaatgcctttcctccatgcagacctatggactggcatttggactcttagaaaaagggcctacaggtagaaactgaaagaaatgttctgtgacagatactgcaaggcactgggtttcagtcagagttgtcacagttttcagatgacagaaagggaaggatgggcaccccaaatttttgttagagctatcacccatatgacctagcaagccccctaatacattgaaggcagaccctgttggagggattgcagacaccaagcagctcttgatggggaatccacaggggtgtttgaggcttgtatgagcaggacagggaaggaccagggtaacttgactcacttgggactttgtatccacagaataatgaggacaggaaacttccagtgctattgtgcatcaaagcttttcctataaaaatagcaattatgtggtttcatagtatttcaacagattataatttaagaagaactggatcaggatgaagattagttaaggtctaataaataatccccaaaacagggaatttttatttgtttaattcacttttgtattccagtacctggaacagtatttggcacatcataggcacttgatagatatttactgaaaaaataaatgaatagagctaatttaggatactaagaggggatatgggtttaggtatctttatgcattatgcaagcatagggaaaatttatcatatggaattgataatatagggagtcaattcctgaaataaagcctaggggtatattattttggaattttgtgtttgctatattttactgttacataagatgttctccctagggatggatctgggttgagactgctggaaatgatgtggttatatcagaaataacattcctgactatcatgtaaaggaaatgtcattgccaactaagtgatttgttttagaacatgtgccccagtgcttgttgtgatttgaaggcattctgcagatatgacccccagatcacatgatttgtcttacatctgaagtacctttctctccctaagaaatacattcttttaactgaagatagccagtccctccagaaaggcccagctatggaactgttcaaagggtccacagccctggggagtatagagcttataccatggtcagtggggaaataaaggcagcttgcagcattccacgaagaattgctaaggattttaggtgtgatataatggaacaatgaaggagcatggcctaaaacagcagtggaagggaggggcatgcaaaaaaaaatgggtttcaaattgcaaaatgagaatttaatgctaagttttttgagatgtgtgattgacagatacttatattgttagaaaggtttaggaaagtcatttctttcaaactactttaaattctaaatgattctttccttcctctgctcttctttacctgagtgcctgctcagtaattccactccttgaaaaacatattgctacgaggtctaagtttatagcttccagattattactaaatttttgacattaaataaaaaaggtttataactttaagaggaaattcttcagtaatgaaatagtggtcagaaaacttttgcctaatagttcccagagagagtgtgacatgtgtacattttgaccacagaagtcgtaatttggcagctggaagtgctatttggagtaaaatgaaggcacacaagttataagtagccactctgcataaggagttgcatttgcgcagagtagaggaacaaattactcagtgtcattatttgtgtaggtgtttactcaatgtaaaactgtaaatatgacttagataactgaaaacattgaaatgagagtgttctttgcttgatcaaaatcttttccaaacatgaaaaacacttaaagacctatcctctgagacctttaactatccaattacattttcattttgaccacacattttagagccataactatactaaaatatatagatgtatttcagtatatataaatatgtatagtttcattttttaataaagggtttttagctataaaagtaaaacgtacttactgtaggtaatttggaaaatacaaatcctaatcctaactcagagaatagagaaaaaaaccccaacaattccaataccacaaaacaagcaccatatgtaattttgtgtaccgttttttcatgacgtagtcttgccctagggtcagcaaatctacatgccacctgtttttgtatggcctgtgagctaagaatggttttaatattttaaatagttatgggaaaaaagcaaaagaataataacatatcatgacacataaaatttatgtgaaattcagatttcactgtccataaataaagttatattggaacacagccatgctcattcatttacatatcctcgatggccgcttatgtgctacaacacaggggctaatgcttgtaacagaaaacatataccctagaaagcatgaaatacttatctagctctttacaaaggtctgacctttggttagacccaagcatttgtccatgttatccaaaagtttataactgtaaattttatagctacataatttttcaccgcgtagctatagcctacttaactatgcttctggttgaatatgagagtatttctaatttttgtctgttattattaatataaactaatcataaatggaattgttggatcaaatggcattaagcatttaagacagttgcccaattatagatccaatggttctatcaatttatacagttactagcaatttatgaatgcctgcttcacaatgctttcactaacctttagcataatttgtaatatttaatttttactggcaatcaatgtcttattttccatttttgattacttgtgggggttaccatttttttcccatttatttgttacttagctgtatttttgcttttgtgaactgccagttgataactttctctcatgattcaaataattttaaagataaaaaatcatggaaagaaaaatttaacctttcaaaccttttttttctacccaaactctaattcagttcttttttccaaagattattaagtttcttttgatttcttgtgattcttttttccagaaaaaatagggatagatatgcatgtatgtgtgtttatgcttattttaaaatgtatattactatttatatatatgtatatatatatacacataaacacatgtatacattttgaacatgtttttttcacttggatatatttctctatcagcctttacatatttacctcacgtttaaaatagttgtattatatggttgtcatacttcacttaagtagccctctgttcatagacctctggttttatttttaaaaagttttgtttagcaccacatgttctcactcataggtgggaattgaacagtgagaacacatggacacaggaaggggaacatcacacaccggggcctgttgtggggtgcggggagcagggagggatagcattaggagatatacctaatgttaaatgatgggttactgggtgcagcacaccatcatggcacatgtatacatatgtaacaaacctgcacgttgtgcatgtgtaccctaaaacttaaagtgtgtgaaaaaaaatcactcttaaagttaaaaaaaaaaagttttgtttatctatctaaaaatgcttcagtgaacatacctgcatgctcaccttggtgaactcttttgagtgtagccatagaagaaatgcctagcagtggaattgctaggtcaaaggaagatacatttaaattttttgtcttccagaaaggttgcaacagcttatgtccctaactacatggcatgagtttgcctgattccctcttttcaacagtggagatcatcagacatctaagtttttgcccatttgatatatgaaaagtcatctttaattgggatgtgttgcattgtatttctttacttatgaattaagtttagcaccttttcgtatgttttttggttattatactactctctcccccaatcagacatctaatctgtacatgaggcagaggctggcagtggtttcctggcatctgttttctctttcttagtaatagagcctctgaatgttacctgggctgctcaggaaacaaacaaacagacaaacaagctacatttctcagaccctctctaagctaaattagttatatgacctaagttctagtcaatgggatgtaagtaaaagtgtacaattttaggaagtgtctgtaaacggaagcagtgcctccttctttgctccatcctcctttcttctcgctagaatgcagacatactagctggaacttgagcagccatttttgaccatgaggtaaaagccatgtactgagctgtggagcccaagatagaagcagcctggattcttgataactttatattgccctatcagagggaaataaacttttatttaagccaatgacatttagagttttctcttacaactgaactcagtcttaataaatatgctaccctcagcctattttctaattacattattttaattgattttcatgagccttttgtaaattaagaaaattacttgtatggggattctatgtgttgcacatatttttaccagtttgtcatttcagactttcagtggcatttttctatatggtatgcttgtttttatttatttggtttttgtgtctttttatatatttgagtgcataaagttatttatattttcaattctctcgaattgtttgggaatgtatgtttctaagacagaggggaaaatgcccctttgcattttctggccatttctggcactgtctaccatcagttgtgtcaggattgtcaggtcagcaacagactgcaagcacaagggtatgaagaacactgggaaaagaaagaacaaaagccacctgggagaattcttcaactctttttctaacctcaaccacatcaggaaatctaaacatcctggagaagaaaatgggacatattgtcttgtcaggcacaaggtatcttgaagtaatttaaaattaaagtttaaatgttctcgtgtaatttaattaattaattattttttgagacagagtctcactcttgtcacccaggctggagtgcaatggcgcgatctcagctcactgcaacctctgcctcctgggttcgagcgattctcctgcctcagcctcccgggtagctgggattacaggcacccaccagcatgcctggctaattttttgtatttttaagcagagacgggttttcaccatgtcggtcaggcttgtctcaaactcgtgacttcaggtgatcttccagcctcggcctcccaaagtgctgggattacaggcgtgagctaccgtacctggccttaagtgttctagtgtaagtttaaacctcagtgcctcattttgtctctgaatataacaacatataagctcctttgatgaaagggctataactttcatttttgtgtaagttccatgagatctatgtatttactccagtaagtaccacaggcattcaaatgttagaccacaataaaatatgctatcaaaatataaacatttcttttagcctctagcacaatctatgtacttttattttccattttcagagaggtttgttgagcccttattttgttgatgaaatgcctctagatacaaaataagcctgaggctaggctatatcttctttgggcaacatggtaaggtaatggtcaagcgtatgaataggagagtcagaggaaccaagattcacatccctttctaccattagcaagctgtgcaacctgtggcaatttattctgctctttgagccctagtctcttcaactgtagaatgaagataattgtagtgctttctgattgagtcactgtgagaattcagataacgcctgtaaaactaaatctagcacagtgcctgacataatgctgaatacatgttggctataattgtaaagttagaattcatatcatttgagaagagtgaaaaagagaagggaagatatgctacacatttttgtgtatattattccatttaatcctcctaacagccctatgagggattagtctgcctcctttacagataaggataaaagctcacacaggttaagtaacttgtcaaggatcacataattagtaaatggcagaatgaagtttagaaccttagttccttccaccttcaaagcccgtattctttccattaatctttgctaaatctaattgcgacataatctgtatatgtgtgaaataacaaaataacaataaaacaccaagaccatggagtaataatataagtcgtttgttcattcactcattcatcatttaggaatcttatttagtcccagatattctgctaagtgctagggtacaaagtcatgattccatcacactaagtgctcatagttttatagcggaaatataaggatatacaaataagtgaaaaaatagtaaaataaatgctcatgaaggaatgtaaaaatgagattggatgttacagttagctgtagttggggaaggatgggaagaggatccagaaaagccttatgaaagaggcagaccttgaccagagtttgaaacgtggaggactcacccaacaaagagcagaattggacagactggagggtgatgtgaactatggaatgtcctatttagggactcacaagttccatgtaactggcttgcacagtacaagtgaggaaatggtagatgaggctggacagggaagccaagagcaagggcataggtatagggaagcatgaagaatcaaaaccattgatccaatcaatcttccacatcaaacgagtagccaaggctgaattagaaccagatagaatgctgaatgtctgcctgaggacagagttgttgtgatgtgattcaggtttcttgttaatatattctacctcttttttctgatttgtttctacctgtatggttgtcctttttagatctctaggcacactgggcccttagggtgtttcctaatgcaacttctttgcatttttgccattaactcacatttcttcccatgccttgatgtcagtaagatagtcaaactagtctgtactaaggtttaatgacttacagggagaagaatgcataaaatattcctaccagcttgttattggtagctaaaagttagaactggtaactaccatatgagaaataaatattggatggcatgatagcagatgtgtgtgtgtgtatatatatatatatataactgtgtatatttatatgatgcatatatcaagtatatgtgtgtgtgtatatttataaggtgaatgtatgtttttatgtgtatatatatctcagatataaaatagagtattccacaagagaaaactatgtgatttttgccaactctggctgtctgtataaactacggtggcctatgagaccagcatgacaactggaaaattgacaggtagaatttggctaactcatctgaagtatttagaagaaagaaaactttgtgacactgagtattgagactctggtaagagcacgttaggaaccaaagtagaaatggcaagggagcctcactgtaacaccctcttgtgggtgctttgatttcttcatctgtttatgtggagctgtgcagactacttaaaagcagtcaataatttacagggcttaaaacatcatcatggagtttgaagtaatgaaaagagtactatagaatttaattgaatgaagccacatcatctaaattgtggctaatcttgttatctatttggctttattttagaacaacgtgcaatgtgcaatatgtattctttccccttaagaatggtctgtctacatcctctcaagtattatattcaggaaactgatttctgggttaatgtccctcaaaaaagttagggtttatagtatattctgtcacacgtggaattatggcagacctgtagaatttcaaagctggaaagagtccagcccctcatttggatggactaatttacctgccccaaatgacccagtcagattgtaaaagaactgtgaggagaagctagagtccactgatcttcagtctagtattcttttaatcacactatgtgcttagcataatctccatgcaatactactaaggcttactaaatcacatttttcctcactttttataatactaaattctagaagacttaacttgatcataaatgttacacaggagacaaatggcttagtttcagaagccttggtcggcaaaaaggctttgacttacagacaatttattgggtggttattttattattagactaatgctttatttatttatttttgtttgaaaaacatttgtagaaaattaagatattaaagccttgaaaaatggctattgaatgtgtccaattactgtatttcataagatttttaaaatgtagaaatttagtagacacattttgtattgtgaatatgtatttagctgatggactatagcagttcaaatagaatcatttatagcttattgagtaaataaaagtgcttccataaagattcacatgacgcctagcttttatttaaggtaactaatttccttttgaaaaactgcctaaatttagatttacataagagacagaacacctcagcagttttaaaagtagtttatatgaccatggactttacagatttaaaatataagattgggtggtgaacactaacttttaatgttctctgacaaaaagttatttaactgtcctttactctctgtgttacattaaaatagtacaaaagtgttacgtatttctggatattattctggatatttataacaagaaaaaccggtcatatttacttgtattttaacatcacattctcaaatcaaagtttcaccagaattgttgctggctttttttttttttttttttttgagacagagtcttgctctgttgcccaggctggagtgcagtgtgcagtggtgtgatcttggcttactgcaacctctgcctctggattcaagcgattcccctgcctcagcctcctgagtagctgggattacaggcgcccgcccaactgatttttatatttttagcagagacgaggttccaccatgttggccaggctggtctccaattcctgacctcaggtgatccacccacctcggcctcccaaagtgctgggattacaagtgtgagccaccatccccagccggtggcttctttttaagcttttaagtgacttaaaatcagactttacctcatttcatgaaaaaagtttttttctagcagtacagcagatgatcccagtagcaaaagcagtcatttgttttcctttatacaaaagtaactctgtttactttctagagactatacttttggggggtacaagactttaaggaaatctctctgtctctctttttcatctctggagattctttagattattttccatgtttaggacataacgtcagaaaatagtgtgcaaaaagtgaaactaatttgaaatactagggaaataacaccccatttcaaggttatttagtcaaaaatattatattggatgaaagggtgctttcagacgacatagtggaaagtagacatattagaaaaagtaggatgagaaaaggcaaaagagggacctctttgtaggttaccaagatctgtagaatattaaagagaaatgagcagttagtagagactttccctaaaggactgccttcctaactttgtaatgtgttaggttgatggatttgcaagaacaaaaagggaaactttaagtacaacatataagtttgagtaaattatgcatatcactaatattgacaaaacaggaatggttggtcagtttggcatagttacctttctctaaaacatccagaagaaaatacccccagaggatatctgaccttccttggactgattctgcacacccctctattttccatacatagttttcttagaccagaacttgaagtataaagatgtatcaaaacaaacttttgaagccttttctgacaataaaatattctactataataaagaatactgtggctataactatgtttattaagaagaaaatcaggccccaccatttcctgctcttccagcattcccctaacccccaggcctggcagaatgagaagttagtagatggcactgtaatgtttatagctgcaaagtcaatccagtaatgacactgctaaaaaatgattctagcagcagtaaaaatgcagatgtgtacacctctagcctctgatgtaatgagatgcctctgttcaggttctgagctgagatgatcaggcccagcattaaggttctgcaagcaaaacctcattaatactactaatcagggtcaacacacgattttggaagttgttttccttccactgggaaaccttatccttcatagagctatttcaagtgaccattttaggtgttttctaacttccagtataaaaagagatgatttccgtcagctattggcctgcagtagagtatcaggaaatcaaaagaacaaagatcaaagaaaattgctgaactaggtgttagatgcagatattgattttttctccagttgtagttttaaaaaaatccacaaaaatggtaacacatacaacagttgaatttctaatatgttcctaaagccagtgataagcttccctcttgtttttacatgtagcaacaattttgtataacatgacataataaagcacaccttatagtttacattattttgttatcaaaactgtaagaggatctactaaaaagtttttttttttttaaaaccctgcaatatagagtatgatttttagtggagatacttataaccagacttgttatttcagcaacatttattttgtgggaatctggaaaattatgtcatacaattgatcactattttcctgccatctttaaatgtcataatacttacctgctttactgctaagacttcttcatgttaaatattaactactagatactgacgtcacttaaggcttaaaggagcagctttatcgaaatattaattctactgtccagtattccatgactttgtggcatttttaatttccaacaatttctggataccatcagtgttctcaaatatatgacaaattattttcattcccttattttgacatgtgatttctaaatacttataatagtctttatcaaaacagggtggtatcatggacataaagatggaaacaatagagactgagcaccagggactatgagagtgggagagggttgaagaactaccagtcggggactgtgctcaccacctggctgatgggatcatttgtacaccgtacctcagtgacttaaatcaagaattacccatgtaacaaatctgcacgtgtacccctgaacctaaaataataaagttgaaagaaaaaacagggtggtggcattattattaaagtaaagccaaagagttctcattagaattttgtatcttagtatgccattttctagaggtcactgggattggcttattttactttgtgctacttttgtcaaataagtaaaatggatagatttaaaaaacataaatactcatagtttattttctaagtaatctaatcttccatattatatggcacttattttatagcataatgaaataaatgctattagcatcggtttctgtaaattgccaatggactgaagtcaaggtaaaaatccctgattgtattgactctctgatataataactttataaaaagttttacacaaagatttagtgtttagacaaattcttgttgtctagaaaagttcagaaaagagtaaataagggattcagtcacacttgataaataatttactatttatatattctcatgtagattattgaaatagtagtttccatctcatttttatattataatgattattagtctacttgcctgtttatggttttaggctctatttgagagttttcaactctatgtttattatttttttcttttgtatgtcacagataggatcacgagaccattcaaatctctccattccttcaagagctcctcttcctgctgacacaactggtattggggatttcttaccattgaaagctgaacttgatactacttacactttcttaaaggagacatttataaatactgtgccccatgctctgacatcatctcactcctctccagtgactatgtctgctaatgccaacagaccaactcagattggattatgacttcatgaaattaaaaaatggaggaagagttaacagtacaattaaaattgttttgaatgggaa

SEQ ID NO: 1226 - DNA, 6188 bp, Homo sapiens
ccgcctagccgcgccggtcccagaagtggcgaaagccgcagccgagtccaggtcacgccgaagccgttgcccttttaagggggagccttgaaacggcgcctgggttccatgtttgcatccgcctcgcgggaaggaaactccatgttgtaacaaagtttcctccgcgccccctccctccccctcccccctagaacctggctcccctcccctccggagctcgcggggatccctccctcccacccctcccctcccccccgcgccccgattccggccccagccgggggggaggccgggcgcccgggccagagtccggccggagcggagcgcgcccggccccatggacagctcggccgtcattactcagatcagcaaggaggaggctcggggcccgctgcggggcaaaggtaccggggctgcggggagggggccgaagccggggcgccgtgggaggagagaaggggccgggatcttccccaggggagccgccgccgccgccccgggcggccgccttagctgtgcccgaagctcccagcccgagagggagcagggagagagtttgaactcagaggaggctcagagacgcggggcggggcctggcgcctttggggcgctcctgttcgctcgaggtgaggaaactgaggcaggaatagagagggaactcttcgggggtttcctggcaggcattgcgtggtgcatgggcgcccccccaccattggcgccaatggggctgggagatgggggagctgaggagggcgcctatgggccacccgctgagactccgccccaccccccacccccacccccccgggctgcggtccggtagggtcttgggagggggcgccgaggtgacagcaggctggggaggcttggagggatctcccgccaacacacagctacgttccccacaaacttcgcgtcacgcgtggaggcgccgaccccctcggaggcacagagaggacggccggcacttccaagagtcgcttggcgcccgcggggagagtcgtgcgcctagtgggcacgcaccaccccgcaaagcctcgccgccccgacgaggctgcgtcccccagcgtggctgggccggggtgggggggtctgtcttctccttttccccgtgtggacctcaggatctggacgctgcccccaggtctgcccaccctcgcctgggtctggctgccccggaactgagggcaaggtggaaaggctagttgcagggggccggaggggggtggggtgggaggggtatctgtcaatcaggctgctgggctccaggtcggaggtctgggcggggcagggcaaacagatggccactggacactggccccaggccgcgggactgcacccctgcctctgggcccagccgcagtgaggacttcgtacccacgggggtggagaggatggagggagggcaggggtggactgccctgggtcccaggccctggctgtcctgagcaggggtgctcaggtaaggtggggtcaggaggcaccgcaatggggctgatcagcagcagtcatggaggctgtgagaggcagggagagagcaccccaggacctccttctccaggccacgcactccctatgtgggcgccttaatacctgctagacctatttgtctgggagctgcaggagccttgcagttgattgtggagccctgacaggggcgtttcagagaaagtcaggagctgccttcgtgtgtctggatgaaggggccacggcaagatcctcctggctcaggggttcacacctgggcacacatgcaggattctgcaggccagtgtgcaccgagcctccaacttgtgcctccctacttcaggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctaaggtgcgtgggggccaggtggggccacgggggcacctggactcagtcttcagggctttaggggaaggggctcctgactgagcttttcaggatggacttgcagacctgaaaggtgcagagtaggagggtggcagcctcccctgccaggccctgcccactgtggggaaactgaattctccctcataagtggaagctttttcctaccttggtttttagagaggtctcaaagagccaagaggcctacccaagccctagagctggcaggggcaaagctgggaagggggaagtatctgttcctggggcctggggttcctctggagacggctagggggagaagcctgcgtgggaggaaggaccaggcccggagagaggcaccccagccagccccgccctccctacagcagaccccagtccaatacctgctccctgaggccaaggcccaggactcagacaagatctgcgtggtcatcgacctggacgagaccctggtgcacagctccttcaaggtgggccctgctcaacagccctcagcccgggtctcggggggcatcccccaccctggcctgggagggaggtgtgtgctggaccccatgccctggggctcctcctccaactccagcagctcttttccccccacagccagtgaacaacgcggacttcatcatccctgtggagattgatggggtggtccaccaggtgagggccaggaagaggcagtggtgggcttggcatctgcctccagaccctaggctcttcccaccaatccggagcgcctcggatgggaattggatacatgtggaatgtcagaggcccagagagggtgtgagacttgtcccaaagtcacacagaacctcaagggcttgtgctgactccaagcctgcagagtgggctcctcctctaggctcccccgtgctgtgctccctcgccccaccctgcccgggacccagttcaagtaattcaggataggttgtgtgctgtccagcctgttctccattacttggctcggggaccggtgccctgcagccttggggtgagggggctgcccctggattcctgcactaggctgaggttgaggcaggggaagggattgggaattagggacctcgtgaggtaggactggccagtggagtggaagttttgatcgttttctggcggggggtgggtacagtttccccagcagtggtcagggtagctggccaagcggagcctgcgggcccagtctccttcctgtgcgcctctgcctccctggcccatgccctgccagccctcggccacccccacactgccccactggcccgcagccccctcactggcccgccccccaggtctacgtgttgaagcgtcctcacgtggatgagttcctgcagcgaatgggcgagctctttgaatgtgtgctgttcactgctagcctcgccaaggtgagccccacaggggtcccggggcaaccctgccctcctacctacctcccgcatgcagcccaatgaacctgcgggccccaggatgacccacctcctgctcccagtacgcagacccagtagctgacctgctggacaaatggggggccttccgggcccggctgtttcgagagtcctgcgtcttccaccgggggaactacgtgaaggacctgagccggttgggtcgagacctgcggcgggtgctcatcctggacaattcacctgcctcctatgtcttccatccagacaatgctgtgagtgcgggctggactgggactgggacaggagctgagacccaggaaggggtcagtccattcaggccaccttggcctcttggatccccagttggggggtgggtgccctcccagtccttcctgcattcattgcctgtgcctgccgcccactcccctcatccacctgccctgtagccatatggtcttttcccctcgcacaaagcagagcatctgccatgcacaggggcccccacagggcaacggagtttggaaagtttcaatttttcgaattgccagttgtgacctactgatggcccacagaattaatttagtgggttctgattgggaattttaacaaaatgaaatagaatagaaaatatccggtcgggtgcagtggctcatgcctgtaatcccagcactttgggaagctgaggtgggcaggtagctgagcccagtagttcaagaccagcctcggcaacatagtgaaaccttatgtctacaaaaaatacaaaaactagccaggcgtggtggcgcatgcctggagtcccggctatgcagaaggctgaggtaggagtatcacttgagccctggaggcagaggctgtggtgagccaagattgtgccactgcactctagcctgggcaacagagcaagaccctgcctcaaaaaaaaaaaaaagtatccgagtgcttcgcacagataaggttaggaattgtgaagcttttgcattgttacgttataaatgtgttttcctggggattgctgtcaaaaaagtttgaacactgtgggtgaggggttttcagaaactgcatgatctgagtagtggctacatagggctggcctggaaattctgcacccaggaccacctgcccccctcatcttcctacacccacttccccaggtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcccaggaagactgcccaggcctttgttaggaaaacccatgggccgccgccacactcagtgccatggggaagcgggcgtctcccccaccagccccaccaggcggtgtaggggcagcaggctgcactgaggaccgtgagctccaggccccgtgtcagtgccttcaaacctcctcccctattctcaggggacctggggggccctgcctgctgctccctttttctgtctctgtccatgctgccatgtttctctgctgccaaattgggccccttggccccttccggttctgcttcctgggggcagggttcctgccttggacccccagtctgggaacggtggacatcaagtgccttgcatagagccccctcttccccgcccagctttcccaggggcacagctctaggctgggaggggagaaccagcccctccccctgccccacctcctcccttgggactgagagggcccctaccaacctttgcctctgccttggagggaggggaggtctgttaccactggggaaggcagcaggagtctgtccttcaggccccacagtgcagcttctccagggccgacagctgagggctgctccctgcatcatccaagcaatgacctcagacttctgccttaaccagccccggggcttggctcccccagctctgagcgtgggggcataggcaggaccccccttgtggtgccatataaatatgtacatgtgtatatagatttttaggggaaggagagagggaagggtcagggtagagacacccctcccttgcccctttcctgggcccagaagttggggggagggagggaaaggatttttacattttttaaactgctattttctgaatggaacaagctgggccaaggggcccaggccctgtcctctgtccctcacacccctttgctccgttcattcattcaaaaaaacatttcttgagcaccttctgtgcccagcatatgctaggcccaccagctaagtgtgtgtggggggtctctacgccagctcatcagtgcctccttgcccatccttcaccggtgcctttgggggatctgtaggaggtgggaccttctgtggggtttggggatctccaggaagcccgaccaagctgtccccttcccctgtgccaacccatctcctacagccccctgcctgatcccctgctggctgggggcagctcccaggatatcctgccttccaactgtttctgaagcccctcctcctaacatggcgattccggaggtcaaggccttgggctctccccagggtctaacggttaaggggacccacataccagtgccaagggggatgtcaagtggtgatgtcgttgtgctcccctcccccagagcgggtgggcggggggtgaatatggttggcctgcatcaggtggccttcccatttaagtgccttctctgtgactgagagccctagtgtgatgagaactaaagagaaagccagaccccta

SEQ ID NO: 1227 - DNA, 6188 bp, Homo sapiens; identical to SEQ ID NO: 1226

SEQ ID NO: 1228 - DNA, 7605 bp, Homo sapiens
atgagattagggggcgcagccagagcaggcctaggaaaacgccagcagcgtgtggcgatcacggtgatgaagcgcaatggtggccgccccgtgggctacccaggagcaggaggagggccgagggatccagcccggggaccggggtatcagtccccgacagtcccctcccgcccctactcccagcctcagcgcacgaagccgccgcgccttctggcagacgccgctcccctcccttcccctcccggcccccgcgcggggcctcccctccccggctccccctcggcagggcctggcggacgtgcgccgcgtcgcacccggcggccggacgggacaggacgcgcccgccccgccccgccacggaggcccgcgggagagggggaggggaggaagtgccgaggggtgtttgtcgggcttggcattattaatttttaaatggtgaacttacaaaatagtaacgacgagtgaaaagaacttcataaacgaggaaaaagaccaacccgcagacccacggcgcgcaccacggaggggcttgcagcgagaagacagggacctccgttcccaagtgcccagcactgcgccacaggccgggtggaacgggccttgagggcctctggtttgaggtcccccacggtcgggctttgggcccaccgcgtgcggcgccgtgctgggctcctaggatcggcagcgagtccagtgactcccaccgcacccccagtaatcacagggcggccgtcgaccgcgggcaggggagggggtctgggaaggcccctggagaaggtggcatttcctcgaggtcggtggaatttggctacgcgaaaggaacagcgcgtacgaaaacttcaggcgggaacgcgcggtggcccgtgcgcggcgggtagacgtgcggggccccgggtggggccgtggggagaggtcggcagggggctttcccagggcagagagttagaatttcacgtcctacagaccgggggcacctcgccctggggctgcggggggcggcgaccgtcccattcaagagcgtgattctgaggtttgcacagctgtttcgggccagcagagccttcgctggctcttgacgtccttgcgaggtgatctctgcgaccaccagacaggagagaagacccattttacagatgaggtagtgctatctccaagtcctcaacgaggaaaccgagaagcctctagtcccgggtcttcagaaaacgcagaggtggagccgcgccgcactcgggcactccccggcgtgggcgctcccggcgggcgggccttggccgagggcgctcggcggcctggaacggtgagccgggtgccgggcctgccacgcagccgcagagactcagccccgccggcgggcggcaggaagggaggcgacgccccctggagcgcggcaggaacccggcccggcccgcctcccagtccgcctagccgcgccggtcccagaagtggcgaaagccgcagccgagtccaggtcacgccgaagccgttgcccttttaagggggagccttgaaacggcgcctgggttccatgtttgcatccgcctcgcgggaaggaaactccatgttgtaacaaagtttcctccgcgccccctccctccccctcccccctagaacctggctcccctcccctccggagctcgcggggatccctccctcccacccctcccctcccccccgcgccccgattccggccccagccgggggggaggccgggcgcccgggccagagtccggccggagcggagcgcgcccggccccatggacagctcggccgtcattactcagatcagcaaggaggaggctcggggcccgctgcggggcaaaggtaccggggctgcggggagggggccgaagccggggcgccgtgggaggagagaaggggccgggatcttccccaggggagccgccgccgccgccccgggcggccgccttagctgtgcccgaagctcccagcccgagagggagcagggagagagtttgaactcagaggaggctcagagacgcggggcggggcctggcgcctttggggcgctcctgttcgctcgaggtgaggaaactgaggcaggaatagagagggaactcttcgggggtttcctggcaggcattgcgtggtgcatgggcgcccccccaccattggcgccaatggggctgggagatgggggagctgaggagggcgcctatgggccacccgctgagactccgccccaccccccacccccacccccccgggctgcggtccggtagggtcttgggagggggcgccgaggtgacagcaggctggggaggcttggagggatctcccgccaacacacagctacgttccccacaaacttcgcgtcacgcgtggaggcgccgaccccctcggaggcacagagaggacggccggcacttccaagagtcgcttggcgcccgcggggagagtcgtgcgcctagtgggcacgcaccaccccgcaaagcctcgccgccccgacgaggctgcgtcccccagcgtggctgggccggggtgggggggtctgtcttctccttttccccgtgtggacctcaggatctggacgctgcccccaggtctgcccaccctcgcctgggtctggctgccccggaactgagggcaaggtggaaaggctagttgcagggggccggaggggggtggggtgggaggggtatctgtcaatcaggctgctgggctccaggtcggaggtctgggcggggcagggcaaacagatggccactggacactggccccaggccgcgggactgcacccctgcctctgggcccagccgcagtgaggacttcgtacccacgggggtggagaggatggagggagggcaggggtggactgccctgggtcccaggccctggctgtcctgagcaggggtgctcaggtaaggtggggtcaggaggcaccgcaatggggctgatcagcagcagtcatggaggctgtgagaggcagggagagagcaccccaggacctccttctccaggccacgcactccctatgtgggcgccttaatacctgctagacctatttgtctgggagctgcaggagccttgcagttgattgtggagccctgacaggggcgtttcagagaaagtcaggagctgccttcgtgtgtctggatgaaggggccacggcaagatcctcctggctcaggggttcacacctgggcacacatgcaggattctgcaggccagtgtgcaccgagcctccaacttgtgcctccctacttcaggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctaaggtgcgtgggggccaggtggggccacgggggcacctggactcagtcttcagggctttaggggaaggggctcctgactgagcttttcaggatggacttgcagacctgaaaggtgcagagtaggagggtggcagcctcccctgccaggccctgcccactgtggggaaactgaattctccctcataagtggaagctttttcctaccttggtttttagagaggtctcaaagagccaagaggcctacccaagccctagagctggcaggggcaaagctgggaagggggaagtatctgttcctggggcctggggttcctctggagacggctagggggagaagcctgcgtgggaggaaggaccaggcccggagagaggcaccccagccagccccgccctccctacagcagaccccagtccaatacctgctccctgaggccaaggcccaggactcagacaagatctgcgtggtcatcgacctggacgagaccctggtgcacagctccttcaaggtgggccctgctcaacagccctcagcccgggtctcggggggcatcccccaccctggcctgggagggaggtgtgtgctggaccccatgccctggggctcctcctccaactccagcagctcttttccccccacagccagtgaacaacgcggacttcatcatccctgtggagattgatggggtggtccaccaggtgagggccaggaagaggcagtggtgggcttggcatctgcctccagaccctaggctcttcccaccaatccggagcgcctcggatgggaattggatacatgtggaatgtcagaggcccagagagggtgtgagacttgtcccaaagtcacacagaacctcaagggcttgtgctgactccaagcctgcagagtgggctcctcctctaggctcccccgtgctgtgctccctcgccccaccctgcccgggacccagttcaagtaattcaggataggttgtgtgctgtccagcctgttctccattacttggctcggggaccggtgccctgcagccttggggtgagggggctgcccctggattcctgcactaggctgaggttgaggcaggggaagggattgggaattagggacctcgtgaggtaggactggccagtggagtggaagttttgatcgttttctggcggggggtgggtacagtttccccagcagtggtcagggtagctggccaagcggagcctgcgggcccagtctccttcctgtgcgcctctgcctccctggcccatgccctgccagccctcggccacccccacactgccccactggcccgcagccccctcactggcccgccccccaggtctacgtgttgaagcgtcctcacgtggatgagttcctgcagcgaatgggcgagctctttgaatgtgtgctgttcactgctagcctcgccaaggtgagccccacaggggtcccggggcaaccctgccctcctacctacctcccgcatgcagcccaatgaacctgcgggccccaggatgacccacctcctgctcccagtacgcagacccagtagctgacctgctggacaaatggggggccttccgggcccggctgtttcgagagtcctgcgtcttccaccgggggaactacgtgaaggacctgagccggttgggtcgagacctgcggcgggtgctcatcctggacaattcacctgcctcctatgtcttccatccagacaatgctgtgagtgcgggctggactgggactgggacaggagctgagacccaggaaggggtcagtccattcaggccaccttggcctcttggatccccagttggggggtgggtgccctcccagtccttcctgcattcattgcctgtgcctgccgcccactcccctcatccacctgccctgtagccatatggtcttttcccctcgcacaaagcagagcatctgccatgcacaggggcccccacagggcaacggagtttggaaagtttcaatttttcgaattgccagttgtgacctactgatggcccacagaattaatttagtgggttctgattgggaattttaacaaaatgaaatagaatagaaaatatccggtcgggtgcagtggctcatgcctgtaatcccagcactttgggaagctgaggtgggcaggtagctgagcccagtagttcaagaccagcctcggcaacatagtgaaaccttatgtctacaaaaaatacaaaaactagccaggcgtggtggcgcatgcctggagtcccggctatgcagaaggctgaggtaggagtatcacttgagccctggaggcagaggctgtggtgagccaagattgtgccactgcactctagcctgggcaacagagcaagaccctgcctcaaaaaaaaaaaaaagtatccgagtgcttcgcacagataaggttaggaattgtgaagcttttgcattgttacgttataaatgtgttttcctggggattgctgtcaaaaaagtttgaacactgtgggtgaggggttttcagaaactgcatgatctgagtagtggctacatagggctggcctggaaattctgcacccaggaccacctgcccccctcatcttcctacacccacttccccaggtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcccaggaagactgcccaggcctttgttaggaaaacccatgggccgccgccacactcagtgccatggggaagcgggcgtctcccccaccagccccaccaggcggtgtaggggcagcaggctgcactgaggaccgtgagctccaggccccgtgtcagtgccttcaaacctcctcccctattctcaggggacctggggggccctgcctgctgctccctttttctgtctctgtccatgctgccatgtttctctgctgccaaattgggccccttggccccttccggttctgcttcctgggggcagggttcctgccttggacccccagtctgggaacggtggacatcaagtgccttgcatagagccccctcttccccgcccagctttcccaggggcacagctctaggctgggaggggagaaccagcccctccccctgccccacctcctcccttgggactgagagggcccctaccaacctttgcctctgccttggagggaggggaggtctgttaccactggggaaggcagcaggagtctgtccttcaggccccacagtgcagcttctccagggccgacagctgagggctgctccctgcatcatccaagcaatgacctcagacttctgccttaaccagccccggggcttggctcccccagctctgagcgtgggggcataggcaggaccccccttgtggtgccatataaatatgtacatgtgtatatagatttttaggggaaggagagagggaagggtcagggtagagacacccctcccttgcccctttcctgggcccagaagttggggggagggagggaaaggatttttacattttttaaactgctattttctgaatggaacaagctgggccaaggggcccaggccctgtcctctgtccctcacacccctttgctccgttcattcattcaaaaaaacatttcttgagcaccttctgtgcccagcatatgctaggcccaccagctaagtgtgtgtggggggtctctacgccagctcatcagtgcctccttgcccatccttcaccggtgcctttgggggatctgtaggaggtgggaccttctgtggggtttggggatctccaggaagcccgaccaagctgtccccttcccctgtgccaacccatctcctacagccccctgcctgatcccctgctggctgggggcagctcccaggatatcctgccttccaactgtttctgaagcccctcctcctaacatggcgattccggaggtcaaggccttgggctctccccagggtctaacggttaaggggacccacataccagtgccaagggggatgtcaagtggtgatgtcgttgtgctcccctcccccagagcgggtgggcggggggtgaatatggttggcctgcatcaggtggccttcccatttaagtgccttctctgtgactgagagccctagtgtgatgagaactaaagagaaagccagaccccta

SEQ ID NO: 1229 - DNA, 1126124 bp, Homo sapiens
tgccggaatctcgcgagagctcccgggggccgttgggtagcgtcttcgctgttgcccttagggacggctgtgggcctgctgggggtgggggcccgaagcgccagagatggctgctcagcgagggatgcccagctccgccgtgagggtcctggaagaggcgttgggcatgggtttgacggcagccggggacgcgagggacacggcggacgcggtggcggctgagggcgcctactacctggaacgtatccttcccgtggaggcgcggcccgctgcgctggcgggtaatgggtgttgggacgaaggcgagggcctcccactggcggcgccttttgagccttggggccactccggaggagcctctgttggacttcaaggtgctgtttttgccaccacagtcttcctgagagccactcactgaatttctcgcccttagtagcccagggtgtcctgtacctgttagaagagttgggagaccttccaaggcctcatacttagtaaccactcagtacattttggatggagggttgctttttatgttaagacagcacaacaaattgcttcaaccctcctttcaaataatgggtttcctaaataagccctcaatctttcagaaagccgtcccaataaattcaacggaggaacgttaggagactagggaaagacctctgccattggactttaaggagctgaagctcagaatacccaacccacgatcctgttcgatggtccagttaatgcttaaatgcttagttttgatagcattatcttcctgagtagttccaagtttgactacttaataataaatactaatagtatagttgcttttttttcttgagcaaataaataatgatctggtgagctacacagctcagagatattaggaataaagcagatggtgattagcgatttttatcggaagtaccagaaaaattgaataacaatgtgtggataattaggtccactatttcttgtgtaaggctttagaacttctttcctctagttatatagattaattcctactagggagacggggagggttcatgagaaaaagacatgtaactcctttattcagggaggtaagaaagagatgattatctgttcagttcttaaagataccaaggaaactccaaaatctgccaaatcttatttgtttgtccaactgtaatcctctccaggtttaattcaagatttcagaaatccagcaatgattcatttcgtgagctttgacaagccgattaacctgtcctgactcaggctcagtacacatccacactacagagagctttgaagaatttagctgaaagattaaagaaaatatgtagtattttattgggtgcaaaaacgacttttacaggaatagaaatttgaatcgcttgaaatgaatttgaaagaaatatatgggtgctttagtgtcataaatgaggttttatactgttttcgtagatgtaacaggcagtcttttccagtgatattcctctttaacaacgattttcataattcttcctaagcttatctatatccagtgcccttgctactgaatggtaaccaggcatcttgtaattttgtttgcattaaaattatttccgtgaacacatagtttaattgttaacatgagattgacacaatgaggtaactttttgcaaacatctttgtgaaataaatggtaggagtctaacataacacaactttcagcaatgaaaatcaggtttacttaatgtgcagggagatcactgagtcacacctgccaagatgtagcagtttgcaaacctgtcttacaaagactttttcaaataatcacacttatttgaactttaacacatataagcaactgtaactttttaggattttactaaccgttgtgtgaattatccaacccatttgcttttcttctttctttggttgactgactgctattttgtattttaaccaaatggtagtcaggggatacacagttaaacatttaaccagtttattttgctatattccatgctgagggaagaggtttagtcatttcaactctcagttgaaatgaagtttgaggattacttgtgaataccaattattcctgtatccctgggcactcttcacatggttaattaagagttgcctgtgtaatgttgtttgacattgtttcttaaggcaattatgatagttgccaaagtgagacttcctttggtttaaagtctttgctttcaggtaatttaattgagctatcatggtgggtaaataaaagttataatatgcacagatgaatcagaaatctgatgtcctctgcttcgcacatatactcaatcacttctaatctactgcatttggcctggatttcccttatttatcactcaacagatgctcctagtacattagacaatgagctatcaatatcgagcaagactttgaaagaagttgacttgaattctttaggaaatctcccacttttctgcttttaaatactcaattatgaagagtatgaatagactaatgtccaaaccagaaacagccaggatccatcttgtgggggacattaatgaaggtcccatgtcctttataatggtttacacactgggttcaggaaaaagagttcttaccctgcaacaccctttccctgtaatctcctagctgtaacagtgccacctatttctcttctaaggaacccagaatatcattgcttttatgttttagacttcaacaaggtgagatacaaatatacattgttcttagctattgtcagaacactaagaaattgagttatggagtatatgaatcctctctagaacccatcattagaaaaatacttgcagcattataaactataaggtgagattttagctatgtgatagatatgtaaagggtcaagtaggtatctccagaacctagaaagaaggttgattgtcttttgtgaatgaatgaatcccttattagaaatcaacacaacttgggtgaggttttcaactgtagtagtgaggaagggctgcctattaatgtatggctgcagacatttgggactgcctagttccaattggaaggccagcatgaatttgtactaagaaagctaagggttaattgactttgttgttccttgtctaaagagactttgttcaaggaatagtaaatgaatacatggaccctaggaaagtggagcttcaaggtattgtttttgttacatacctccctcaatatggacatctggctcctctagcttttgattatttcctctctctgggcattctaatactaaggatttggctttttagatggtaggtgtaagtttactggccaatgaaaaaggctccccaacccccagcagcaatttctgagagttcagtaagtttaagccagttctgtgaagctaatcagctctgaatggagtcccaaagtcaactctttctgaaactccaaaattaaggactctagaccctgaaatatgaggatcacactagactgatgcccttatctgagatactgaggactgtaattgaagtagcaagcctgtagataaatatcttaacttctaccatgctacctttaaaaaaaattattatttttttagagatgaggtattgctctgctacccaggcttgagtacagtggcatgatcatagctcactgcaacttcaaattcctgggctcgagcaatcttcccacctcagcttcctgagtagcggggactgcagatgtgcggcaccatacccagctaattttgtttgtttgtttttgtttttggtagagacgggggtctcactctgctattcagattggtctcgaactcctgtgctcaaggcatcctactgccttggcctcccaaagtgctgggattacagacatgagccactgtaccaggctgctgtcttcttaagtaacagttctatctagtctttcattgccatagtaatgttgactgataactttaattaaaattgaagttttccttattttattttattttttgagacggagtctcgctctgtctcccaggctggagtgtagtggcacgatctcggctcactgcaagctctgcctcccggattcgtgccattctgctgccccagcctcccgagtagctgggactacaggcatctgccaccacacctggctaatttttttttttttgtattttcagtagagacggggtttcactgtgttagccaggatggtctcgatctcctgacttcgtgatccatccgcctcagcctcccaaagtgctgggattacaggtgtgagccaccgcacctgtcctttcctttttttaaatttactgtatggtttttaactttttttttttttaaagctaaacattgtagttgagtaagtaaaacatttagaaaggtggatgcatagatttctttttcttttttaaaactaacattctcttagatacatgtgttaaccactttttcttctgttataaaatggtacttctctgaaatgtttgtagtattataattgttctgaaccctaaagtgtatttcttatcactggaacttaatttgtgcatgggttcttagatattagaacatacataccccgtgtatattcaaatgaaaaggatacacaacctgcatatagacagactaagaactatgttactaaatccagagtgttgatatttacttgtgtaaaagtcataggctatttggagagaaaaaaaatgtgttttgctctgtgtcctttagtcaggcgttaatgtgcatatgactcacctggggagctttaaataaatattctaattcaataagtctggcaagggggctgagattctgcattgctaagaagcttcctggtgctgcggttgctgctggtctaaggactgtaattgaagtagcaaggctgtagataaatatcttaatctctagcctttatattttcagatagaaatatcacatgtggagtccatatctttggatctcctggcttagaagttggaaagacttataccaccagctgccatgagcactgagtcttacatgctgaacaaaagttattttccagttatgaaggtagaagatatgcaacagctatgtaggacaggggtggccagtacatttccactcttgccaattctgttgaattggtagtggctccctggtataggatattaataagaattctgagtcctcatgaagactgtgtggtaaaaactgcagggagcaattggcaaaagggaatgtgaccacaagcatgccagctaccttccatttttgtctgtattattcagttaacttatttaaactggccttcctaagaaagggaccaagactatgatatttgctatttacagtatttttatttcaacttaataagtaaaatgttgatcatggaagatccaggctagattttagattgagtctgtgtacgttggctctgcagtgatggcaaggattacaaaatgatttctgtctatagtagctttgggaaatcatgtaaaatataattagctatatgtttcactccagttcttcataaagatgctgctactgctggcagtaaacactacctacaaatgcagcagtggaagagaccagtgtgtaaggtactttgctgctcacatctgaaaattattcattggtttctggctctggtccatttgcagaatgttatttgtctccccctcataccaattggcacctcaagctctgcgccattaggccaaccaaaatgtctcaccgaggtttctggcagttgtgttctctgtagtactgtgatgggcttagggctccctggcagtttcagtgtgggtgttacattttcccattttctgaaaagatcgagaatatcaggatctggtgcaggctctgctagtgcagaaactatgagatagttcacccatggtgactaaataccaggaaactaattcatgctatgaaactcacgagtgctactaaattccttccagagcaaatgcagatttgggaggaatgggagcctcagtctgtgtctaggttatgactagaaatacagaacctggcctggacttggatggtactgtgggctgtggcttcagggcagggagaaaaggggagccatggacactaccccaggcaagaacaatctagaaaacaaggcacagtattaagtgtcaagtcaaggccaagtgtgcagataggtaagaaccagatatgaggggaacagacagggcagaaaaaaattttggaactgaaattcaccagtgttcttcgaaggaatactaggcagttagagggaagggagttttgtgagggctcaaaggcagcttgacattaagaaactggatttaggccagaatgctagcttattatttcagtgaaagaataactttgcatgagaactgtgattagcttaattgtatggatgtttcctggagagtaggatcacctaagagattaaattacagatgagaaagttgctccgtgaaagtagaaccagagtgtacagagttttatcattcttgacgaattaaccttttctactctggcaagattgttatccaaaacaatgctttccaaagtttttcacatacagtactccatcacatcctacttcactctgccttttttaccgtcccaagggccaaggggattgatatctctacactgcactattctttttatgagaacccaagaatgtcatttctctcaggctttggaaccagatattcctggatatctgttgagaaactcatctgttttcattgggtcgatacagagatggtatctgattccatgtccctttttaccctggttactgggaagcttagagtcaaatctgggggttatttttgaccaatcttatgagacctatggtatctgctgcatcttaatcatatttctataatgctatttccttttctcctccaatttccacattcattaattgttacattttgtatagtgtgtgtatttgcaaactgtagcagaatcactttaggatcagtttgtgcacctgtccctactgccagctagctagccaggtaaacagatgcgtacaaacataagtgtcaaagtacatttatgtctttaataacattgtgacatttaaactgagttgcctttgggaaattttaaatataaattatattgtggatacataaaaatcaatcaaagtatgtatcttcctagtttgattgttttgtccactacctgacgtattgtcccatcagtctcttgcccttggttagatttcgttttgagtctgtagcctgtagctcttttctacttctctttcctctgggggtcttcaaattgagctatttatgtgatttgatttacctgttattaatataacacttgaaagtttttggaaaaaaataggtgagttcattacctaggatattggtaaaaaagttgtgtattcctattgtgtcactgtagaaacagtactatgtagcagcaaatttatggcatttgtatctcaggaatttatctttgtcattcacagctgtgtgatcttgggcaaatcttttaatctctgattcagtttcttcatttttaatttagagatgggtatatctgtgctgtttgacctcactgggttgtgtgagaataaatatagttttggtccatgtgaaaatacttttaagctttataaaatggtagttatgtactctcttaatcttttttgattgtgggaaagtaatacatttaggtgataaaaagccattgtctagaatatttgctgggtaggagtatgtaagtgttgattgatattttctatgcttcgaggacaaatcactttttttctactctatattgccatgtgacatcttcctcatataatcttatcagcggttggcttatttacaactttaaagtctatccagaagcttttagagtatttacttctttttgaaattattatgatgtgaacatggtgaaggatggcattgcttttctggagacatacaaatgaccgcttacaaaattactttctaggagctgtctctcagaaggggtcatgctttttcatagaaaagaggctgacttcctctagctgaaccttcggaaattttatctcattatataaaactatcagaggccgggtgcggtggctcacgcctgtaatcccagcactttgggaggccgaggcgggcggatcatgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaacaaaaaaaacaaaaaaaaacaaaactatcagaaagatataaatctataactggagggaaatttaaaatgtcttttatttattcattttaacatatgggggaacagaggcatgagaaatttaaaagatttttttttccatagatactcatctctttccagagtgagaaaagaaatgacaacaaacacttgtatatcatttactataagccaggcactaatctaaatgctttacatatattgactcttaacattcttatagtatggaaggaagccagtctctaaaataaaatgacaccctgatatggtttggctctgtgtccccaccctaatctcaccttgaattgtaataatccgtatgtgtcaagggcaggaccttgtagaggtaattggatcatagggccagtttcccccatgctgctcttgtgataatgagtgagtatcgcaagatctcatggttttgtaagtgtctggcatttccactgcttgcacccattctctctttcatggtgccctgtgaagaagtgccttccgccatgattgtaagtttcctgaggtatcctcagccatgcagaactatgagtcaattaaacctcttttccttataaattacccagtcttgggtatttcttcatagcagcatgagaatgaactaatacgcatccagtgagccccacctcctaatattcatgctcttgtgtaatcctcacacactgagtagacgtgacccatgtaaccagtgggatattgaagaaatgatgtgtgacttctgatgtttggttagaaaagctattgtggcatccacattgttttcttggactgcttattctgggggtagttagcccaccatatcttgaggatgctcaagcagcctgtggagagacccacatggggaagaactgaggtcttctgggaaactagtacattgtcagtgagctgccatggaaatggatcctgttgcctcatctcagccttcagatgactctaattctcctgttattttgactatgacatgagagacccccaagtcagattctaccagataaaccactactgagcccttgacccagagaaactacaatataataaatgcttattgttcctttttcagcgttattgagttgtaattgacaacattacatatattctaggtgtacaacatattttgatttacatatacattgtgaaatgattaccacacccaagctaattaacctatttacctcatatagttaccttttcacttttatattacttgtggtgagaatatttaagatctactctctttacaaatttcaagtgacactccattattattagccatagttactgtgctatacattaggtctccataaattcttcatcttataactgaatgtttgtgcaacgttgatgaacatccccccattttccctaccctctattcattggtaactccccttctaatgtctgtttctgtagagttggaattttttttagattccacatataagtgagactatgcagtatttgtctttctgtatctaacatttcacttagcatgaccttcaggttcagtatctggagtagggtgttaaataagaagtaacagagtagctttgaaactggggattagggagatgttggaaatactttgttagtgaaagataaaatacctcgaacagattgctagtagaagccttatgatctttaaagaggctgatggcaaggaattagagagtgaggcaaatactattagaatctgttctacagtaatagataattaataaaggaggtattttactccttgtagtatttaatatggatgaattaaggttatggaatagactgcaagtatgcaactatttttttgtttaatcatttaactagctatttttgagcctaattacttttcactatgttattaggagaggcacttattcatgttttacaataaaatactgaccttttgacagatacctggtatctgaggattggtcataatggaatggggcttaagtgtccctgcaagggatagggataagacatacaggatgattacttgtgatggagcttagtagcagtaataaatttataggtttagatctctgtggaaaataattggcaaacactttatgtatttatgtagcacagaaaacccacacagaacatggagaggcaatataatatggtgaaacctaaacatctgggctcttttaggtcctagctgtggaaccttatgcctctgattcttgatttgtaaaatagagttatagttccagcctcataggcaggatgaggatgaaattagttaatacatggaaaacacttagaacagttcctgtctcctattaaatactgtgtaagtgttatctgttcttgttataagcaacagaagttgttatataccctttcagctaatgcttggtaaacaatgccagagacattttataatcagcagcaaaatgaaaactaggctaatcttatctttgattttcataaccattaccatgcattaaagtgtttaattcacacattttaaacttggcataaccgagtcagtgtaatcgaaaaaaatgtaaacctaacaataataacaacaacaacaacaagcattgctggtgtgtgctgtgatttaacataaaatattgtcttgaagttttcatatgtaattagagtaacttatagtttttgaaagtcttaaagcagttctcttagaattattttatgttagaatcatttccattgatatttaatttcttcagtatttatgaaattttgaattatgattgctatatactttatattcacttaaaaattaagttatctttcctataaagataatttaaaaatggagatacatggaaaagtaaaatttaaattttactgataaaagcattgatatgtgtttttttcttaaatattggcgtgcatttgttttgttcattcacaatactttaaaccaaataaagtcacattttattcatgtactgtgaatagttaactcaggagctctggaaaattcattgtggtttaagatgaatttgaaaaagttactgttttttcttacctgtttctaattcacgctaccttatgatattatgtatattttcacaagccttcatagaatcaagtttgaaatcattagatagatagtaaacagtcaaaagacagatagcaatgtaggttttcatggatttgagttgtgaaaaataatgaagtattttatttttaaatatctagatttataggctatatggggaagacaaattttttaaagattaaattatatatatttaccaacttcctggtgagatagttgaatccaatactatatttgaaggtcaaatcaatttttgtgcaataattttattctatattttttgagattaaaacttgacaagatattcagaggtcaccataactgaagcatctgaagatgactatgaatatgaagaggtaacatgttaattttaggtgtttattctgtaaatttattgcagtcattctcatgaaatgctcattttattttctgaaacatgtaagaaccattcttttttcttaagagataccagtttttcaactgaatttagctagtatcagctgattaagaatgagatgtgaaaattctgtttaaacatttaaattggaaaatacatctgattcttttgattttcctgttaatcgtccttcaggttcagctccttattacctgccttgtagattcctaccataaactgttatctctgttcaggaggcacttccttcctgtcatccagtctgctcttgtcaaggattcctagattcccactgctcagttgaagcggaggccttatgcatccttccagcttaacagtatttctatctaatgtggttcctatctcaaagctttcctttaattcattgttcccgagacctatcattacttcggacacttggaggataaaatcactggtagatgacagaggctgtgaatgaaactgtgtggaaataagcctggcgagcctgggtgagcaagagacaggatgaaaattggagacaggctttttattactggtaaaatggagattatgtgtaccacatgaagttcctgaatgagttaataaatgtaaaaggcctaaaccagtgatcagtacataagaagcgtgtgttaagtcttaactgtcattaatcataattgcaatccatcacgtcctttcaagattttaatgctcagtgagttttattttttaataaacgagagattttcagttgctagtagttctgaaaaagtgatggtggaaagcacttgagatggggcaagaatggtgatatttagatagccttattattttttcagcagaattgttagattacattttctattatagataaaagcagttgcccacaaactaatcctgaatttattagaagtgacgtttattgacatttacaaggaagtcagaagaaagcagttattcatttttcatggatcttcagaatgacatggtattttacataaagtatttctttgatcctttgatttgtgaagcaaaattatttctgaagtgaaataaagtattttatatttctgctcactcttcctatccttctctttctctgtgatctagataccagatgacaattttagcatcccagaaggtgaagaagatctggcaaaagcaattcagatggcccaagaacaggctacagatactgaaattttggtgagaatttgaacactagtgtagtctatagtttagtggtagtgctttttatatgaagtttggaaagtcttttaaatgtaaatactagtgtagctcagtcatctgttatatcattttcatctctgtttatttgtgatcaagccttcactttaaggtaagcagtcatatttactcttttttggattgccattctccacatcatggtcactcttgcatgactttgtatcaagtgacaccttctctctgaactctgattaatctcactggaggataaaccaataattttcaacatttatgtttagaatttagtgtcatatacaagttctacagtctgttttgtaaacattttgtgtttttttacatgaaagtattaatcttacagggaatgcttaatatggctttcttgtgaggcttatgaactaattatgttaaggaatgtggtgggggatgttttttgattataatacaatgaactaaaagtgcataaaactgatggcattcctctaaaattgaaaactcattaaaattgtgaaccatttaatatgatggcaaaaatatttttaaaaatgttttattttgtaccaacattaagaagcatgctttctttcagtgtttaacccctttactacagagaaatgtgaaggaatttgtgaaactcctttttggttgcagatttgccttcctcagtgtggaattgtatgtgagactttactgcatattataccatatcattctttccatattctgtagacttcttcaatgtagaagtccaataactccttttcaaaatgtctgtccactcaaaattggaataaaagctctagaggaagattttttcaggccagaattaattgcattctgttgtaaatggagggctgcagctcatagtaaatgacattctctaatgaatcccatggacatagcttcttcttggtagacacaaagtgaaatctattccatagacttagtctgttggatatctcaaagcaataatttgtaggaatagttttaaaatgtatgaatagcattttcagtgacatgcaactgatatgtttattcatttatcatcatcctcttgctttacatcactaaggattttgacaaattctttatgtaccactcatttgtatcggtatttggtaaagtacatgtggctaatacagtgcttggcacatagttggcactaaataaatagcagttaaataagagaatggataagtggatcattgaatgaaaaaactgaacaaaactgtaattgcttccttctgctatcatggtcgaaagtgtttgtaatgcaaagataaatcagaggaaagttgaggaagaaatacattgtagtagctgttgtatctactgagccaaatatcagtaattcttcttttatcaatttattggaagcttttctttatcataaccttacatgagttaacattcttgatttctggcatgtctgtagctgattgactctcatttagcttctttttacctcattttaaaaaattctttggaggaacagtattatgctgaaaattcacagaagttgtccttaagctgttaaatatggattcattttatcataagcatattagttatattttttaatttgctttttatttctaaagtatgttaatcttcagtaatttgaattgtgctatgggctttctcttttaaagaatacttattgcttgttaaatccattttttgttctgatcttatatatattcataaacaagatatattttcttctctgttaaaggatacagtaatctctatgcacagaactcttaaaattttcattgaagattgcaagtaaatggttatgatactattaggaaagttaagttgaaataatgtaaattatcttatttgttaaaatattaacaaaaaatgacttattgcgacttattgaatagttgacatttaaatacattcttgttcttatgatttccttttttttttttttgagacggagtctcactctgtcgcccaggctggagtccagtggcgcaatcttggctcactgcaagctctgcttcccaagtagctgggactacaggcacctgccaccacaccgagctaattttttttttttttgtatttttagtagagacggggtttcaccatgttagccaggttggtctcgatctcctgacctcgtgatccacctgcctcagcctcccaaagtgctgggattacaggtgtgagccaccacactgggccaagttcttatgatttcctttaaatgtgggtagtatagattaaatatttgagaattgattgcatggtttgctttataaattttaaattgtgtatttgatactatccgttttcttagtgggttcaatgatctgaattctgaattaaataattttcattatatttaaagttattcttgaaaaatattgagaagataggaaatgttattaatctataacagttatgtagtttgattatactatcagtagtttcttgaaatttaagtattttacaggtatgaatacaagtaaaggtaggattatatatatgttcgttagattgtgtctgtgtgtctgtatgtattacttagggatatttgtatgtaaatatatgaaaagaaaggtctacttacattgaagctgggtctccccttctaaattctgagcctttttataagtgtatttttgccatttttttggataattcttcagcctctttggttattgatagtttattctgttaattttcaaggtacaatctcagaggtcttttatactgctgtaattacgtaatgacttctaatttttataaatgtagaattttgatctttaaatatgacagtagcaagacacccaagtcatataattgttcaattccctgatgcttttcctcctcctgctaccccttttcctcctctttcttctcccttccctcctcctccttttcttcctcttcctcctgagaatttaagtagaatttatggaatttctttggaataattaactatttttggagaagactaattgatgactgacccaagcgagaatgttctttaccatatgtatcaatagttctcaaagtattgtgggagatcttttggggtccccaagaccccttttagggaatttatgttgtctttcattttccaactacacacctgctggaggattctcctcatgtagctcaactgagacaacatatcacaacaggtcaaatgcagaaaaaaatatggggatctagctgttcctctaaatactaaaaagatttgtaaaaatttgtaacagtgtcactcttctcattagttctttttctgttttggaaaatgtagttagtttttattaaaaaaattctgtctatgttatctgtgtagaagttttgctatagttattttaaagtaaataaatgaatattttaaaatttaatatccaatatataattcttgataggtataactcagataaataagtgctgtctggagtactcaataatttttaatagtataaagtgttgcgagaacataaagtttgagacattttatagaattctattctcagaaattttcaaatatgttaagaattaatataaaaaagttctcttgctattatgttaatataccaaaatatagtctaggattaataaatatgtattccttttatttagatcttaatctcacgagggattaatattaggttggtgcaaaagtaattgtggctataccattacttttaacggaaaaaaacgcaattacttttgcatcaacctataccattatgttaactctcacatcataatgctaatggattaaattcttaaacaattttcattacttttagactcaattactagtctcaagaaaaagagctgtttgtcattattgaattcccattctctccatgtacacacttaattttagttagagacccaggctccttgtactcaaagccatgtctacagattatccaagccaatatatttgacttaatgtgaattaaggagttgatgaaatgaagccccaaataaagtaacatttaagttttaagaccacttggatttcattgtttatttttttgtttctcactggtcaactaaagttgtcaaaggaactcacattaaaacagttcaaaatttgtcaagatacttaattttaatatgtggtttagcacttctttgcaattcaacatttaattagttcttaagtctggaaagttttatgtcctcaacatctttcatatccttctctttaccttcatcctcacttagtctaccttaaagctaccctctttcttttctcatctgagctacagcatgctgctggtactatgcttccttctattcccacctaaaagatgtgtctaatgcaaatttcagtttatctcccctctacgtaaattcccaatgtgtctacccttccacctgcctttgccttcttgatatgcttcctgtttagtttttccactttatctttggccctttctccgtaagaccctgagccttaatggattgaattgtcactccttgtttttgcctcagatgttttcttgccttgaatattggtttatctttctttatctgttgtatttcctcatcgtctgtaacgttcaacctaatagtctccttaacatagccttcattcacatatctaaggcaagggaaatattcttctccattgtgtatcacttcacctagcagatttctattgttgcaatcataacacaatatagaatcctgtctacttagaaaatgtcaactttagaatgttcatagacaaaatgaagctatgtgctagagctaccattgtttgtcctcaacagatttctgggtcacatgtggctagagtaatttttgatcattcagcagtctgcaaagtgagaccatgtttcgctagtttgtagattgcttgcttttttgtgcttattctgtggtgttttgttaacctcataattaagttagttaaaagccgtaatgagagttgtatataatgtataatagggataaaagtgtaacttaaatttcttaagtatacataatggttgcatgtatgatatctgtggatacctgagtaggattttgtaatcaaaatttgtaacaaaagagcttctgtattataatgttttgtttttgctaaatgaaccgttcagttcctcaagacagaactgtcttcttcatgtttaattcccagcacctttcatggtacctggtacatgggagatgttcaccaattatatgttgaataaatatcctacgtaaaggtaaaagagatattcatgatcacattagagcttggaaggggtgtgtgtgtgtgtgtgtgtgtgtgtgtgtgtgtgtgttgtgtataaatgcagaagaactataaattgaggtatatttacaagcttatacattttattgtacagtataaataagaaccaacacagtttaaggtggtcgtatttcttttctgtgggaatgcttcaaggtgtgtgcatggtgcacattcaggaagacacagaatgcaaacatttatttgaaagggcaggaatctgccaggtgtgttgcaaccgtacatacaacaaacatcctttaacctgcccataagtgtctttagaaatgagaatagatacaccctcctgctgtctgtcttccttttcctgttttccaagttccttccaacaatcagcctaaaatatcattttcaaatttattgaccaaaaaaactgaggtagcatttattgttgtataatgaatgttcacttccaactatattttgccctgaccttacaattatatataatttcctgtgctagtaaccagcacactgcaaagacttgaaggcagacatcttgtactctgctagtttggtatctcccatgacatttgaattggcatcctgtacttcttatgtaatgtctttttaataatctttggaagaatagtccagttttttttttaatttttaatttttgaggatacatactaggtacatatatttatcgggtacataagatattttgatacaggtgtacaatgtgcaataatcacagggtaaatggggttctatcaactcaagcatttatatttctttatattacaaacaatccaattatactcattaatttaaaaattactataaattattgttgaatgtagtcactctcgtgctatcaaatactagatcttactcattctgactatatttttgtacccattaaccatcccctctcccctccccagcctctggtaattattgctctagactctgccttcgtgagttcaattgttttactttctagcccccacaaataagtgagaacatgtgaagtttgtctttctgtgcctgacttattccacttacataatgatgtccaggcccatccatgttgttggaaatgacaggatctcattctttttgatggctgaatagtactttattacataaatgtagcacatttcctttctgcactcacctgttgatggatacttaggttgcctccaaatcttagttattgtgaatagtgctgagataaacacaatagtgcagatatattttcgatatactgatttcctttcttttgagtatattcctggtagtaggattgctgaatcatattaaataactcttacttttagtttttttggggaacatctaacctgttctttatagtggttgtactaatttacatttccactaatggtgtacgagggttactttttctccacatccttgccagcattcattattggctatctttcagataaaagccattttaactggggtgagatgatagctcattgtagttttgattggcatttttctgatgatcaatgatattgagcacctttttatttaactgtttgccatttgtatatcttcttttgagaaatgtctattctgatcttttgcccattttaaaattactttttttctttagagttgtttgagctccttatatattctgattattaatcccttttcagatggatagtttgcatatattttctcccattctatgggtagtcccttcacattattgattgtttcctttgctgtgcaaaactttttaactgatgtgatcccatttgtctattacttgtcttggatgcctgtgcttgtgaagtattgctcaagaaatttttgcccagaccagtgtcctgaagagtttcttttgggagttttctcttagaaggtccacggtttgagggtgtaaatttaagtctttaatccattttgatttgattttgtgtatgacaagggataggggtctagtttgattcttctggatatggatatccagttttcccatcaccattcatcgaagacactgtcttttcccctaatgtatgttcttgatacctttgtcgaaaatgagttcactgtagacgtatggatgtgtttctgtgtgctctgttctgttggtctatgtatctgtttttatactagtaccatactgttttgtttactatagctctgtagtataatttgatgtcacataatgtgattcgtgcagtttccttcttgttcaggatagctttggctaatgtgggacttttttggttccatataaattgtaggattattttttctgtttctatgaagaatgtcattggcattttattttgttggggattccactgaatttgtaaattgctttggatagtattgacattttggcagtattgattcttctaatccatgaacatggactatcttttcattttgttgtttctttttcgatttctttcatcagtattttatagctttcattgtagagagatctcacttgattggttaagttaacttctaggtatattatttgtaactatttgtaaatgtgttttctttcttgatatctttaccagattgttaactgtcagcatatagaaatactactgattttgatatgttgatttcatattctgcagctttactgactttatcagtccttttggtgaataggtttttttcgagtataacatcatagcatttgcaaacaaggataatttgacttcttcctttctgatttggatgccctttatttccttcccttgtcagattgctctacctaggacttccagtactatgttgaataatagtggtgacgatgggcatccttgttatgtttcagatcttggaggaaaggctttcaggttttccccattcagtgtgatactacctgtgggtctgtcatatatggcgtttactgtgttgaggtatgtttcttctatctccatgttttttgagggtttctatcatgaagggatgttgaattttatcaaatgcttttttcagcatgaattgaaaggataatatgatttttgatcttcattcttttgttatgatgtatcacattgatagatttgcataagttgaaccatccttgcattccaaggatgaatcccacttggtcatgatgatgacctttttaatgtgttgttgaattaaattggctaatacggtgttgaggattttgcatctatgttcatcaggaatattggccttttaacatgtctttgtctggccttgatatcagggtaatactggcctcatagaatgagttttgaagtactcccttttcttgtgatttttagaaaagtttgagtagggttggaattagttcctttttaaaatgttttatacaattcagcagtgaagccattgtgtccagagctttcctttgctgggagcctttttattatggcatcaatcttgttattggtctgtttggcttttggatttcttcatgttacaatcttggtaggttgtatgtgtccaggaatttatccatttcttctaggctttccaatttactggcacgtagttgctcattgtagcctccaatgatcctttaaaatttctttggtattggttgtgatgtcccctttttcctcttgattatatttatttgagtctactttaaaaaaatttttttttggctaatgttttgtcaattttgtttatcttttgaaaaaaccaacatttgttttattgatctattgtattgttttgttcatttgaatttcatttatttctgctctgatgttcattatttttctttcctctttactcttctctcctcaagtggaaggaaggagtctctcggggttaggggaggtgtggcacaagcactcacttggctgccctggctggtatctcactaagtcatgtgctcctaatgtccactggctctgagcccagcatagcatcataacttgccaaagaattacagtccatgtggtgtagactgcctttcaagtttatttagtaccccagaaccctttagcccgtggtggtgaggctttctggaactcaggttctgactgctgggatgggcaagtcccctcttgctagggctggttgaaatgctccctctgggtgatggctgagttctgcctggtgttgctttctgccatgatgatgcagcactattttcgaatgtaaaaaattccataattactacagtctccctcccacaggacagagattttctctccatgccacttggccactgccaggggatgggggaggtgtggtgtcagcaactcaagactgtcttttctgccttcttcagtgcctctttcagcaatatgaagttaaagcctggtattgtgattactcacttgatttttggttcttatgaagttgcctttttgtgtgaatagttcttcagtttggtgttcctgcagggttaatgatcagaggtgtctattcagccatcttgaactgcctccttccaaattattctttttgaactttacaaaagtaattttacactctacccctttgtcaggatttttctgtagccccaaaatttgcctcaactcaccactattgtgaatgtcatagcagctatcagtaataaacatcagtgttgaattttgtttttttttattttttttactttattattattatactttaagttttagggtacatgtgcacaatgtgcaggttagttacatatgtatacatgtgccatgctggtgtgctgcacccactaactcgtcatctagcattaggtatatctcccaatgctatccctcccccctccccccaccccacaacagtccccagagtgtgatgttccccttcctgtgtccatgtgttctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgctacattttcttaatccagtctatcattgttggacatttgggttggttccaagtctttgctattgtgaataatgcagcaataaacatagcagcatgatttatagtccttttggtatatacccagtaatgggatggctgggtcaaatggtatttctagttctagatccctgaggaatcgccacactgacttccacaatggttgaagtagtttacagtcccaccaacagtgtaaaagtgttcctatttctccacatcctctccagcacctgttgtttcctgactttttaatgattgtcgaattttgtatagcacttttggaaagaatttttggggcagcaaagatcctctttcctcattggatttccatgtaaacattctgtgcattctgtgtaacctgttgtataaccattaacagcttgggaaagagaaggcgaaaggaaaatttgctgctgagtttctgtaggtgagaatagatctgcttattcaaatagtcagcaaacaaattagagacttcttgccaatgcgaagaaaatgacagcactcaagagacgatgattgttttatttttttaattttatttttattgagcaacacttcattccataaaatagaattagtattccctattccttggtatttttaaaaaactaccaattattttatttattttgtacactgacttacatgatataataatttttatggctgtactaatttcatttgttgcttgctgaaatgtcttcatttttctagttttaggtctgctaagatgttctgtcagaatactacatacagtttgagtatcttttatccaaaatgcttgggaccatagtatttcagattttggattttttttcagatgttggaatatttgcaaatacatatcaatgataatgatattttgaaaatatgatttagtgttattcaagtgcaaagcttgaggatagccacctgggaaacacagtctccaaaagaatgagtgagtgttccatagtggggaagttttcacttatataggcagaaacagaagttaacagggttgcaacattttccatacaaggtcattacatagtttgtaatgatttgattgattacagcttgctacattccaaggaagattgctttgacattctgcaaggaagggcagtgttctaaagtggtcttatatctggtggtattccgtgttttgtaatcatttttaggacagtaatgaagacatttaatctataattgaagaagcagaagttgcagcttcatgctatgtggctcaggccacatagtcccgttcctctcaagccttaacaaatataaagttccaaaagctataggtttggattatttagtttgacatatacactaagatctcttggggctgggacccagttataaacatgaaattcatttatgttccatatacaccttgtacacacagcctgaaggtaattttatacaatattttaaataattttgtatatgaaacaaagtttgtgttaagtacttgcatgtggaattttttacctgtggtatcatgttggtgcttcagaatttttggctattggagcatttcagattttggattttcggattagggattgctcaacttgtactttaggttttgagggccatgaggactctgtggcaactagtcaactatctcatgtagtgcaaatgcatccatacataatatgtaaacaaatgggcatgggcatgctgtgctctaacaaactttatttataagaactgttagctgacccctgatctagttgatagactgactgacttccatgtggaatactagtgtaagctcctgttgtcactaattattttctccatagtgtttctaaaagtcatggtactaaaattactgtatttctttttaaatgataattaaaagcattaaaaggtccatgcattctttttttcttttttttgattaacatgctatgtgctattgaaagggcaaacctaccttcttactatcctttagacaatccaatcacactcctgctgcagggcctttgcacttgctgatgcagatacaaaccggaacataagacactctgcctctttgtctagatttatgctcagataacagttttatcaatgacatcttcaccaccctaaatacgtagcaacccagcttcacataaatacttgtcctacacttggttctatctttagtcctctactttctccccaccccaaggtacttagtaccatctgtcatagtatatgttttttatttagttattcatattctgtctccatccacttgactaatagataggaggacagagatttgtttgctttcatctgctttatccccagtaattaaaatattaatggttcctggcatataacagtcaacaaacattgttgaaaaaaaatgaatggatgaatgaatgagtcgaaggcttatctatatcattaattaatgctttgatgttttcagaataaataaatgcacgtttaaatttcaggaacggaaaacagttcttccttcaaagcatgcagtacctgaagtaatagaagactttctctgcaatttcttgatcaaaatgggaatgaccagaactcttgattgctttcagtctgaatggtaaacaattatgtagataaatagttctcttaaaattctaacatttaacatatacacttttaagtgtcttaggagactttgaaatgactcagcctatgaaaaatgactagaaacttttcccatctccagccctgaaaccacaacacacacacacacacacacacacacacacacacacacacacacacacacacacaaatcagaatagcagttacaaagacatttttattaaacatctttcccaaatatttaagtttaagtaatttttaaaaaatcaagacacttgaatatctcctggagttataaaacacaaagatattttatgaaaacatttcctaatatttttgtataattattgagagtatttcctgtatttagacattatactaaacagtcctgctttacttccttgttttatttatagtgtaatggcttgtctttttctactcacatagctgattaattatatttctatgaatattcttcagttagaagtaagtggaattgtattttgaatatcacttaaacaaaatattttcttgttataattgaaaattttaataactagttatgaaaatcagtaggtgtacctttattcctttgttataataataatgtcaccaggcatattttcagtttcctgacattgtttaaataaatttattaaatgattagctatgaaaatgtatttgaactttaatagctattgcatattctagaaagggggattaatatgatacctaaagatgtttataattaggactaattcctaattttaaataaatttgcaatgtatggataatttgcgatttttactcatccagctgtggtataaatttttattttttgctttttttggttctcatcttctgagaacatgcacataagcgcagtcagtttcattattttaaattgcacatgtaatgttaataaattctatgaggagaattatttttcattaatacagtctaagaaaaacaaagttcagtggaagaaaaataatactgcttctcttaaatttggaaatagtgtgaattatttaaaataattttttataaaaatatccctaagaaatataataattacaaatgtactagaaaatatattttttgtaaaagtaggtagatgattaatttacagtgctaataaagtgaaagattaatatgattcacttaactttctgtgttcaacaatgtgtgttaggacatgtgatgcttatatgttaggccagtccaaagtgtaaaatgattttcttagaataatctggatccaagtatactgttaacaattcggtgactattgtcatattttccttttagatttagcaatctgaattgatgagatgaaattttaggaaactaagattactgttagtattaggatttaaagtcctcccaaactaagcatactagtcataagataaaattggtataacgcatttctttatgagtttagaatatcgtggttcaagtaattttatccttatccctagctgccagtttgcaatgagattacattgtattgaataccttatttcatatgaaacattttttattttgattagaaaactttacctattctacatagtaaaattataggaatattaaatatattattttttatcatttttaccacaggaaaaaacacttagaatatatcatttgctatgaattcacttaatctttcaaaacatgaccaaacaaggattttcctttgttagtttgttaaaataagcaaacaaacaaaacactgggcagtaaaatttgatataggttctttcactcctcaagcagaaaatgcaatagatcctttaaatcgagggttagaaaactaagatccttgggccaaatctggcctgcttcctgatttttaaaataaaatcttattggaacacagatataacctttctttaggtattgtatatggctgctttcactctgtaaaagcaaagttaattagtcacaacaggagagatatggcctgtaaatatagttttgccaattctaaaatatttattctctgaccctttacagaaaagagttgccagaacatagtaggaatttgttctatgaaccactgaaaagtttccattgcaggtttagtcgatggttcaattctatttatatgcctattttagaattctcaatgggcaatggtaatttctcaggggggaaaaattaaagaagaaattaaaatggagaaaatatgataatctaattccagtacccttacctgagcatatgtcatccatctgtcttcctacactgactgttcccctattaacattgtcagaactactcaccctaaagatacattcttactttttttgcctcttactacacttctttttaaaccatttttccctttccagccaatattttgaaaacagagtttaaattttttttctttcttcacctttttacttcgtattcaacacttagttctctccagtttggcctattcgcaccatttcactgaaggtagggtggcaatgaaaatgccatcaaaagtaatagtacaattatttataacatttaattactaatttaattttttttaataatggaagagattgtaaattaagagtatatttcattaatttgcatgaaagaaatattgcagcttttagacaataaaatttgtcataacatttaatcacttaaatgtgagcagtgcagttacaactttctggggatggttaagttttaaagccagagcctagaattaaaattacctttgatatagcccttatgttgcccaagtatgtacaggaaatatgtgtggtgttgtgtatacattaatgactcccagtgaacactacacaaatatttgttcctttgtcatttgatcttactgctgtttcttcaattaatgagaacttggcttctagttatatgtcccataagaatattttttccccattcattattaagtttaacacaggaatgtagtgactcttctacataacataaaagttagcaaaagctaatttttgctatgttacattatgatacatttgaccactataaatacatctgcacagatttatgtactatgatattaagagagcagccatttaggtgagtatttaatttaaatttttaaaacaaaattaataacatgtttattaaatatgagggatttaaaaatatttaagaaggtgaagccttaggcttatcactcagaaatttactttgtatcatttttattgatatagtatattctcatgcattatttcatttacttctcccaacaactgtatctagcaggtagccacagccatatttctattttacgggtaaggaaaggggatagggagattaggaaatctcatcagtgagtgtcaccaagtcatagccagtaagtggcagagtcaacctaggacatactgatcttaaagaccagtctcctaaccacagggctatattgtgcaattatacaagagaatctttgaaaaaattaataaaggtgccttttggcttggctggatactaaaaggacttcagaaaatattaatttagaattcaaatttgtgcctattttctatattggtttgaggaatcttggggccagtaataaacatgtcagccatgctatatttttcctgagagggactgtctggttctaagtgatagtcgcgatagtgctggggattctgacatcctcggtttgtacaggaattaaaataattttgtctgtgttggtaatgtatttccctaaatctttatgaaaacatggaggaaaagttctcattataggcttcgtataaggagattataatcaagatgacctttcccctgtcttttacatcctatgccttgggtgccaccatgagggaaaaataatccttattcttctgacaccatttctgtttttactggaattctgtcataatattcatcatttatggcagtgggtcttaaatgcttttgttatgtggacaaaattttatgaaatttctatgcactttctccctgaaattcatatatattctccatttctacataattctaagtagttgatggatctcctggtaaatattaagataattaatgcagttttattagtgataattttattggcaatttcattaagagcaaattatatttcaaatttctaatagttatggcaatcttttttcccacctgaacacttttgagtcttattttaagagtgagtgaaaaagaagaaaaaataaaaagtcaggatatttgttaaaacaaaacaaaacaacagatacatacaaactgaagcaaaccacaaaaacattatgtatgagaattcagattttattgagaagtatacttctgtagtttgtgcattaaaattcctaattacttgtattattatctaaaaatgagcctgaagtcatctttcatatttttacatggatggcagaaaatttacctgataaataatttttgaatgtcctgagatatatactatgtaataaatgttgtatttggatttgtgcttcttttatcacatactattttatttatagtatttaatttagaggaaaaactattaaatcacttttttcctcatagaaaatttctctagtggtttttcctcattaaataaagcaaggtgctgaaaaccaattttatggtcagaaaaagcctatgtcttctcttctgagataagtatatcacattcctagtacagattacttactgaatttatgattcaattgatacctatttcctgttttatgaattgtggcaaatataatggaatattgattcaattatcttaatcttcaggatattctatgggggggtcctcttgctctttttttagaaaaaatcagataaagtatataacacaaaatatgtgactttataaatatgtaacattattatgatttataatatgaaactactgataatttataattagctctaatatttagctcatctagagtaagctttgtagggatttattaataaccttattacttgaaatatttttctgtgctcaaattgttttttttaactttattgattgccatacacagggattaaaattgtaattatttacaatctgcaattgattctctgatgttgcttcttatttgactgagaaaatagaagttccatcactcccacctccctctttaccaccctgctgcctctggcctcaggtattcttctcttctccctcagactctaatgttatctgaagccaactctcatcttgtctgcttgataccagcccctctcacagacttaaggatactgcttttgtaatcgtcccgcttttacctccattgtcagttttttccctcttggctgagtcattcccataagcatacagatgcacaatatctcacattttaaaaaaggaagagaagaaccgccctagatttcatatcttcttctaagttcatcttgattccctgtgctttgctttagagcatatctccttgaaaaaagtttgttgccacttcctcatttcctagtctctcagacgtactctcagtttggcttttatctgcatgactctattgaaaacttttttttttttaatagtgactttcacagtgccaacttcagtaattgattctcagtattcttttcagactcctggcagcattcgtcactgttgttcagttcttcctttttagaacactttcttcatttggcccctgggcacagctctcagattctcccactatttcacgggcctctcttgcttcgtcttttttggtagtgttttcttttcccctcaacctggaagcagtgtagtgtttatggctcactcctaggacctcttcatttctttctttctttactttcatttcccactgcctagctggtctttttcagtctcatgactttaaatagtatctataatgttgattaccaaatttaaattgccaaccctgacttttttcctgaactctgaacatgtatactcaacgtttgtcttcacttaaatgtctgctaggcatattacatttaacacgaatggaaacaatcccttgattactccagccactctgctcctcctgcatttgtccccacttagtaaataaatggctatctgttgctcagccaaaaaccctggagtcgcacttgccttctctcatttaccaacacctgacagttgatccatcagagagtcctgctggccccaccttgacagcatttctagaaggtacttctcataatctccactgctaccaacttctttcaagccaccatgctctctctttgactactgcaatagcctgctaactggtctctctgattctatgcttgctagactaatccctttaaaacataaatctggtcagtgtcacttatctcaaaaccttcctatggtttacttctgattcagagtaaaattgctttcctcactgtgactccctgctgttttcctgactcatctttcaccattctctccttggtcacttagttggcttcagttccagacactccaggtaccctggctgtttgttctttcttgtagttgccaaacacttccttggttcagggccattgcatttacttttccatctgccccagctgcttctctcccagctatccacataacacagtccctcatttcctttagatctctgttcagatatcactttgtcagtcatgtttgtcattcatgcccaccctatgtaaaatagcacaagcactcccatcagtgtttccacctcattcttcctatatctttcagacagcttatttaacttcatagaacttatcaccctccccactagaatggaaactccatgaaatagggacgtagacatttttgtcaattttaatattgtctagaccagtgcctggaacataggagatgttcagttattatattttatacaccatgatggtattggtacctagaagtcatattttattctaaaatatattatgactgttggacattttaacttataaatgtaatactgcaactaattactataacactccctgagacttaactttttgaattgtacataaattaagccaatttggcagaaagaaatgatataaacccttttgtttgattttatcctaggtatgagttaatacagaaaggagtgactgaacttagaactgttgggaatgttccagatgtctacacccagattatgcttttggaaaatgagaacaaaaatttaaagaaagatttgaagcactacaaacaagcagctgagtatgttattttttaaatgacattttcttctttttcttttggactaaataaaagagttgagtgaagctgatatatgtaatataccagagccttaatttttgaaaactgaatttttctagttgtaaagaatgtgagaggcttcattagcaaattaattaaacagatgatcagaactatcacaattataacttaccaacaagaagggaatgcaggtagttgtttaggagatggtacattttttatataacattcacttccttgtgtatttgatagtcttttcatggtttataacattttctcctgtaaagataggctaatttctgaaataataattaaatttatagaaagccgagaggaaattgctagtttattcctggtagaggaatttctgtatttgaaaattctccagaaggaataatataaactgtggactttgggtgataatgatatgtaggttcgtcagttgttaacaaatgtatccctctgttgggggctattgataatggggaaggctgtgcatgtgtgggagtaggaggtgtatgggacatctctgtaccttctaatcaattttgctatgaacttaaaactgctctaaaaataaagtttattaaaaaaaagttaattctctatactgttttccatacaggttgaactaatttacattcccaccaaccatgtatgagtgttctcttttctgcacgttctcaccaacatctgttatttttgactttttaataatagctgttctgactggtgtaagatgatatctcattgtggttttgacttcagtccagcagttccactactgggtatctactcagttgtataaaaattccacccacactcttacgtttattgcagtgctattgatgataacaaagtcatggaatcaacgtaagtgtccatcagcagatgatgggataaaaaatgtgacatttatatacaatggaatactattcagccataaaaatgaatgaaatcaggccttttgcagcaacatgggtggaactcgaggccctcacccttagtgaaatgactcagaaacagaaagtcaaaaaccacatattctcacttataagtaggagctaagcaataagtacatatggacatatagaatggaataatagatactggagactttaaaaggtgggagagttggaggaaagcaagtatgggtaaaatgtccactacttgggtgattggtacaccagaaacccagacttcatcactatgcaatatatccatgtaaaacaactgcacttttaccccttaatctataaaaataaaaaattttaaaaaagaaaatataaactatccataatttcaccacccagggccaaccacttaccattttgttgaatagcagccttgactttcctcaatgcatttatattaatgcatatttatgagtaacttttaaatataaactgcactaataccatattttgtaagttcctttttcattcaagagtacattattaatatattttatgaaaataaattttcttctaacttaaaagaaaattactgaaaggaaacctttgttttgtaatttcctggcataaatttattcatagaagagaagccagatctctccacacctttctttctttctgcaattaatggaagacatgcaattcctggtgaacaattttagataaacagccagtgttattctgacaaggaatgtgtgaatgcattaacttggggtgaatctgcttatctgaggcaatgttatatggaaaaatcaatgctcagatgtgaagcagagttcgtgttttatttattaattcatttttattaaatatagttaaagagggcctttctcacttaaagaatcatattaaaaccaaaattagattaatggaactaccatataggaacataatattgttaagatttttgataagtttaaagaaacatgccttttcattgagaagtagagaaaatatttaagctcttgtaaaagatggcagtaaataatttgtatgatatcatttattcaagtattatctgtacttgtagaaatgtttttgcaaggtatataaattttgtattgtctatggatgtaatgtaccatttagaattttatattttacattagaagtgtatgatgattcagaagaatatattactagaaccagtgttctctctattcttcattccatttctcaaaagtgttttgtactgtttgccctgttgctcactatgattttgtatattcatctaatggattcactgggaatttggtatagcatatttctcacagtgctgcctggcacactgtttcagttcctgatctcctttgaattattgcttgagtttgctaattttcttttaaatagatcaaagcagcctctttatgccataagtttagctccagtgacattgaatagtcattgtcaagtactggttgtttgttgaatattatgtttaatagcaataatacgaaataacatattactcatgcagattattaacttaatgttaaaagaagccaggattaaaatgtatcactcaaataaaacatcttgtcttactaacatatcagattatagttttaattttaacagtttatggctatttctcaaatctatctcattcaatagaacttaaaatctaaaaaattagacaaggaaaatttgtgtttgctttactctacttgacatggaagatttgaaaggaagctgcttgatccttagtagatgcttaatctttattttgttgagtggatattaagcatggtgtgctttcacagcacattttagtaaagtgcttccttatagcctggttctactgatacattcttagaaaatgtagaatgaagttttgtttcgttttgtcagtagttttttattgatacatcataattgtacatacatttatatatgataattgtacatgtgatattttgatacatatgtatcaaatacatttgtacatatgataattgtacatgtgttattttgattacatacatacaatgtgtagtaatcaaatcagagtatttagggtatccatcacctcaaacatttatgattttttgtgtgtgttgggaacatttcaaatctaactattttgaaatagatgataaattattgttaactgtagtcacgctactgtgatattgaacactagaagttaacccttctatctaactgtttgtatccattaaccaatttctcttcatctcccctttccacccaacgttccccacatacttcccagcctctggtaattatcattctccctgctacctccatgagatcaactattttagcttccacatgagtaaggacacgcaatatttgtctttctgtacctggcttatttctcttaacataatcatctctagtttcatctatgttcctgcaaattataggatttcattctttttttaaaaatggcttaataacattccattgtgtatatgtgccacatttgatttatttattcttctgttgatgggtacttaggttgattccacattcttggctattgtgaatagtgctgcaattaagttttgaaaaaagttttccgaactacatctgtcatgctaccagcctgccccaaatggtagtgtttaatcatctaggtttttcaatttgacttctgaggataattttcaaatagcaattagtaataaacatgagattccctatattgagcttgagctaatgtttgtatttttaggattaggatatttcttaaggcaaaataaaacaggcaaaatagaataggatatttcttaaggcaaaataaaatagatatcaaatacttttctaataataatttttaatacacaaaaaagtcaggttgcagatatgtattattcttgattatactaatagcatttagtgatgtatctaggaaaatcaaataaataatacagctataaaattaatatttatctgggggaaagttgccatggaaagagtattgatcttaaagttcaaatacctggcttctaatattctgttacttattaactcagtttattgaattactcccagttttcttattaacctgggaattattttgcatagtgttattaatttctatggaataatgtgataattaaatgagtcaagctatgttaaagagctttgtaaatcacagagtgctttgaaatgtcagctattatcaataactctaaatgctgtcatctctaagtttttattaatcacatcattaatattttttaaattcagcaacgatgaagtatgaagaaggaaatgaaaggagaaaatatttcccactaaaatatcatttgaattgccataattaaagcagggaattgtcattttctctgttgtcaacagtgtcaattttagactataggttttctctgtacctgctataaatatagattatctgtcttccaaaatataaagttgggaaaataactgttgagaacatttctgtatagatgtttttatggagaaaatgatcttattaaaaatttatagttacattggaagtaaaagtatttcccatactggatattgaagaacaatatttttctcagaaaaggagagcatacgttttctattgaaatgtagaccaattgttattttaaatgcaaaagtctaaagttgcacttaaagcaggtgaccacagttgcagagatttggtggttgacaccaacatggcacatgtatacatatgtaactaacttgcactttgtgcacatgtaccctaaaacttaaagtataataaaaataaataaataaataaataaaaaaaagtaaaaaaaaaagattataaaacaccacttagaattgtatctttcacagtttagacactatattcattcataaaccttgttttatttggtagttgtcatgccaaaagatttactttggtctgaagtttataaataactattatgagttttattaattaaaacctttttgcttgatcttcttgcctgttttcactagcattttatgtcttctttccatagtgtagacaatgcaaaaaaaaaaaaaaaaaaaaaacaaaaaactcgtttgggtgattgattcctgaaagcaccagtgtacttgaactttaacatcttgcagtctgactttcatttcactttttctcagttggccttggacacaagagaactgtttgacacccaaatttagcagtcttttttttccatttgtatatcctggtttttattcctatcttcccttagcatctgtgacatcatactgttctgcccctccttctaccttagtgacaggcttcttttccttttcttaactccaaacagttgatactctttaagtacattaggataactattgactacatgtgaatattgacaaatacaacatatattaggtagtggtaagtgctatgaagaaaaataacatgggtaaaggagacagacggggtgctgttttatgtaggattggtaaggggtggggcagggagcaggggagcacatcagaaacctgaagagactgagggaaaaagccaagtataaacttgggaaaatggaattccaggcagaggaaaaaggaagtataaagaggatgtggtgaagacaggttggcttgttagaggattagcaaggaggctatagtggctctaaccagtgggttagtggtagaggcctttgctagaaacttgctttttcccccaggtggcatgtgaagctaatagtttgagcagaagcatgtgaacaggcttctgcatggaaaaatgctcaatgttactaattgtcaaggaaatccaaatcaaaagtaaacgagaaatcacctcatacttttcaggatggctattattagaaaaacacaaacaatatgtccggcgcggtggcttacgcctgtaatcccagcactgtgggaggccgaggcgggcagatcacaaggtcaggagatcaagaccatcctggctaacatggtgaaaccccgtctcttctaaaaaatacaaaaaattagccgggcatggtggtgggtgtctgtagtcccagctactcgggaggctgaggcaggagaatggtgtgaacccaggaggcggagcttgcagtgagccgagatcatgccactgcactccagcctaggcgacagagcaagactccgtctcaaaaaaaaaatagaaaaatacaaacaataacaagtgttgatgtaaatgtggaagaattggaacccttgcacattactggtgggaatgcaagtggtgcagccaccactgaaaaccgaataaaggttcctcaaaaaattaaaattcaaactaccatatgatcaagaaatcccactcctgggtatttatttgaagtgaattgaattgaaaccaggatctgaggcagatattagcactcctgtgttcattacagcattattcacaacagccaaattatagaaacaacctaaatgttcattgacagatgaatgggtaaaaaaaatatggtacattcatgcaatgcaatactactcatcctttaaaaagagggaaattctgtaatatgtgaggacatgcatgaaccttgaggacactatggtaagtgaaataagacagtcacagagggatgattactgcatgattccccatatatgaggtatttaatatggtaaaattcatagaatcagagtagaatggtggtttccaggggatgacaggagaggaagatagggcattacaaatcaaagggcataaagttttaggtaaacaaaaatcagtgctacagatttgttatatatcattgtactacaaccaacaatagtgtattgtacacttaaaaattcgttaagagggtagatctcatgttaccttcttaccatatactcaaagaaagtaaacagtatagactaatgaacctcatagacctataggataatcaacactctacttttgtcattcttatttcacttctactcttacccattccctactgtacctcaagttattataatatataatttttacagttattttttgttatgctttatatacattgaagtatatgtcttagctatataattttggcaaacggataaactcttaaacatccacattcatctcaaggtagaacatttttatctatccagaagttttcctcatgtcccttctcagtcattctctgtcccagcaatcacttttaagaattttttcactttagattagttttgtttgagaatttcataaatggaatcacagtatattattgtgtttggcatcttatactcagcataaagtctgtacaatgtattatttttgcctgtatcagtaatttgttcctctttattgctaagtagtattctgttgtataatgtatactacaacttttttatcctttttccatttagttatttccaacagttggttattaaagataaaactgctgtgaacattgaggtacaaatatttggtgggaatatgttttcatttcttataaaaacttagtggaatttctggatcaaggggatagatggatgtttaactctgtatgaactgctcgtacatattcccacattcaagttggtccattttgctttctcagtaggaatacatgcgaattccagttgctccaaacagctactaacattgagtgttgttagtcttttcagttgtagccattttaactgttgtgttgtggcatcttgtatttttgatatgcattttctgtatacaaatgatattaaacataattttttttgctttttgaccattctaaaaagcattctacaaagcatttatcctgctttctgtatgtttatgttttttgcttgctgatcttataattgaattgtaagagttgtttgtatattctggatataagtgctttgttagaatattgtgaatattttctcccagtctgtggcttgtgtctttaatttatgaatggtgtctttgttgagcagacactataaattttaatgaagcatatcttatcttttttatggtatttattttgacattttgttgaatatatcattttctactataggtcacagagatattctgtgttttcttctaaaacgcttaaaatatagatttttatttcaacataggatctgttcttaagttttgtgcattgtgtgaggtagaagctagaagttaattttctttactataggaatacataattgttctggcaccatttcttgagaaaattatctttaagtctcatttaatttctttggcacttttattgaaaatcagttgaccctttagaataagtttgccaatttccacagacacgggtgatgtaggtgtgacataggatggggattaagttgaaaatataacttgattttggaaaaatatgtgtgtgtgtgtgtgtgtgtgtgcatatctattttttgaggggggaaggattgatactgtcacaagttttagtcctatttacatagcatatctctccatttaagttatatttaatttaatactttatatttatgaaggagcttgaaatttatgcccttcatattgaattatctaatgtttatattttgttgttgcattttcagttccatataatagagactatgttttgtgttcactatacccacggggcctatctctgtgcctggtacatagaaggagcttaagtgattgtgtgctattaaacttttggctctttagttaagcttttaataatttttagagcagttaattggtgatttttgcccctttcatggcatttatttggggtaggcattattttcttgggaatgtaaccagtcttgccgtattttgagtattgtcttcctttgccaggcttttacagtaaggaaatataatgcagaccagaaaggctttgttgagagccctgaagaaaataatactgattgggattactaacaggaagatgaaaaactgccatttaaaaaataatgacatactttattttacaatctgccagagagtataggcataaagaaaaccataattacatggcaattaatattgaggaaaaattaaggtggtttactaaggggcctttatttcactttcaaaatttacttctataaaaggtcaaagagtgcccagcttttgtgaagacccatttagttttatgactttcagaaacaaacactgtgaaaataaagataataatgaggcttataaaatttcatgctttagtgtttaggtaattgcttgttaaattaagaaggtatttttttctggacgtgaatatacccctttcttttttggttaggatataatgaaagtttttctctaatctggttgaattccattttggccatccaacagttattccaatataaaatttagtgggttaaataaattcatttataaccaattgaagataatggaatatttgctaattatgtaactactattatcagaaattactttgattcaattttttcatgtgagaaaaatatatgacaaagatagcctacttcgatgcaggtaaacaagaaaatgtttatatgctttactttgccaaattataacaagataatccaataaactcattattaaatgatcattcaaaaatacttaaaactgttcagttaataaaattattttaccatggatattcacttcaaaatatttttgagcatactattaaataatattcatatcatattgaaaatggagttttggggcaataattttatagttcgataagaatatctgtaccttaatattgcataattgaattgtagactttgatatgctggtttcctgaaatggagaagttaaataatcattgtaccattttattaagacaaagcatgtgcaaattgttttctttatgatgtacacatttaaatagaatgttccactgagtaactcttaacagcgttgtacttgaaacaatgtctgtttgctgtgtttttttttttttaacacaaagatgctctactaatgtgatgaggaaatattatatagtttaaaatattagctgcttatatgaatattttaaactttattctttagtacaacttttattttccatttattaagcagatgggcagcaggaaggtcataataggagaagcaccaccatgaaatgaatttaaattgttctactgaatagacttcattgtgcaaacagaaagaaagtccctgaaaaccaatttaatggtcagaaaaactttaaggtctaatacttcagtcaattcctatgctttgtttcctgggacgagcacaaataggcttctaatgtatatttaaaaagtgaattgatgcaatgctgcacatttatggttctgcttaagaaattttgcagcgttatttcttaaagtatttttaacatgttgtgggtttacatttcacataagataaaaataagctcatttatgtaattcaagtgactgaaattaagacaatttagtatactcaaaatagacgttcacaaaattttaaattcattttttaaaagatacacagtgttactaatattcacatatcctaatatttttggttgattagaagatatttacttactggcacactccttattgtaggaagataaatttagcgcttagaagaattgtgtgtgtctgttttactatactgaatagcagtattatgaaatgatgatgatgattatgagtacagaaacatttattgagtaatttagtatttgctatgtgcaagactatgtaagccactttactaaaatatttaattgaatacgctttgaagctcattatatgtccattttggaggtgctaaatttgatatttacagaggttatatagcttgacaaggtcacattgcaatgaagaatttcctatattgaatatgatattattatcatattagcattactccaatgaagtaaccatatctgttagctgattataaagacataatactggatttttatctatggttctaaaacaaatatagtattattttttagataaactcattcaacttgacatgctttagagctaacttgttttgatagcccgctcaggatattctgtacaacttttttttaaaaatacagggttaaaatgaatgttctaagatcttattcattattctttttgcaaattatttgaagagattcattgatcctttttcaaaacaatttatctcttctacacacagcctttctctatacttctaattgaaaatggaatcattttctaaatgagaattcaagtgaggttcttgtgctttcacaataaagtatcaactcaatcatttacttattttccattcactttacttaaattctctcctcctcttcacttagtactcagtaaggatgatgccaaacagtctgccatctcagggagatggcagagagtttctctctttttagtccatattcactagggaggtcttgtgtacctgagccttaggaatgaggacttttcctgtctctttgtccatcctctgtgttatggccaaactctgccttctatctgtagttggtctttgtaggagtttcatactgctacctcaggagtaggatacttctacttgctgtgatggaatattaaggcctaagatggttacctgttgattggtttggctgtgtccccacccaaatctcatcttgaattcccacgtgttgagggagggacctggtgggaggtaattgaatcatgggggcaggtctttccaatgctgttctcctgatagggaataataagtctcacgagatctgatggttttagaaaggggagtttccctgcacaagctctccttttttttgcctgccaccatccatgtaagatgtggcttgctctttttgtcttgcaccatgatagtgaggcctccccagccaagtggaactgtaagtccattaaacctctttttcttcccagtctcaggtatgtctttatcagcagtgtgaaaatggattaatacagtaaattggtaccagtatagtgggcattgctgaaaagataccagaaaatgtgaaagtgactttagaactgggtaacaggcagaggttggaacagtttggagggctcagaagcagacaggaaaatttgggaaagtttggacctccctagagacttgttgaatggcgttgcccaaagtgctgataatgatatggacaaagaaatccaggctgagatgatctcagatggagatgaggaacttgttgggaactggagcaaaggtgactcttgttatgttttagcaaagagactggtgatattttgcccctgtcctagagatttgtggaactttgcacttgagagagatgatttaggttattatctggtggaagaaattgctaagcatcaaagcgttcaagaggtgacttgggtgctgttaaaggcattcagtttcaaaagggaaacagagcataaaagtttggaaaatttgcagcttgatgatgtggtagagaaggaaatcccattttctggggagaaattcaagccagctgcagaaatttgcataagtaatgaggagctgaatgttaatcaccaagacaatggggaaaatgtctccagggcatgtcagagacctttgcgacaacccctgccatcacaagcccagaggcttaggaggaaaaaatagttctatgggctgggcctagggtccctctgctgtgtgcattctagggacttggtgccttgcatctcagctactccagccatgactaaaaggggccaaggtacagctcaggctgttgcttcagaggatcgaaacccaaagccttggcagcttccatgtgatgttgagcctgcaggtgcatggaagtcaagaattgaggtgtgtggcctctgcctagattttaaaagatgtatggaaacgcctggatgcccaggcagaagtttgcggcaggggtggggctctcatggagaacctctgctaaggcagtgcggaagggaaatatggggtgggagcccccacacagagtccctactggagcattgcctagtggagctgtgagaagagggccactatccgttataccccagaatgatggatccaccgacagcttgcactgtgcacctggaaaagccacagacactaaacaccagcccatgaaagcacccaggagggagggtgtaccttgtaaagccacaggggtggagcttcccaagaccacaggagcctacctcttgtatcagcgtgacctggatgtgagacatggagtcaaaggagatcattttggagctttaagatttgactaccctgctggattttgcacttgcatggggcttgtagtccctttgtttgggccaatttctcccatttggaatggctgtatttacccaatgcctgtagccccgttgtatctaggaagtaactaacttgcttttgattttacaggctcataggtggaagggacttgctttgtctcagataagactttggactgtggacttttgagttaatgctgaaaagagttaagattttgggggactgttgggaaggcattattgtgttttgcaatgtaaaacatgagatttgagaggggccaggtgtgcaatatggttggcccacccaaatctcatcttgaattcccatgtgttgtgggagggacccagtgggaggtaattgaatcatgggggcaggtctttctcgtgctgttcttgtgacagcaaataatcctcatgagatttgatggttttaaaaaggggagtttacctgcacaagctcacttttttttgcctgctgccatccatgtaagatgtgtttgctcctccttgccttcctccatgattgtgaggcctcccctgccatgtggaactgttaagtccattaaacctctttttcttcccagtctcaagtatgtctatgcacagtgtgaaaatggactaatacacctctccatctatcaggggtagagagtttttcttttacttttccttcacctgcaaagtatctttgcctgtgcctgtgtgttgccctttccccaggggcctcagaagtaggcactggtttgtgccttttctgcagcatgcctgggtcctgaggcccccattccaggcctgagctcccacataacatttctagacactttctgggctaaaagggaccccactgccttgaagggaagaacctgatcttggcaggatttaccgtcataagaatgtcattatttaatgatagagcagtcagttcagcaagaggatataacaattgtaaatatatatgcacccaacactggagcacccagatatataaagcaaatattattagagctaaagagagggagagatcgcaatacagtaatagctggagtcttcaacatcccattttcagtattggacaggtattccagacagaaaatcaacaaacatcagacttaatctgcaccatagaacaaatggacttgatagatatttccattctcaatgatagactatatgttaggttacagaacaagttttaaaacattcaaaaattgaaataatatcaaacatcttctctgaccacgatggaataaaactataaatcaacaagaagaggaattttggaaaccatatgaacatgtagaaatttaacagtatgctcctgaatgaccagtggatcagtgaaggaattaagaagaaaactgaaaaatttcttggaacaaatgatagtggaaacacaacataccataatctatgggatacagtgaaagcagtactaagaggggaatttataggcacttacataagtgcctttttcttcaaaaaagaagaaaaacttcaaataaattacctaatgattcatcttaaaaagctagcaaagcaagagcaaacctaacccaagattagtataaaaaataaataaaaaggaacagaatagaaataaatgaatttgaaatgaagaaagcaatacaaaagtcaaggaaacaaaaaatgttattcttttgaaaagataaacaaaatcaacaagtccttaggcagattaaagcacaaaaaaggaaaagacccaaataagtaaaatcagatggaaaaggaaacattacaactgggattgcagaatttcaaaggatcatcagtagctactatgaccaactacatgccaataaattggaaaatctaggggaaatggataaattcctagttagatacaagctaccagaattaaaccatgaagaaatacaaaatatgaatagaccaataacaataaacaagattgaagctgtaatatgaagtctcccagtaaagaaaataacaggacctgatggcttcactgcttaatcgtgccaagcatttaaagaactaacaccagtgttactcaaacaattccgaaaaatacaggaagagggaatcttttccaaactcatttacaagacccatattaccctgatacccaaaccaaagacacatctaaaaataaaaccacaggccagtatctctgatgttgattcaaaaatcaacaaaaataccagccagcggaattcaacaatatattaaaaagataattcatcatgaccaagtgggaattattccagggatgcaaggatgattcaacatatgcaagttaatcagtgtgatacattacatcaaaagaatgaacaacaaaaaccatatgttcatttcaattcatgctgagaaaaatttaatacaattcaacatccctttatgataaaaactctcaaaaaatttggtatggaaggaacatacctgaacacaataaacactatatttgtcatgccaccgtgtcatactgaatagggaaaacttaaaatcctttcctctaagatctgaaacatgaaaaggatgcccattgtcaccactattattcaatgtagtagtggaagtccaagcaatcagacaagagaaggaaataaatggcatataattggaaaggaaaaagtcaaattatccttgtttgcagatgatatgatcttatatttggaaaaacctaaagtatccaccaaaaaaatgatgagaactgataaattcagcaaggtttcaaggtacaacatcaacatacaaaaatcagtagcatttctgtatactaacagtgaataatctgaaaaagaaattagaaagtaatccaacttacaatagccatggataaaattagataggaagtaacaagcaaataaatgaaatatctctacaatgaaaactataaaacactgatgaaagaaattgaagaggacacagcaacatggaaagacattacatgtttatgggttctaagaatcaatattgttaaaatgtccatactaccctaagcaacctacaaattcagtgtgacccctatcaaaatacccatgagattcttcacagaaatagaaaatacaatcctaaaatttatgtagaatcacaaaagatccagaataggcaaagctatcctaagcaaagagaacaaaaccggaggaatcacattacctgacttcaaattatactacagaaatatagtaaccaaaacaacatggtactgacataaaaccaaacacatagaccaatggaacagaatagagaaccagaaacaaaaccacatacctacagtgaacacatttttgacataagtgccaagaacatacactgtggaaaaggcagtctcttcaataaatggtgctgggaaaactggatatctatatgaagaagaatcaaactggaatactatgtctcatcatgtgcaaaaatcaaatcaaaatgaaattcctaagagaaaactaaaagaaactctcaatgacattggtctaggcagaaatttcttgagtaataccctacaagcacaggcatccaaagaaaataatggacaaatggcatcacatcaagttaaaaagcttctgcatagaaaagggaataatcaacaaagtgaagagacaaacccatagaatgggagaaaatatttgcaaacgactcatctgataagattaataaccagaatatataagaaactctataggaaaaaagtctaatactccaattaaaaaaatggacaaaaaatttgaacagacttttctctaaagacatacaaatggcaaacaggtatatgagaaggtgttcaacatcattgatcatcaggcaaatatcagtcaaaactatgatgagctgtcatctcaccccagttaaaatggcttttatccaaaagacaggtaataatgctggcgaggatatggagaaaagggaacccttgtacgctgttggtgggattgtaaattagtacaaccactgtgaagaacagttcgcagttcctcaaaaatctaaaaatagatctaccatatgatccagcaatcttactgctgggtgtatatacccaaaagaaaggaaatcagtatatcaaagagatatctgcactcccatgtttgttgcagcactgttcacaatagccaggatttgaaagcaacctaagtgtctatcagcagatgaatggataaaggaaatgtagtacatatatgtaatggagaactgttcaaccgtaaaaatgaatgagattctgtcatttgcaacatggtggaactgaaggtcgttatgttaagtgaaataacccaggcatggaaagacaaatttcacatgttctcatttatctgtggaatctagaaatcaaaacaattgaactaatggagatagagagtagaaggatggttgccagagactgggaagggtagtgtgtgtgtgtgggtgagccagggatggttaatgggtacagaaaaaattagaatgaataagacctagtatttgttagcacaatagggtcactgtagtcataacttaattgtacatttaaaaataaccgaaagtaaaattcgattttttgtaacaggataaatgcttgaggggatggatgctctattttccatgattattacacatgcatgcctgtttcaaaatatctcatatactccatgaatatatacatctactatgtacccacaaaaattttaaaaagtaataattaaaaattatattttcatttagcaatatagataaatggttaaaactagaagtttgtaatattttggaagagatgaaagcatgcaaataacaagacaattcaaaaaggttgtcacaaacataatgaactgttcccaaagaatctcataatgaacttgagaaaattacatccctatctacaatctaaaaattggaagatggacatgtattcctattttaaatacaggctttattgttgttgaaatgcaaaactgtcctaaattgcactatcttttttgttaaagtgagtatatgtaactgttacactaaaaaatacactatatatatttaaaggaaaataaccattaatttttgtttttacaacagagacatcttgaccagaagcaatacaataacaaattagaaaagataaaaagcacttcattcaatatcagtatctatattatttctcaatttatgttgtcagcttatgttatttgtcaaattatattcttgatatacgcaaatgggttaaaatcagaaaagaataaattgtttatctaatcattcatatattcctcagatgatttttcaagactgaatgttcgaatcaataatttcttgcacgtataagattgttggcatgaaaatgaggttgaggtttaggtggagaaagttcaccatgagtattgtgagtcacctgaacattgtttatttacgtgtaatgaaaactacaaaattggcagtaaaataacagtagaggtcatttttaaaaaaatagggtgtgctgggaggtggggagaaagaaacttagggggtgagagtagccaagtttaccaaatagaaacagctccactctgtggctcccaccaagaaggatgaaaacagccagtgaattctgaatcttcagttgaggtaccaagcttttctcattgggactgactaggtggttggcgcaacccagggagagcaaagaagagcatcgagggcccacccaagagctgtgtgggcaaaggaagctttctcccccagccaaaggaggcggtgagggattgtgctacccctccctgaaaaccttgcttttgtcatggatccttgcaacctgcggatcaggagttccccttgcgagcccacgccaccagggccttgggtcccaagcacagaactgtaaagacatggcagctgcttgggtggctggccatttcagcaggcaccaagacacagtatttgcatactccagctctgggaactcccatgaggcaggatatctgtccactcctgtgggaagggggctgaagccagggggccaagtggcctcacttccacagaaccccacaagctaaaacacactggcttggaatccctgccagccaacgcagcaggtcagagactgcctaggaagacttaattccgagggcaggagggttggccaccatcactgcggctccagttggccattgtcccctgctgtaggtgccagtgagactgggtggtctggactaggagcaattccccacagcgcagcacagcagctgtgtcagttcatggctagactgcttccttaagtagaacactgatccattttttctcactgggtgaggcctctctgtgggaatttcagcatccctagacaggagtttatgaacagaactttgatatccctgagaggagccactaggaggggcagctacggtatcatggatcagtggtctttgtcttttctgcctgctggctctggagagtcaggggagcccagatgagggtgcagcacacccgctccaccaaggggcagccagactgcttatttaagcaggtgcctgatcccactcctgctgactaggtgagacctcccaacaggagtccacagataactcatatgggagaattccaactggcatcaggttggtgcccctctgggacacagcttccagaggaaggagctggcttccatctgtgctggtctgtagcctctgctggtgatacctccaggggtgggagggacccaggcaaatagggtctagagtggacctccagcaaactgcaacatccctgtagaagagggggcctgactgctaaaagaaaaacagaaaacaacaacaacatcaatgaaaaggaccccacaaaaacccatccaaaggtcagcaacctcaaagatcaaaggtagataaactcatgacgatgagaaagaatcaacacaaaaatcctgaaaactcaaaaagccagagtgcctcttctcctccaaatgattgcaacatgtctccagcaaaggcacagaactgggctgaggctgagatggatgaattgacagaagtaggcttcagaagatgggtaataatgaacttcactgagctaaagaattatgttctaactcattgcaaagaagctaagaaccatgataaaacattacaggagctgtttaccaacataactagtatagagaggaatataaattacctgatcaagctgagaaacacaacacgagaacttcacagtgcaataacaagcatcaatagccaaagagacgaagcagaagaaagggtatcagagcttgaagactatcttgctgaaataagacaggcagacaagaggagagaaaaaaagaatgaaaaggaatgaaaaaaacctctgagaactgtgtgattatgttaaaaaaccaaacctatgactgataggagtatctgaaagagacggagagaatggaaccaagttggaaaacacacttcaggatatcatccagaatttcctcaacctagcaagacaggccagtgttcaaattcaggaaacccagacaaccctagtaagatactacatgagaagatcaagcaaaagacacataatcatcagattctccagggctgaaataaaggaaaaaatgttaagggcagccagagagaaagtccaggtcacctataaagggaagcccatcagactaacagtggatctctgcagaaaccctacaagccagaagatagtgggggccaatattcgacactcttaaaagaatttccaacctagagtttcatatctggtcaaactcagcttcataagtgaaggagaaataaaatctttttcagacaagcaaatgctgagggaattcatcaccaccaggcctgccttgcaagcactcctgaaggaagcactaaatatggaagggaaaaaccattaccagccactacaaaaacacactgaagtacacagaccagtgacaatatgaggcaactacgcaaacaagtctacaaaataaccagctagcatcatagtgacaggatcaaattgatacataaaatattaaccttaaatgtaaatggactaaatgccccaattaaaagatgcagagtggcaagctggatagaggcaagattcattggtgtgctgtattcaagagacctatctcacatgcaaagacacacatagacttaatcccattactgggtatatacccaaaggaatataaatcattctgttacaaagacacatgcatgtgtatgttcattgcagcactatttacgatcacaaagacatggaatcaacccagatgcccatcaatgatagactggataaagaaaatgtggcacatatacaccatgaaatactatgcagccataaaaaggaatgggaccatgtcctttgtagcgacatggatggagttggaagccattatcctcagcaaactaatgcagtaacagaaaaccaaacactgcatgttctcacttataagtgggagctgaacaatcaaaacacatggacacaggaaagggaaccacacacactggcgcctgtcagggggtggagtatgtggttgggggaggtggagcattaggaaaaatagcgaacgtatgctgcgcttaatagctaggtgatgggttgataggtgcagtaaaccaccgtggcacatgtttacctatgtaacaaaccttcacaacttgcacctgtgccccagaacttaaaaaaaaaaaaaagaaaagaagaaagaaacttggaagaatggatcagagaccttgcaccatatgcctcatgtaatttgatcttcatcaagaagtcgttaatcaacatatgcttcattgagagccttactttatctcataaacatctttggtagcatcccatacgctgatcctcagtgattgacttctgacaccgcttaaagcagaaatctgttcgtgtgcatttattttatgtgaatcaaaattttgaaataattgtgacccagagaagtagatttcttctgtttcaatcctaatatgaggtatcagtccatttttcagaatggaaatgtgacagtgtcaatgctgtagcactttgtcagttatctgaggctgagaactactttttcattataaattatatttcacattattgtattgaaactaatatattatggaggtaagtgaaacattctcattaaatgttcacatagaacctgggattagaaagaatcctttagcttgctttatgccagaggtttgcagaagatatatcaagttgaaaaatttttctgtattacagcactgatattgaagaccattctcatcaagctatgaattatgtagtaatcagatccactgatgatatatatttattttataccatgaaatcttggttttctagaatttatatgctttcttttcccaattatcagaactgaataatctagtatattctctttaactttacattctaggaagttcagagttaaattccataaagtctttatttttaataattttgaattgtcatgtttcatatatttcaattttccaagccaaaaaggttctctttggaaatagatggtttatactttggacatgttctggcagcatacctttaattttcatttacttagatgaaatgtagatgaatcatatttttggaactacaggttttgccctttcatccttcacccccatacctaatatgaccttatacaaattatgtttgatgagaatcttcgatgagaattatagcaaaatatttgttttcctattatcttttgaatggcacaatactggatttgaactcaagactaaataatttttcgaaaaagaattagcagtgatttataaagttactatttttttttcagcaaagctagagaagatttgctgaaaattcagaaagaacgtgattttcatcgaatgcatcataagcgaatagtccaggaaaaaaacaaattaattaatgacctcaaagggtaagcttatacttgttggcatatttattaaagagttatttaatacatgttaagtaatttgattatgacaaagttttagacaaagttattaattccacggttattgagcataagatgagtaagttgcgacccttgctgtcaagggtctcagaaaatacttgtgtgtgtgaagtgggaggagttaagcagaaatatactgaaatacactgcattgttgctatgccacccaagagggccatcatcccaatacgactggagtgtgagagggctcaaggatttatttccacaggaattaaattctcaagtatgagtaagagtagacagtgaggaagtggggtccgcacagtgctctttgcagatagtacatcctctgcaaatgcaccaagacatgaaaaaacatgttacgttcatcaaattgtgtacatagagagtaaagtgcagctgtggtattgcagggataggggacatatctctaaatgactatgaatttgtaagtcttttagaaattattttgaaggcattattgagatttactttctctccttctttaccttcctcccctacaaaaacaagaaaataaatttacaatccttaaataaaattatattttgcttgctctaaggcagtgctatccaacagaactttttgtgatgatataaatactctgtatctgtactgtccaatacaatagcccctaaccatttatatttaaaaatataccatacttgttcaaattcctaatatgtttaaagaatacttttcacataaaattcatcattttagattacatgtttttttcgtatttcattatttcaggcaccctggtaaagaagcacacattactttgtaatacagctacacttggtgtatactcagatagcctttatttcttcatttaatcattaagaaaaacatctccatttaacaatctggatgaatcactaaagctcattttataaagacctaaaacaaaacttcaatgatgccatcaagtcacaaaactgggtatcaagttaatcagtcaaacacagtgaatactttgcccgatagctgcgcgattgcataataaatcagctataggacagagtgttttgatgccaggcaaagttggggtctgaaatctcttatgtcacattttacccaaatacattaatagtgtatccatatttcctttcattgtaaaccattaaatgtttaccttatttttctgtaaatttttcaactagtttgataataaattttacagtatttctttgtttgttgttttgttttgctttttagagtcagactctcattctgtcgcccattttagaatgcagtggtgagattaaggcatcctgtagccccaactcctgggttcaagcagtccttccgcctcagccttctgagtagctgggtctacaggtgcatgccaccatacccagctaaatttttttgttttaatttttttgtagtgatgggggtctcactttgttgatcaggttggttttgaactcctgggcaccagtgatcctctcagatcggcctcccaaagtgttggaattacaggcatgagtgaccaagcctggccagtatttcccatttaacacaagtatcttattatgaacgtgcttattttcagaattatctatagctaatattagaacttgcaaacagatgaattatgaagtacttatggactttataaaatagacacaccctttaaaatagattaaacagagtttttctagatgttgtttccttgttatattccagtgaaattctatgtgttgttaattcttttaacagaagatagtcaagccatatctcatgaatgagttaaattccaaagttagtaaaaaaagggaaattttgccatcaatattttctttaaaattcttcaaccatccacagattacagtatatatagttttgtgtatacaattctatatctgtgtgttgtatgtatttatgaatatgtaatgtttatggagattatagtatgcagcaaagtgtatatatattacatacatatgtatatatatatgacatatgtgtatatatatgttacatatatgtgtatatatatattacatatatgtatatatatattacatatatatgtattatatatatatataaacacacactaagctaatcagaaaggaggatagaactgtacatactacctaaatttttatttttgttactttttctgagtgtcatattaatacacattaaatgtatatataatgcaactgcactttaatacttaatttctattgctatcatcaatgaggtataatgtgatatccaaattaatgacgtttataaatactgctatgaaaatatagaaaataaaaagctctgttttaattattaatggaataaaatattattcttttggaggacttttggggaatttctgctttgggctatgtcattgtaaatagtatagaattagctctccaactggtactggactagctccccaaatgtaaggaactacatgactggacaaaatacatgaggcagttttttttttaagatggtggaaaattggcaaagcaggaccgtgatgcctaagagaagacaaacacaaaatgagcaggatgatcaacccacatatcttcctgaaggtacttttcagcccacagtttgaccagatataacccaagcagagcatggtggctttcagagctgaggaggcagagatcagagttcagggctgcagaggtagctggaacttgcagcatggtgtacacagaaggaaggaggtacatgaaatgtagcttaagaaatatctgtaatggttctcttcagtctttggccacgtaactaacttgtggaagtataggatgagagaacatgaagcctggcaggaaacagcacctgggaaactctgagcaaaatagagattccagaggttgcacagtgctgggagatgcaggagttctgaccagccataagggaagtaacctcactgaatactctgagcatttacttaatatcctccacaagccatgccacagaagcagacctagttggtcctagacaaagtgttgctttagaatttttctccaaaaagcttaaaggtaagctttgaaaaactcgagctgattcactgggaaattaactgtctgtcagaaaataactctttaaaggaagaaaacaaaattcagacaagtgtatgtccaacatacaataaataaataaagtttatacgtattgatttatctatagatatatctagaagcaggaagacatgtcctataatcaggaaaaagcagaaccagacacagagaaaagaaaattacagaattagcaggcagggactttacaacagttattatgaaatgcttagagttttaaagaaaatggtgactgtaaggagtgataaacagaattaaactgaaatttgagaactgaaaaaaacataatatgcaaatgaaaaatttactaataggtcttagaagattggacattgccaatggaaagatcaatgaacatgaagacaggaagatggaaaatgatccaactggtgcacaaagagaaaaaagctgaaaagaaatgagcagggactcaaagaaaaaagactgaaaaaacataaatagaacctctggagcaatattaaatagtccatcataggtgtgtatttgaaatccaagaagaggctgggcataaccttccctattctgctagcttattccaattgttaagtatacaaattcaaattatttactcaggaagactggagttgatcactgggtgcttacatgaaccaaatatgctgtgagcagactttagccaggactgtacttattttctgttcccctgtagactcccattctaacagaggggtcatgattctgctttaggtttctgaatttgaatgaccacttcttaaaatatctttccccagtacatagtcactcaattaaatagccaggggtaatttgcagaaaaattgaggctatttataacagtatataattgctatggtgttacggagtgcttcctctactgtctgccagggtagctccagcatttccacttcacagcgttggctatctttttccaagttttgaaggaccaccctagaagtgaatcaaccttattcactggagtttttttcttttttttttgtattttaagttttagggtacatgtgcacagcgtgcaggtttgttacatatgtatacatgtgccatgttggtgtgctgcacccattaactcatcagttaacattaggtatatctcctaatgctatccctctccacttcccacaccccacaacaggccccggtatgtgatgttccccttcctgtgtccatgtgttctcattgttcagttcccacctatgagtgagaacatgcggtgtttggttttttgtccttgcaatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacataacgtgtgcatgtgtatttatagcagcatgatttataatcctttgggtatatacccagtaatgggatcgctgggtcaaatggtatttctagttcaagatccctgaggaatcaccacactgacttccacaatggttgaactagtttacagtcccatcaacagtgtaaaagtgttcctatttctccacatcctctccagcacctgttgtttcctgactttttaatgattgccattctaactggtgtgagatggtatctcattgtggttttgatttgcatttctctgatggccagtgtgatgagcattttttcatgtgtctgttggctgcataaatgtcttcttttgagaagtgtctgttcatatccttcgcccacttgttgatggggttgtttgtttttttcttgtaaattggtttgagttctttgtagattctggatattagccctttgtcagatgagtagattgcaaaaattttctcccattctgtaggttgcctgttcactctgacggtagtttcttttgctgtgcagaagctcttcagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtgaggaagggatccagtttcagctttctacatatggctagccagttttcccagcaccacttattaaatagggaatcctttccccattgcttgtttttgtcaggtttgtcaaagatcagatagttgtagatgtgtggcattatttctgagggctctgttctgttccattggtctatatctctgttttggtaccagtaccgtgctgttttggttactgtagccttgtagtgtagtttgaagtcaggtagcgtgatgcttccagctttgttctttttgcttaggattgacttagcaatgcaggctcttttttggatccatatgaactttaaagtagttttttccagttctgtgaagaaagtcatgggtagcctgatagggatggcattgaatctataaattaccttgggcagtatggccattttcacgatattgattcttcctacccatgagcatggaatgttcttccatttgtttgtatcctcttttatttccttgagcagtggtttttagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagaccttgctgaagttgcctatcagcttaaggagattttgggctgagacagtggggttttctagatatacaatcatgtcatctgcaagcagggacaatttgacttcctcttttcctaattgaatacgctttatttccttctcctgcctgattgccctggccagaacttccaacaccgtgctgaataggagtgatgaggcaggacatccctgtcttgtgccagttttcaaagggaatgcttccagtttttgcccattcagtatgatattggctgtgggtttgtcatagatagctcttattattttgagatacgtcccatcaatacctcatttattgagagtttttagcatgaaggttgttcaattttgtcaaaggccttttctgctctaatgagataatcctatgttttttgtcattggctctgtttatatgctggattatgtttattgatttgcatatgttgaaccagccttgcatcccagggatgaagcccacttgatcatgatggataagctttttgatgtgctgctggattcggtttgccagtattttattgaggatttttgcatcgatgttcatcagggatattggtctaaaattctctttttttttttgttgtgtctctgccaggctttggtatcaggatgatgctggcctcataaaatgagttaggaaggtattccttctttttctattgattggaatagttttagaaggaatggtaccagctcctccttgtacctctggtagaattcggctgtgaatccttctggtcctggactttttttggttggtaagctattaattattgcctcaatttcagagcctgcaattggtctattcagagattcaacttcttcctggtttagtcttgggagggtgtatatgtcgaggaatttatccatttcttctagattttctagtttatttgcatagaggtgtttatagtattctctgatggtagtttgtatttctgtgggatcggtggtgatatcccctttatcattttttattgtgtctatttgattcttctctcttttcttctttattagtcttgctagtggtctctcaattttgttgatcttttcaaaaaatcagctcctggattcattgatattttgaagggttttttgtgtctctatttccttcagttctgctctgatcttagttatttcttgccttctgccagcttttgaatgtgtttgctcttgcttctcttgttcttttaattgtgatgttagggtgtcaattttagatctttcctgctttctcttgtgggcatttagtgctataaattttcctctacacactgctttaaatgtgtcccagagattctggtatgttgtatctttgttctcattggtttcaaagaacatctttatttctgccttcatttcgttatgtacccagtagtcattcaggagcaggttgttcagtttccatgtagttgagcggttttcagtgagtttcttaatcctgagttctagtttgactgcactgtggtctgagagatagtttgttataatttctgttcttttacatttgatgaggagtgctttacttccaactgtgtggtcagttttggaataagtacggtgtggtgctgaaaagattgtatattctgttgatttggggtggagagttctgtagatgtctattaggtctgcttggtgtggagctgagttcaattcctggatatccttgttaactttctgtctcgttgatctgtctaatgttgacagtggggtgttaaaatctcccattatgattgtgtgggagtctaagtctttttgtaggtctctaaggacttgctttaagaatctgggtgctcctgtattaggtgcacatatatttaggatagttagctcttgtcaaattgatccctttaccattatgtaatggccttctttgtctcttctgatctttgttggtttaaagtctgttttatcagagactaggattgcaacccctgcttttttttgttttgcttggtagatcttcctccatcccttgattttgagcctatgtgtgtctctgcatgtgagatgggtttcctgaatgcaacacaatgatgggtcttgactccttatccagtttgccagtctgtgtcttttaacgggagcatttagcccatttacatttaaggttaatattcttatgtgtgaatttgatcctgtcattgtgatgttagctggttattttgctcattagttgatgcagtttcttcctagcctcgatggtctttacaagttggcatgtttttgcagtggctgttaccggttgttcctttccatgtttagtgcttccttcaggagctcttttagggcaggcctggtggtgacaaaatctctcagcatttgcttgtctgtaaaggattttatttctccttcacttatgaaggttagtttggctggatatgaaattctgggttgaaaattcttttctttcagaatgttgaatattggcccccactctcttctggctggtagagtttctgccaggagatcagctgttagtctgatgggcttccctttgtgactaacccgacctttctctctggctgcccttaacattttttccttcatttcaactttggtgaatctgacaattatgtgtcctggagttgctcttcttgaggagtatctttgtggcattctctgtatttccttctactttgctctttccagtgcacatggaattgtcactaaaatagatcgtatactgagccataaaacaagtctctatacatttcaaaggatggatgtcatacatagaatattttctgaccacaaccaaattaaattagaaatcaatttttaaaaatctcaggggatttctcaaatatttggaaattaagtagtatactttaaataatccatgaggcaaagaagaaaattacagaatattttgcgctgaatgattaaaaatgcagcatattgaaatgcagccaatgcggcttaaattgaaattgatggctttaaatgcttattttagaaaataaagttttaaaaccaatgatgtcatcttagaagcttaaaaagagcaaattacaaccaagaaacatgaagaaatgaaaaataagagctgaaatcaataaaatagcaaatggacaaacaaaaaatcaacaaagtcagatgttggttaatggaaaatgtaataaaactgacaaatttgataataagatggataaactcttaatagactgatatcaccagaggctggcaataatgtagggtacccaggactgtcatatagggttgttggaagtataaattataacccagcaattaaactcctgggtgtttatctaaaataaatgaagatatatgaccaaaaatattacatgacttatataaaaatgtttaaagaggccttattcatgatagcccaaactaaaatccactcaagttttcatcagcaaaatattggataaccacattgtggaatatacatacatacaagggaatactactcacagtaaaaaggagtgaagtattgctatgtaaagtaatgtggaataatctaaagaaacattacactgagtgaaataaactagttaaaaaagagaacatgttatatgataccaaataaatgaagttctagaattttctggggtgttagacatgcttcatattttgataatgtatactacttgggtgtgcatttctcaaaactctgaactgtaacgcttaagagctgtatgttttatccatgtaaattacacttcaataaaaagattttgaggtcattttcaaataaaacagattttttaaaggtatattatatactaggctgaattattccttctgtttagatatcaaaatgtttttatacttaatttttaaaatacaagattagccaaacttgttttaaagactatcctttagtttattttgatgtgaatgacactccatgtttaatcatctattgtttgtggcccttgtctttctgatagttatttccaaattgacaaaaggaattgcattttaaaaaatttcatgggtagcagcaatcttctgagtacatacttggacacagcaaaaggtgctagtaggaaatagagaactagttaagacgtgatttgctccctcactgcaccctccaccctcaagttgcagtgaagttgtatgctttttgtgcttcttggctgtagtgtgttaacctttatatgattattcatttttatttcacagcaaaaaagaaaaagaaaaaaaggttttgatgttagatggaaattactgatttaactcaataaccccttaagatgctattgactttattttttataggttgaagttacattatgcatcttatgaaccgactataagggtgttacatgagaaacaccacactttactgaaggagaaaatgctgacctccttggaaagagacaaagtagttgggcaggtaaagatatagtcaaagctaacttaaaatgatcttttaatcatttttttaataatacaagtagaaatactgattttgtttctgagattaattttaaaacattttcaaccaactttcatgtaaaagagatccatttggaaacattcagaaaaagtatttctccatttaactacctataaagattattataaaattaggccaggggcagtggctcatgcctgtaatcccagcactttgggagaccaaggtaggtggatcatttgcggccaggagtttgagaccagcctggccaatatggtgaaaacctgtctctactaaaaatacaaaaaaaaaaaaacaaaaaacaaatagccgggtgtggtggcacaggcctgtaatccctgctacgtgggaggctgaggcatgagaatcatttgaacccgggagtggaggttgcagtgagccgagatggccccataccactgcactctagcctaggcaacagagtgagacagtgtctcaaaaaaattaaattaaatatcatttaattgagacataaatttatagcagattattaaattatagttagaagaaaaaacttagccattgtggtcaaacttgggtttaaatgccagctttgacagctataaacattaaccttaggagagtcatttaaacaaattggagctcagatttctcatatataaaatgtagctgcaaagaccaaagacataccatttaagattgctgtgaaacttatatgagatattttaataaataaaaactccctcataggtactgactcaagtttttggttatttttgctaatgcttgacatccttttagggtttttgtgtaggcttaggcctagggtagtgggtgagatacctttggcataaaaatttaagaaaaagaaacaaaatgtttatatgccactttaaaaccatttatcagtttttttagaatatataaaactgcaactatgcttaacattctattattgttttctggagattttcatttttggccaaactttgagaagctacaaaagcttacatgatgataatactcttttgaataattttatttgtcaagacatgctttaatcaagtttattttgtcttttgagtgaaattcttagcttcgaaaatgcaaaacatcattgtcttgatgccccttgtgcttgaatttaattttgtgttttgaatgtttgaattttaagtaatattggatacaatgataatatgatttggctgtgtccccatccaaatctcaccttgaattgtaatcatccccacgtgtcaagggcgggaccaggtggaggtaactgaatcatgggggtggtttctcccatgctattctcatgataattgagtgagtctcaagagatctggtggttgtataagcgtctggcatttcttttgcttgcactcactctctttcctgccaccctctgaagaggtttctaccatggttgtaaatttcatgaggactccccagccatgtggaacttgagccaattaaacctctagtctttttttttttttaatatatttttaccctaaaacctctattctttataaaatacccagtctcgggtatttcctcatagtggtgtgagaatgaactaatacaaatgagtttaacaataatttaaattttatggcattataatcaaaccttcagaatttcatacccttgcttcttttcatctaatctgtcttccccagtctcctaacaaaaggctttctttattctatatcctgaggtattaggagctagattcagatctcttcctatttcctattccagatgggccaagcttaagcttttgctacccatcttactctctttagtcctcctggtctcatgcttatctcccatataccatgtacaatatttgtgtttcaagttgctccttgatggtttagtggaaagagctaagaactgggaatggctggtatgaattccagttgtgttgtaaaacacccaagtgaggattcaggttatttaaatatttctttttactcacttattaaatagggataaattatttgccttatgattgatatgtgtacaagattaaaacatgtttaaaaagttaaaatcatttgatctatgagttagagttgaattttgcacactactgttcagatgtgcaaagaaatatatctttattatctgcaactggttttgtctttgaactcctactcctgctgaagacaaaagaaaagataacctgcatattaaagactatcccaatctttgtgagttaaaccagtctctttgggtttaacacagggtgtttgaatattatattaactgaatgtttagctaaaacatagttattagtgctcattttcttccttcaaatggcatgccctttttattcttccccagatggttcctagtaaaaaagttacttgtctatccgtatagcttaaagtctacaggctatattcactctccagtgtactgtgacttgtttgattaggttggtgtccaggtacatgaaacctggatagttctggatagctcctggatagttcctgggtagttcttttgtatgtgaacccaacacaccttgctaaatccatggcctctgccacaatatctgtgaactcctttatatctgtggcctcattatcctaaccctagctttttttctgctccagtacatcaaatattaacatttccatgtaccccactgaggtggttgaggcttctgatttctctatattggaaatacaagccatgagcaatttgaaaaccagttagggtccatctacacagatatacctttttcagtccattttcaacatgacctggagagtagtgtgtttttctagcacaatgtaaaatatgaaggactctttaaggggttgtcaattttcctaggctattgcctgaaaagctaacagcaagtatacttatattcctggagtatccctagagtatctggctttatttgcccttcatttccaactggccccacttgcatttttcacttggtagataaagtaggactcatgtctgacctgttgttacctcgtccctcaggcatctcgtccctcaggcacagaactcttttcacttctttgttctattggatggaatatcttcctatcttctttcatgttacaggatgctctatgtcctcatttgttacagcaatcctgatttacacctatttgcacaggggaatttttaataaattccactttcaccctaaaaatatcccaatttagaaaatctttattaatgggaaaattctatttttttatactttaagttctagggtacatgtgcacaacgtacaggtttgttacataggtttacaagtgccatgttggtttgctacacccatcgtcatttacattaggtatttctcttaatgctatccctgtcccagccccacaccccatgataggccctggtgtgtgacgctccctgccctgtgtccatgtgttctcattgttcgtttcccacctatgagtgagaacatgcggtgtttggttttctgtacctgtgatagtttgctgagaatgatggtttccagcttcatccatgttcatgtcaaaggacatgaactcatccttttttatggcagcatagtattccatgatgtatatgtgccacactttcttaatccagtctatcattgatggacatttgggttggttccaagtccttgctattgtgaacggtgccgcaataaacatacatgtgcatgtatctttatcgtagcatcatttataataatttgggtatataccccgtaatgggattgctgggtcaaatggtatttctggttctagatccttgaggaatcaccacactgtcttccacagtggttgaactaatttacactcccaccaacagtgtaaaatcattcctatttctccacatcctctccagcatctgttgtttcctgactttttaatgatcgccattgcaactggtatgagatggtatctcattgtggtttttatttgcatttctctgatgaccaatgatgatgagcattttttcacgtttctgttggctgcataaatgtcttcttttgagaagtatctgttcatatactttgtttttttcttgtaaatttgttgaagttatttgtagattctgaatattagctctttgtcagatgggtagatggcaaaaattttctcccattgtgtaggttacctgttcactctgatggtagtttcttttgctgtgcagaagctctttagtttagttagatcccatttgtcaatttttgcttttgttgccattgcttttggtgttttagtcacaaagtctttgcccatgcctatgtcctaaatggtattgcctaggttctgttctagggtttttatggttttaggccttacatttaagtatttaatccatcgtgaattaatttttgtataaggtgtaaagaagggatccagtttcagttttctgcatatggctagccagttttcccagcaccatttatcaaatagggaatcctttccccatttcttgtttttgtcaggtttgtcaaagatcagatggttgtagatgtgtggtgttatttctgaggcctctgttctgttccactggtctatatatctgttttggtactggtaccatgctattttggttattgtagccttgtagtatagtttgaagtcaggtagcctgatgcttccagctttgttctttttgcttaggattgtcttggctatgcaggctcttttttggttccatatgaactttaaagtagttttctctaactctgtgaagaaagtcattggtagcttgatggggaaggcattgaatctataaattaccttgggcagtatggccattttcaagatattgattgttcctatccgtgagcatggaatgttcttccatttgtttgtgtcctcttttatttcattgagcagtggtttttagttctccttgaagacgtcctttacatcccttgtaagttggattcctaggtattttattctctttgaagcaattgtgaatgggatttcactcatgatttggccctctgtttgtctgttattggtgtataggaatgcttgtgattgttgcacattgattttgtatcctgagattttgctgaagttgcttatcagcttaaggagattttgggctgagatgatggggttttctaaacatacaatcatgtcatctgcacgcagggacaatttgactccctctttttctaatcgaatcccctttatttctttctcttgcctgattgccctggccagaactgccaacttccaactatgttgaattggagtggtgagagagggcatcgttgtcttgtgccagttttcaaagggaatgcttccagtttttgcccattcagtatgatattggctgtgggtttgtcataaatagctcttattattttgaggtattttcgatcaatacctagtttattgagagattttagcatgaagtgatgttgaattttgtcaaaggccttttctggtggataagctttttgatgtgctgctggattcggtttgccagtattttaatgaggattttcatcgatgttcatcagggatattggtctaaaattctctttttttgttgtgtctctgccaggctttggtatcaggatgatgctggcctcataaaatgagttagggaggattccctctttctctattgattggaatagtttcagaaggaatggtaccagctcctctttgtacctctggcagaatttggctgtgaatctgtctgatcttggactttatttggttggtaggttattaattattgccgcaatttcagagcctgtgattggtcaattcagagattcaacttcttcctagtttattcttgtgagagagtgtgtgtccaggaatttatccatttattctaaattttctagtttatttgcatagaggtgtttatagtattctctgatggtagtttgtatttctatgggatcggtggggatatcccctttatcatttttttattgcatctatttgattcttctctcctttcttctttattagtcttgttagtggtctgtcaatattgttgatctttcaaaaagccagctcctggctactttgattttttgaagggtgtttttgtgtccctgtctccttcagttctgttctgatcttagttatttcttgccttctgctagcttttgaatgtgtttgttcttgcttctctagttctttttattgtgatgttagggtgttgattttagatctttcctgctttctcttgcgggtatttagtgctctaaattttcctctacacactgctttaaatgtgtcccagagattctggtatgttgtgtctttgttctcattgatttcaaagaacgtctttatttctgccttaatttcgttatgtacccagtagtcattcaggagcaggttcttcagtttccatgtagttgtgtggttttgagtgagtttcttaatcctgagttccaatttgattgcactgtggtctgtggtctgagagacagtttgttgtgatttgtattcttttacatttgctgaggagtgctttacttccaattatatggtcaattttagaataagcgcgatatggtgccaagcagaatgtatattcttttgatttggggtagagagttctgtagatgtctgttaggtctgcttggtgaagagctgagttgaagtcctggatatccttgttaaccttctgtctcgttgatctgtctaatattgacagtagggtgttaaagtctcccattattattgtgtgggagtctaagtctctttataggtctctaaggacttcctttatgaatatgggttctcttgctttgggtgcatatatatttaggatagttggctcttcttgttgaattgatccctttaccattatgtaatggccttctttgtctcttttgatatttgttggttttaaagtcgttttatcagagactaggattgcaacccctgcttttttttgctttccatttgcttggtagctcttccttcatccctttattttgagcctatgtgtgtctctgcacatgagatgggtctcctgaatacagcacactgatgggtcttgactgttaatccagtttgccagtctgtgtcttttaattggggcatttagcccatttacatttaaggttaatattgttatgtgtgaattcaatcctgtcattatgatgttcgctggttattttgcccattaattgatgcagtttcttcatagcattgatggtctttacaatttggcatgtttttgcagtggctggtactggttgttcctttccatgtttagtgcttccttcaggagctcttgtaaggcaggcctggtagtaacaaaaccccttagcatttgcttgtctgtgaaggattttatttctccttcacttatgaaacttagtttggctagatatgaaattctgggttgaaaattctttcctttaagagtgtcgaatattggcccccactctcttctggcttgtagggtttctgccgagagatctgctgttagtctgatgagcttccccttttatgtaacctgccctctctctctggcggcccttaacattttttccttcatttcaaccttggtgaatctgacgattatgtgtcttagggttactcttcttggggagtacctttatggtgttctctgtatttcctgaatttgaatgttggcctgccttgctaggttggggaagttctcctggataatatcctgaagagtgttttctaacttggttccattctccccatcactttcaggtacaccaatcaaatgtagatttggtcttttcacatagtgccatatttcttggaggctttgttcatttctttttactctttttctctaatcttgtcttctcactttatttcattaagtcgatcttcaatcactgatatcctttcttccacttgattgaattggttactgaagcttgtgcatgcatcacaacgttttcgtgctgtggttttcagctccatcaggtcatttaaggtcttctctgtactgtttattatagttagccattcatctaaccttttttcaaggtttttagcttccttgcgatgggttagaccacgctcctttagcttggagaagtttgttattaccgaccttctgaagcctacttttgtcaactcatcaaagtcattctccatccagttttgttccattgctggtgaggagttgtgatcctttggaggagaagaggcactctggtttttagaattttccacttttctgctcttgtttctctccatctttgtggttttatctacctttggtgtttgatgttagtgaccttcagatggggttttgatgtgggtgtcctttttttgaagtttatgctatttctgtttgttagttttccttctaacagtcaggccccttagctgcaggtctgttggggtttgctggaggtccactccagaccctgtttgcctcgctatcaccagcagaggctgtagaacagcaaatattgcagagcagcaaatattgctgcctgatccttcttctagaagctttgtcccagaggggcacctgcctatatgaggtatcagtcggcccctactgggaggtgtctcccagtcaggctgcatggggatcagggacccacttgaggaggcagtccatccattctcagagctcgaatgccatgctgggagaaccactgctttcttcagagctgtcagacatggggtttaagtctgcagaagtttctgctgccttttgttcagctatgccctgcccacagagatggagtctatagaggcagtaggccttgctgagctgcggtgggctcctccagtttgagcttcccagctgctttgtttacctactgaagcctcagcaatggcagacgcccctcctcccaccaggctgcagcctcgcaggtcaatctcagactacagtgctagcagtgagcaaggctctgtgggcgtcggacctgctgagccaggcacgggagaaaatctcctggtctgccagttgctaagaccatgggaaaagtgcagtatttggacagaagtgcctcgtttttccaggtacagtctgttatggcttcccttggctaggaaaggcaaatcccccaaccccttgcactcctgggtgaggcaacgccctgccctgcttcagcttgccctccgtgggctgcacccactgtccaaccactcccaatgggatgaaccagcacctcagttggaaatgcagaaatctgtcttctgtgttgatcacactgggagctgcagacgggagctgttcctattcagccatcttggaaacgaccttaatttgaaaattctaaagagctaatttcttgatatctaatatggaacagttagtcccactcttaagataacattgaaaaaaataaataaaatggagaagttaggatttataaatagcttttctctctcaaccaaatctgctgttgaaggtggtagattcactacaatttgagaaagtcaaatttaaataggaggtgctattgctgccactgagctgtcaccacaggttttaccatggacaatgctaatactgaatacttgatactctttcagaattttgttatacttgtcaatggaaactggatgtggcagccaccattctcaggataaattccaaattctacattgttccttatatcactaaattttgttcagaatccaaaatgggtacacaggattgatggagccaatgcaagtcctagttataggacaagctgtgtaaatatctgatatctattgcaaaaggtggaagacacatgattctctaaacccaaactgctaagtggccaaagcgactgtcaaatatccattatacaagtctaaaccaaggctcaattaacctactctccaaattagggcacagaatatagtcctagtcctgtcagctctccaggtgtgtccttgtggaacaagtcaaggttaccacttaaagaatggaaactgtttgtgtacccttcttacaaagaatgatttattgccaaccaatcctttctttctgttgtagcatactaatcaggtatatcctgggtgtacaggcatagattagcctttgaaattgaacatattagtagtgtgtcatggagctatagaatgaatttattcaaagtatgtgtacagagaaaatatcttaaaatatgtgaaatgtttctctataatgtaaaatagaagataggttacttttgtgcttatattttgaatatttctttatttcaacgtttgatgcagttacgctttgagaattcatttccaaccaaactttaggatgtgagttaagagcagtaagacatcttatgttttctagctggattcctgattgttacttccttaaaaactttatcttaatgagcatttagcttactgtgtttctccttaaacctataccttgcataaagaaggattgtataataatttaaaatttttgattattatctagtttgcatatgaaagagtgaaaacacactgtgggatgacaaaaatccgataggaaatacatgttttcaaatttctttagtagatactagacagtgaatcaacatttatttaaaatgtaatgaaaaacctataactttgtttttggttttaagaaattattgaaaatagtgttcagaattttgaattagagctccatgacccaagaaaaggtgaaatagaattgatttgtaggtatctatgtatactaaattatattttatcttttttagatcatgggattctaactcagaatatgtatgtatgtgtgtgtgtgtgtatatatatatatatgtatactaaaaactaaatctaaatatatatatatattttaggtctgtctgcttggagagtctagaagtagtgacactccaccagtaatgaacatatccagtgttaggatcttgatttctaatatcactctgtaataaaaggaaaggaaacagggttctttggagaagtgtctgattctagagctgggcagataaaatactagataggcctggagcacttgggacattttcttgtgctagaaaggaaggaaatgctcaaaaagtagaacagaaaagaaaaaaaaactcaacataataatgggatatgtcaagttatgacaaaggaactgtagtgggcacctgcagaggttggtggatccccaactaaatttgatttggatattcagactgataatgccacacacacacacacacacacacacacacacacacacacagaggctgtgaataaattcactacttgtggaactgaatttgctgaggagagctgcacattacctcccaagcatttctgaaatggcttgagagagcaagtaagggagactggcttggggtttttattgcggttgggggttagggccagggtgagaattctcatatgtgaggtgaggcttgagtcatttgaatctcccatcagtaccagacaagggagtacccaggcattcttgtccagttgcccagatgttgggcacaagggaagaaggaggaggtaaaacttaaaggctgttgacactcaaacatcaaacaataaagtcaggttcctcattataggaatccaacctgaaagagcttccagtgatcaaaccttctgaaacaatttgagcaacaaaataatgtagtgtttgattataacccaaaatataaaataaatatctttgattccttaatggtataaatataaatgattagtaaggacatgtgagagagtagacaaatctcccatacagaagaatctcgagtaatatatgttgataatccttccctcaagtaggtggagcttaacaactcagctgttgagtgttggctgcactttgtaaataatgacttgcatccagaaatgcaagggaaatagggaagaaagtaactttacagtggggaaacctgtcaaccttctcatcatgtaaccaaaggatcaaggtgaacatcatcagttttaagtactgttggtagcatgaacctatgatgtaatatgctaataatggcactcccctgtgatcttcttgcaaatccataactttagtctaaccatggggaaaatatcagacaacctcaaatctagggctattctgtaaaatactgtcagactaatgctccccaaaattgtcaaggacattaaaatcagggaaaatctgtgtattagtccatcttgtgttgctataaaggaatacccgagactgggtaatttataaggaaaagaggtttatttggcgcatggttctgcaggctgtagaagaagtatagcaccagcatctgcagagagatctgcctccatgacccaaacacttccccctaggccccacctccaacactggggatcacttttcaacaagagatttggagaggacaaatatccaaactatatcagtctgagaaactgtctcagtccagaggaggcttaggagacctaaaaactagttgtaaggtgatattctggatgcgattttgaaacataaaaaggatattatggaaaaattaataaaactaaaaatatggcctgtagttcataataatatatcaatattggttcattatttgtgaaaaatgtatcattacaatgtatgatgttaatgggggaaaaagggtatgggataaaacaggaattctcagtactacattagcaactctcctgttaatcttatgctattctaaataaaaagtttatttttgaaatttataattcttttggcttctaggaatagatagtaatcttttacttttttttaacctaggcatttcatgagcactcatctataggttataattaataaattatgttattttctattaataaagaaatattactattcagtgatagtagaaaaaagtgtgtatctgtatgtaattgaacagatggtattttgtgttggtataatcatatacaatgcaagatgaaatagcttttcaaggtcaaattttaaattaagtatttttcaggaatacaggtaaatcatgacaccaaagctaacaaaagttcttagttataagacatgtttaataaaatagagaatatatgtgggtggaaaatgagctaagagttgggggaataaaaacaacctcttcatattttacattccaagtgataattaccttgtattttataaatataaagatgatagttattgtgaaacaatttgaacagaggaaaaacctctctcaaaatagagaattgaataattattaaagtgtacaatgagtattcttaattcaggaaactatgccgtgaaataaatgtttcagatgcttacctaaaataagtaattaataattagctggtggaattatattttaacttaaaattctgtttttcttttgttaaaatttatgttttattaaaaaaggtataaatttaaaagagattaatattttttatattttacaatggatatttaaatattgtgttttatgtaacctttttaaaagtcatttagtgtataatttcatttctttgaattttactttttagatttctggacttcaagaaacattgaagaaactgcaaagaggacatagttaccatggtcctcaaattaaaggtaaatgtaaaatgtgatgaagctctcatttaatatagtttggtgatttctcaaccttatcagtgattaatattctagagatatttaaaggtgagtaagtggtggctatttcacaaattaaaattttaataaaaagattaagaagaaatatagatatcatactgtatggattaattatagagaaaaacaagtcaactataatggaaggacttctgcttctggtcattatacctggtaccagactagccttctctgtgtaaataactctaaagctaagctgtaagatcagacaactacttttaggcagtagaaaacagacagctcaagtaacagaaggcaattgacagaaggaaaatttataaggtgagctctgccatcaccatggctttgggtctgtggaaagttccaaactgagctttgtggagatggaagccaataagagcatgacaatcctgataattggaaatgtcagagaccctagttcacagcttttgaagccactggaatctgtagggaaagacaccagagaagagagctgcaatgaggagtggctcagtttgtgagggagtttactatgagtccttagctgaggctgcaatactatacataacaacactacctgacacttacaagagagatacaattatataggatcaagaggaggccagagattgtagaagttaagtagtgatgcgaaacattgcaaatctggccatgcctgggtggaaagacctctttcacaccttgttaacaacacagtaacattcagcatcccatatccgccttataaaaccaggaacaaagcttacacagcattcttagagaggacacagaatttggagtttgagtcttgccaagttatagggccttgagaaacatttagggctttccatggatccaccctaacgaagcataaaattaagcctaggattttagggtcatcagccaaaaatggaactgccttctagaacaaaaaatgacatccttttgaggaagacagtcatccagagtctttacaatcttttacccacattgcctagtacataattaaacatttctagatatgaataggaacaggaaaatgtgacccataatcaagacaacaagcaataaatggaaacctacccttaagtagctaaactgttgcatttagcagatagaaagtgctaaagtagatactttgattatgttcaaggacttaatggaaaatactaataagtgaacagatggggaatttaagcaaagaaatgagaacaagcatacattccaaagcaaattgaagttctacagctgaaaagtagaataactaaaatgaattttttttttttttgagacagagtcttgctgtgtcacccaggctggagtgcagtggcatgatctcagctcactgcagcctccacctcccaggttcaagtgattctggtgcctcagcctctccagtagctgggactacaggcatgtgccaccatgactggctaatttttgtatttttagtagagctggggcttcaccatgttggccaggctggtcttgaactcctgtcttgaagtgatccgcctgcctcagcctcccaacatgctgggattacaggcatgagccactgcgcccaatcaaaaattttatttaatgtacttcataacaaattagagatgacagaagtgtcagtaaatttcaagagagatccataaaggcatctagtctaaagaagaaagataggccgggcacggtggctcacgcctgtaatcccagcactttgggaggctgaggcgggcggatcacgaggtcaggagatcgagaccatcccggctaaaacggtgaaaccccgtctctactaaaaatacaaaaaattagctgggcgtagtggcgggcgcctgtagtcccagctacttgggaggctgaggcaggagaatggtgtgaacccgggaggcggagcttgcagtgagccgagatcccgccactgcactccagcctgggcgacagagcgagactccgtctcaaaaaaaaaaaaaaaaaagaagaaagataaaagattaaaggaaaacttgcctatttaacatatataaaattaaagtcccaaagaagagaatgaaaatggagcataaaaatacttaaacaaatgatggccccaaatttccccaaattcatgtaaagtataaacttaaacacctaagaaaagaactaatcatacacataaagagaaccactcctgaacacaatgtgttgaaattgttgaaaattgaagtgagaaaatcttttttttttaatttataaagaaaaagaaaaagaggtataatggactcacagttccacatagctggggaggcctcacaataatggtggaaggcaaaggaggagcaaaggcacctcttagatggcagcaggcaagagagagtttgcagaggaactgccctttataaaaccatcagatcttgtgagatttattcactatcatgagaacagcatgggaaaacccgcctccatgattcaaatacctcccacctggtccctcccttgacacatggggattatgggagctacaattcaagatgagatttgggtggggacacagcccaaaccatatcaccaagtgtccattgatagatgaatggataagcaaaatgtggtttttacatgcaatagaatcttttttttttaattatactttaagttctaggatacaggtgcacaacatacaggtttgttacatacgtatacatgtgccatattggtgtgctgcacccattaactcatcatttacattagatatatctcctaatggtatccctccccattccccctaccccatgacaggccccggtgtgtgatgttccccttcctgtgtccaagtgttctcattgttcaattcccacctgtgagtgagaacatgcagtgtttggttgtctgtccttgagatagttggctgagaacgatggtttccagtttcatccatgtccctacaaaggacatgaactcatccttttttatggttgcatagtattccatggtgtatatgtcccacattttcttaatccagtctatcattgatggacatttgggttggttccaagtctttgctattgtgaatagtgccgcaataaacataatgtgtgcatgtgtctttacagcagcatgatttataatcctttgggtatatacccagtaatgggatcgctgggtcaaatggtatttctagttcaagatctttgaggaattgccacactgtctttcataatggctgaactagtttacagtcccaccagcagtgtaaaagtgttcctatttctccacatcctctccagcacctgttgtttcctgactttttaatgatcgccattctaactggtgtgagatggtatctcattgtggtttgatttgcatttctctgatggccagtgtgatgagcattttttcatgtgtctgttggctgcataaatgtcttcttttgagaagtgtctgttcatatccttcacccacttgttgatggggttgtttgtttttttcttgtaaattggtttgagttctttgtagattctggatattagccctttgtcagatgagtagattgcaaaaattttctcccattctgtaggttgcctgttcactctgacggtagtttcttttgctgtgcagaagctcttcagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtgaggaagggatccagtttcagctttctacatatggctagccagttttcccagcaccacttattaaatagggaatcctttccccattgcttgtttttgtcaggtttgtcaaagatcagatagttgtagatgtgtggcattatttctgagggctctgttctgttccattggtctatatctctgttttggtaccagtaccatgctgttttggttactgtagccttgtagtatagtttgaagtcaggtagtgtgatgcctccagctttgttctttttgcttaggattgtcttggctatgtaggctcttttttggatccatatgaactttaaagtagttttttccagttctgtgaagaatgtcattggtagcttgatggcgatggcattgaatctatacacttcatgctaaaaactctcaaaaattcgttattgatgggacttatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaattagtcaggaaaaagaaataaagggtattcagttaggaaaagaagaagtcaaattgtccctgtttgcagatgacatgattgtatatttagaaaaccccatcatctcagcccaaaatctccttaagctgataagcaacttcagcaaagtctcaggatacaaaatcaatgtgcaaaaatcacaagtattcttatacaccaataacacaaacagagagccaaatcatgagtcaaatcccattcacagttgcttcaaagagaataaaatacctaagaatccaacttacaaaggatgtgaaggacgtcttcaaggagaactacaaaccactgctcaatgaagtaaaagaggacacaaacaaatggaagaacattccatgctcatggataggaagaatcaatatcatgataatggccatactgcgcgagaaaatcttgaaagcaataatacaaatacaggctgatttctcataggaaatactggaggctagaaacaataaaatggtatttttaaagtgtggaaacaattttaattcagaattgtgtatccaataaaaatatcctttaaaatttagataaaatgtagacattttaagatgcaggcaagctcggagattttttgcaagcctatctgtacagcaggaaatactaaagaagtttctttggtcaaaaaagtatatttgccagaaggaaattaatatctaccacaattgaatacagagaattaaaaatgttaaattctggttaaaatgagaaatatgttttccttttctaatttcctcagaagaaaagtgactgattaaaataaaattatggtgtcataaggtaatgtttataaggtatgtaaaataaaggaaaataaattgaggtgtggtggaaatgttttatatcttaattttggtggtagttacatgcctgtttatatttgtcaaaacacacctatctgtacaattacagtgcataatttacctacaataaaatgcataaatttaagtatacctgtgtttacttttaggcaaagaggatttttttttttggctcagatagctagaaggcacagacagtattctcagacatgactagatccagaaggatgatgtccttaggacctggtcactgcctctgtcttgtgagctgaattcattttttaaaaaggataaactttattttttagagcagttttaggtttatagcaaaattgagtggaaggtacagtgattttccatataccacctgcccccacccatataccacctgcccccagacatagcttcccctattatcagcatcccctaccagattgatacagttgtaaaaactgatgagtgtccatgacattaatatcaccgaagtccatagtttacattagggttcacttttgatgttgtacgttctgtggaattcaacacatttatgacgtgtatccaacattatagtgtcatacagagtagtatcactgccctaaaaaccttttgtgctttgcgtattcatcccttcctccttcctacttttctaatattttatgttaaagtagtatcagttatgcacagtgattcctaagggactatgcacaaggatgtttattgcagtcataaaagtaacacaacaatacaagcaatctcactttttaaccaccagtgaatgtttatagtggatcctacaataataaaaagtctaaaactcatgcataagaaatacttatgttttaatgttaagaagtaaaaacatttatatggtacaaatgtatgcctgttgaatatatgcaaagaaaaaatatcagaaggtgtataccaggattttaacataattttctctgtgttatgtgactacttcctacccttttctttattgcatattttacaaagagtgtacatttctgtcaacttcaaaaattgttttcatattaagataagaagaatgtaatcagatataaatattaaatgatggtttgaaattatcataatttcatgaactgtaactccaaaaatgactaaatagtctgaaaaagaatatatgtaagaaagcttaaaggttgagggactttgtgaattgggttgatgtttgcaccaattaatctctaacgattcattctactctaatggtttaaattttatatatttatccttgacatatcaattaaaataaactgatgcctgacagataactcccttatgaaattatctcctggtgtttagtctaattcatacaagaacatattgcatgtttttcttgagtgatgtttacaatgtactttggagattaaacttgtatttgatctgtgatattttgaaatggcttttagtcaaaagaaattctgacccaacatggggaaatagtttcttttagttatgtatcccaactatctaatcaaaagtagttatttaaatcctgtactgaataattttatgctctttgtaaacatacactctagttttagatacagaacttgaagcacttttccctaagcttctgatctcagcatttgtctgtggtcccttagactctgtcacgtctccagttgctaaaacttggtatcctacttagggactgtaatttgaaaagaggctgtgcgtggtggctcacgcctgtaatcccggctctttgggaagccgacgcaggcggatcacgaggtcaggaaatcaagaccatcctggccaacatggtaaaaccccgtctactaaaaatacaaaaattagctaggcatgatggtgcgtgcctgtaatcccagctacttgggaggctgagacaagagaatcacttgaaccaggaggttgcagtgagccgagatcgcaccactgcattccagcctggcaacacagcaagaccgtgtctcaaaaaaaaaaaaaaaaaaaaaagaaaagaaaagacgatttattggttaagtggttgttcttcataattcctgtcattcttcatattttcatgttacttcctcccgctttacttgctcatttaagtttagttttaaaaatacttccctctctctctcatttacccattcatccacccatccatctatccatttattttcggcagaagttggcatgtcaatagagattcttcaaattaaacattatttactttgaagttagaaaacaacaaattgattgtcatttactctaaactttgggaagaagacacattaattgttatttaatctaaatttagggaataagatgcaaattggaatgatttggagcaaagttagcaaagtattttaaacatacttttttgactaccaaagtgacgtttattatagaaaattcagacaatgataaaatatattttaaagaatcaccccgtaattgctgccatacaaagataatattaatgctttattacctaatctgatctgaaaagagttttcaattttacatttattctttatggtaggtcaaaagtagaaaaatttctgggagaaactatgaaataattattattgagtagatatttaaactgaaaattacagattatgtttttatttttatcaagggtcatatgtatcgaatatttacatgacactatacagaaagcactttttagtattacatattatgagataaatttttttttcaaattaatttcaaaaagcttatgaaatctactggttttgattgtcatccttttattagttgtttttgtttgctaaggttgcaatttcagtgcagtaatgcctatttttaaaccagatcataatgatacatataattgcattttagtatatcttataatgtataggaaattattaattccggatgaccttctagaaattgtaaatgcttggtgaagtgaaaaattgtgaaagctgacttcagagctttaaagaggaaataaatgtcatatatagtaaagcaaagtagctcttaagttagtacttcaaaattaatagtagagcaagtactcattatttcttatagtttaattaattgctgctttttaagttcgtgttttgttgctgctcagaattgcattatgagatgccaaattcatgtaattattagactatatggtctaattaatacttttttcaaatataacatcttcttatttaactctatttctttttctgaattctaattacatagatctaaccaatctcctcattttagtttacatgtgtcctaatctcttagacattttctgtttctctagggtaaattatagacaatttcttcaaaacctttttcagttaaaaaattctcttttcagttttgtttggtctataaggaagttagggagtggcatgaagttagggagtggcacaaagtaagtgctcaataaatatttgttaaattatggtatttatgtctttctgatatttatccaagagcctgaacatgttaacattgattaaatgtgtacacacatgaaggaacaattgagtgggtaaaatttagcactggaaggtacaataaatagaatttctataaatgaaagtgtgtttgtttatttgctgtttgttttatctcaagaaagtatgcatgccttaaaatgttgactttacctaagtaaaatttggaaaactgcacagtacctgttggtaccatagcctttgtcattaataagcattagatgacagccatgagaagctatgatagagacaaagactttgctgggatattactcaacattgagaagtgctatatggaatctgagaattacatgcatttaacactgaatgtgatacagactttattgtctgtgcctttcatttgttctgtaaatttttgtgtaagtaaaagtgatgcttatttgctggagagtggaaatcatatttattctcgctacattgagaaatacttgaaaaacatttttttttctgccagtaccctgtacattctgcaatgtttattcctaagttttggttttaaatgttgaatactgtcctaaaattttattaaagtgtgtattttccattttgtttgtagagcaacaatgtatacacataaaccatgcccttttggattttccacttttgtaattactaccatatttgtttgtttacttgctttttaattttatttctttgatgaagtggcctttagcaatgtcttgcatgctacatgagatctgcttatattcctggaattatctgttggattcttgagtttctctccctactgatttctcttttctttcctctgatattactatatgcattccccttctcatatacaatgggaacaaaaggtagtgtgaccttcacaagattatttacataattgcataaaattgtacctatgagttgtttagaatagtggacattataatagtaaaagatcaatgaggcatgaatgttagttattgtttttaattattatcaggttgacacccctggaatttgaaggggaaaatataataaaagagaagcagaagtaaatattttcccttaatctcaacaagctgtaattgttgcctttcctctagacttcagtatcctagatgctgtgggactctagcttagcaccttcggggaggacaggcagtttggacacccaggtctctcaagtactttcatgtaacgtggggttatggaacattttttaacgttattgtgggagttattttgaggattttctcctttgtctagaactggtatcgaatagaaaaaattagtcagaaaataaaataaaataaatgccagccattttcttccctgcctttataatctcaggatttcttaagagagccttgtcattgaaatcatccagacatttctttgttcatcatcttttctctattataaatctggtgttataatttgtaacgtttagttgtttatttgtgttagtgattataaccttagttttttgcaatcaacttactgtttagaaatacaagtggaaatatgtgtacttatatatgtgtatgtattatatgtagaaaaatgtgagagactttttctgtcaattccccactctcaaatgattccattaagactgctcattatgtccatgagaagtaggagaccaatgttacaactattttgaatattaccctgtgtttttcctttttgtccttaacatagtgaagcatagacaataatattttattaatacaatattctttttataataaaaatatttattatctagtttcatgtgggaagttttgtcatttcttgtcattctctcctccaccatctttaactctgtttataaacacacaaagccttgtgataacaggaatttggatatgtcataactgtgctctgtaactggctcaccatgtatttaattaaccttgtagtaatgcatctctgcatttttgggaactgaattttgagaccacacataaagcatttggtatggtttgggtatcaataatttaatgaattttttaaaaatacatgcatcattgaggttttggttttcatatttttggttgcaatcattttataccgataaacagtgcaaatattaagaataaattatattatcttgtagttgatcatagtcgtgaaaaagaaaatgcaccagaaggtcctactcagaaaggtcttcgtgaagccagggaacaaaacaaatgtaaaacaaagatgaaaggcaatacaaaggtatgatatttgtttttgtttgcattaagtcatacttaactctcagatctttagatccattcactcatatggtatcattattttaccggaaaaggaatttagaggttatatattccgggctgcttggtttatacatggacagtggaggtatccaaatgttactagtaagtagttaattcagggacacaggcttattagtagcagagacagctcagtggatcactctgccacctatcccaacataatcatgatcatgtctgctcacctgctaacttttctgcttgaaactacctctgtctaaaagaaatcactcccaggtcatatcttgttatatcttttctcaaaatgtaacgtcagactttacttagtctctttaaaggtagaatgaaatagcattatgctccgtttaacaatctctttatatcttgagtaccttcactttgtaatcagactggtagtttaaatctttgccagtgattaaagaaaatggtattaaaaatggttggtcaaagagatcaaaaatgaagaaaattacataaaacctgtgaagagtttagtttattgttttgaaaattacataaaagtctagctcaggtaatggattttcttgtaaggcagttgttaccttagagttctaaaatatctggcacttattttaaaataaaaatatttacaattataatagcttcttagtaattctagaagaagaatagatttgtatgaattcaaataatagcatttacttaggtaatgccaataattttttttctctctaaaacatgcattggattctggtattgtataaaatatttatacaatgaatttttataaatttgtataaatataaaatataaaatttataaatttgtataaatataaaatatttatacaataccagaatccaatgtataaaatatttatacaataaaataaaaactaatcacttttttgttataataagctttttattataatcttgtgctttttcagattagtgttttgttgtttttctatcataattatagattatcgtatgtgaggtagactcacatcagatttaaggatttttggaatgatggaggtgattgtcatcagaaacattttcatcttctaacggtataagtattgtctttcaggtagtaagtcatacttagaagtgatttgttgattcattcactcagtgcttactgcttataagagtttagattaataatgcaaggttgactttttatgggacaaaaagatactaaaatataggaaaagtacattgcatatttatgcatagtatattattttatggtgttgcattctgatatttaacgtaatacctacagcatggtagaaaacataggtcatattaaagggctaaagtgtaaaataaggtgaatccttctcaccttcactgagtaatcatttttactagtatttctcttaattttcttgttgttattattataacaaatgactgagttctgtttctatttttttaataattcacttcacatgatatctattgactccgccgtaacaaagaggcatttagagcactttactgacttgatttgaattatattattatgtatgttgtcataattgataacatttacatttgttctatagtcttaattctattttctatgctatgtctgtaaattaatactaacatttaatcccataaacagcctttaaatggattatgtttaagtaaatgtaatttattgcagacattgcaaatttaactagaactgtagaggaggaaggagaatacctgaagtgcataggactgtatttaaagatttctcttttataaacagtcgctctcttctacttcattggcttacactcagctgcccctgttatgtattctcatattttccttcatagattgctttttctgttttcctagattatctccttgagtaattttcaaaaagggccaatggagataaatgatctaagttcatacatctgaaatattcttgttctaccttacactgagttgatattttgctggaattagagttctagttttaaattaatttttcaccagaattttacaggcattgttttaatgtcttagaggatagcaataattgctgttggtctgattcttgttattttgttgggaagtaaaaaataccatatacaatacaatgtaccagtaaactagtattttgaacaactagaacagtgaggtgtaatcataataacaactttatttatgtgacctactgactcttaaagctgctcagtggaggtaattcaacccttaccctagggtgataattcattcaggcttcatgaaattattagtcaagtgtgtgtttactctggttgcaaaacacaatctcaaatcagtaattaaatatgtccagctttatgtaacacaaatgctccacatttaacatgaagttaaattttcacctaaccctcagctgaggacttctttgggctagacatttgcagtgtggaaggggttgtaatggtggtggtgtgtggccgttcgtaaatcttttcctcttactttttccctcttactttttcctcttactttttcccttactttttccctagtttgctaactggcaaggttgaaggtgcaaggagggagaaattaaagacgaatggaagagttgttactggacttgagataccttatgatagcttagagttctttgaacttggcaaaatcagaaagcttttatcctgatgagcactgtattagtcagagctctccagagggatagaactaataggatgtgtatatatatatatatatatatatttttttttttttttctttagaaggatagaactaataagatatatatggggagtttattaagtattaactcacacgatcacaaggtcccacaataggctgtctgcaaactaaggagcacggagagccagtccgagtcccaaaactgaagaacttggagtctgatgttagagggcaggaagcatccagcatggagaaagatgtaggctgggaggctaggccagtctggtcttttcacatttttctgcctgctttatatcctagctacactaggagctgattagatgttgcccacccagattaagggtgggtctgtctttcccagcccactgactcaaatgttaatctcctttggcaacaccttcacagacacacccaggatcaatactttgcatccttcaattcagtcaagttgacagtattaaccatcacaagtccccgccttgtcaacttgaacccatacatatctgctgagatcatacataatcttcaaataaagacaataataaggtcataattatgcctaacataaaacaactatccttcgtacaaccagaaatgcatcagtccccaactcaaatactattacataaagttaacaatacttaaatgttgatgtgaagtcagtaaatccttatatcacatgataagggaaaaaggaaataaaacgaaggtatattcttagtacagtgtatacatgtacaaccatggttttaacaaaagaaggagggaatacccatgacaattacagtcctcgtttctgcagctggtcatgtggttgtagctggtattgattactaccttgttctatctattctgtagtccctttgccttcagcaagtacctcagcaggttgtggattttttcctggtggagtgacccaaaccttcattcctgaagggtctgggccatatgcagtcctgcccagactgtgatgttgtaatttcccaatgaccttaatcacagggcatggcaatactaagagacatcctagtggatctcctgtagtcatgcatactctttgctacctccattgtggagtagtagactgatttcatcttgatagtctgggccaatcaccccagccaagactgtaactcccttcttagcctgttgacttaaaggtaggaggagcccaaagtgtccaagtggcaatcttaactttcagtttaatggaatcattgttgtgtctcttgatggcagcgttcctccctctggaactaagacctctaggccagcaggatcaatgttgtgggaacaggaagcaagaattttgctggtggatcactaggggtgatggtgagtggtgccacttccacttccaccccttggttcctggaaccatgaatcctggctatgggagaaacagtaccatatattgaatgctgattcagagcatacacaccttctggagaactttgcctcagcctagtaaagtattgtcacctagttcgtgttgtaattgtgacttcaaaaggcaattctacggttttatcaatccagctgcttcaggatgatggggaaacatggtaagaccagtagattccaggagcatgagccccatgctgcacttctttagccataaagtgagtgctttggtcagaggcaatgctgtgtggaacaacatgatggtggataaggcattccgtgagtccacagatgatgtcttggcagaagcattgcttttaggataggcaaacccatatccagagtaagtgtctattccagtaaggacaaacctctgccctttccatgatggaagaggtccagtataatcaatctgccatcaggtagctggctgatcaccccaaggaatggtgccatattgagggctcagtgttggtctctgctgctggcaaattgggcactcagcagtagccataaccaggtcagccatggtcagtggaagtccatgttcctgggcccatgcgtaacctccatccctgccaccatggccactttattcatgggcccattggtgatgacaggggtggctggggaaagaggctgagtggtgtccacagaacggggcatcctttccacttgattattaaaatcctcctcagctgaggtcatcagttggtgagcactcacacggaatacaaatgtcttcacagtttttgaccactcagaggtgtccatccacgtacctctttcctgaatttccttgtcaccaattttccaatcgtgcttcttttaagtccctgaccatccagccaaaccattggctgcagccgtaagtcagcatataatcacacatctgaccatttctccttccatgcaaagtgcacaaccagttgcactgctctaagttctgcccactgggaagatttcccttcatcactgtctttcagggatgtcctagaaaggggctgtggtgctgtagctgtcaactttcggatggtgcctgcatattgtgcagatccatctatgaatcaggccctagtcttctcttcctctgtcacctgatcataggtaactccccatgatgccatcagtgcaagctgggagacagaaggcagggtgacaggaatggagaccatggacatttgagccacttcctcatgtaacttacttgtgccttcgggacctgcttgagcccgatcacacatacaccactttcatatgatgaaggactgctgctatgcatgacccagtttatggctagatgtgtcagaaagcatccagttcacgacaggcagttcaggttgcatggtgacttgatgacccatagtcaaacattcagtttccacgaagcccagtaacaggccaagagctgtctctcaaaaggagagtagttatctgcagaagatggcagggccttgctccataatccaagaggcctccgctgtgattcacctatggaggcagcattggatctgctgggttatatggccccagtggtagagcagcttgcacagcagcctggacctgtttcagagcgttctcctgttctggacctcactcaaaactggcagcccttcgggtcactcgataaatgggccagagttacctaccccaatgaagaatgtggttgcctgcaaaatcaaaataggcccactaggcattgtgcctctttcctggttgtaagattttactaattgactaatatatctatttcaagaatacaatcagaagccagggaaacaatgaaggaatgggtccataaatccactgggcttaccgtaaaatagacttataccacaacactgttgatcagaaggctatgataagcccctaatttagctgttagatggtgttttggggtctctaggaaagggcatttattcagagccaatttctaattatatctgaaaggtatgaagcaaaagagtactccatgtaaatgactgctgttcctttagggaaggcttggaggaagacttacaatcagatttctgtagtgaacccaacatgatacaatgaacacatattttgtccagtgaaaataaaaaaacactgacccttctaaaatggtccaacataataagtatgccagtaggtggctggcaggtttttcatggtacggtgccataacaacggttccatgttggtttgtgctgttggtaagctggacattcagcactggatggtagctgaataaactttgcttaggagaagcctttgttaatgattccatacgtagtcttcatctttaacacaaggctacatgatcctattgagcatacagagggagagccaaggaaaatagccagtattcacaagataaggcatgtgatccacccgattattgaaaacctgttttgcagtggattttttaaaataagtatacccatgggacaccaatatttccacacttttgcctattgtgagagatgtagccactaaccatttccttagatcttatctcagaatttccaaccttattcttttataaacccctaaccagtcagccagactgatagccactgccaataaataggtatagatgtatccgctgtaccatttatgtttttaggcaacataggtgatcagatatactgccaagatttctgttcacctgaaggcttttcattcatcactgtctttcagcgctcccattggaagacttgtaatccagtgactgtccacttatagctgaatttgggtggcacattgtacaaacctgtatggaaatcaggctagttttttttttttaatccattctctgatagctggtcatggtgagtatctcacaaagccgtaggtatagttgagggacatgtgacattgaaacaagagtggaagtttggaagtttacctgctcatgcaacttacttgtgcttttctgatgttctctagcacaatttaaattataattcttccttttttaagatgaattgcttttacatgtccagactcatgtctttgaggacctcctggtttatgatgagcaattcagtttacttagttgcttggtgttataagtcctcagtatctgtcagagctcatgaacatagtaggagctaacccttaatagagaatatgtaaaagtagttatcaacaaggtgaacatgccttttctccagaagtctggaggtcagtactgtggccctctgttggggcttgttataggcttcctatagtatcttcattttctacagatagtttgagcaccattgggtctgctgggccataaggcccaaggagaattgtcttatatcctggacatgttgtaaactttttggggtccaaacatcatttatactatgttctttattcagcatggaggacaaaagatacagtaactttgccttttatttagaagcattatcttaccatgttccaggcttcagaatttctttggtgtttgtttcttctctggcacaagcatattgctaagacatctagggtacttgccacttcctgctcatcagatccatttagggggattttagcaatatagtggaatataaagatggtcaaggttactttagtttgacagagaataggggagtttatatggccccgaggcaaaggagtagaaagttttctgctgcctttgtcatgtaaaggcaatttggattaactaccatcacagatgggaggagagaataaaacattcaccaaatcagtagcctcataacaagtagtagagggtatttttatctgcttcagtaaagataacacatatggcacagcccatatgttccagatctttacatgattctctcaatcttgtaccccattattttctgattgaattcttgagcaatgtttggacagtaagattctactcctgtctctcttttgttggatctggcaacctccttttataaaagtaagtgacatattggataatatatgtataaacactttatacattataaaagcattatgtaaatacaaagatattattgttgctgatattattcctattattatagaaatatatcccccaacatgatgctaagattgcagagtatttagtatcttgctgacccctcttgacttatcttctagctctacttgttcctgttcttctcataatgaagtgcaaaaataagctaaggttcttatgggttgtcttggatgtctaaataagttgttcatttgttttgaatgttctaggtcttaatcagtgtatattaagattatatgaatcctcttgaatgatgatatacactccaatagagtgtgtgccacttgagtgtataccatatggtggatacactcagaggcagcagtgggttcctattacaagtttgtaggaccttattctcctggcattccaaactgtgtcttctcttgagtacatctgtagatagtcaaaacatataagacatgaactactgtcctgtttgcaccaactagctccttttgcctataatcataacacacaaagcttattattagtaaacatcatgtttatccattctgattaacataatacaataaatagtgatgttctataatatttctagagagtacagttcccttcagactattttatgactagagtggaatgttaaccttggcaagaacataaacatgtactgttgtctgcccaactgaatgcacattgcttctaatctcactttatgagaagacacatttgccggatcaatgactacacacgatgtgcctgagtacatgttaatctgctgttgcaaagataccatatcaggtagaacagttgcaatttaggctgttacttggttgagtttgcagtagtctcctgtcatcctccaggatctttgtttattatagaaactagactagggaattatatggaaatatgatgagaacatccacatctacatcctttgtttaaatctgtgccattttccaccaccctccccaatatgcagtattattttttatgaacttgacagggaaaggagcagttttcaagtctcctacttggcatttcccaccatagtatcatatatcccacaggtcaagaattaatgtggaagttctgcaaaataccaagtatgttctttcaacttgtttggaatctgttaaatgaccatcagatgggttcatggattccatcttactgtgagccagacctgggcaagctatatttattacttagtccctatatgcctcagcctcaaatctaagatggtggagggtgagagttataaaactatgagtccctgagtatcaacgccatgctagaccctgtgtcaacagtttcacaatgtctgggtctttctttttctgtagtgtattgttacctaagcctctggggaaggaatggaggaatcattgtatgtacttgctatggtgtaggaggatcctttttcatagggactgaacttctttcgtcaggaagttctgtgtgtgaaaactggctaagatctggaaaccaggcaagagatagtgactttttacaaggttgctgctctcagtatcctgatcatccatcctgtttcttctggtcgtacagattgaacattaccactgttggcttcccatctttcagccctttaaagattctatgttctattgactatcttcctagcgttctatggttcaggatatcctgatagcccttaccaccttgctgttcttttccataattgtgcccatcttgcttttgacatttacgtgcttctggctggcctctgctttctcaggagtctataatctaaattgctttcagggagtgtagttctctaataacatactctctactatcatcttagagaaccacaactgagcttctcaatgatgttgctgctcctctcaccttactgctttcctagtggacgtattctctggtcatccggtggacatggttatctcatgggatttttggccttttatggtgtatccactctcacaggctcacttctctgagtatttagatcctcctttgttgtggaatgtagcattggcttttctagttcacttagtttggtaatcactttttcccctaagcttcaaagagccatcctagcttcacataaataccagtttcctttctagggtgttaagttctgtgttatagaagagtactctcatattgataaactctgccttgtccaactttatattctacctctcttacctcaatgacctcaggacccaattcttcatgtactgtcgtggaacccataggtacatgttggctagttcctgcagttccttggaagtagttcttttcatctttataacagagtcattacttacctgaataggttttatttttatttaaatgaattttggtctgttggccagtaaggagggtggggaatatattgtaagaatggcatgtattgtctcataagacagaagactctgaattgcccttggtgaagagaggtgtgctcgtctctaaaagggagaagcaggccatttttgcagggccagagagttcagggaaatatgaagatttaagatttttaagtacgttgtctcagatttcttcatctctgtccacacacacacacacacacacacacgtatgacttcttgtaactcagaataaatttatttttccataaaattcatgtactaaaatactgttggttttcctaaaatgactttcctataatatgttttcaaatttcacttctttgctgatatctttaaatttttatattattatactataactttataacaatatttggagtcatctacagcaatttatgttttgagataaaaataacatgacaattcacaaataactatcatatttcacaaacattaatttcttcatctttgaaatgtcttctaatagtatctacattttactagtttattcagttcagaattgtggccttgtcttaaatcgtattcttcccaatgtcttccaaactcccattgatgccttttttccatattatttaataagttgtgaatttctcctaggagtggggcatgggttcagatcctactggaaagggcctaagagtcttgtcttgaaatttcatttgcaaaacaaacttagattaaatatatatatattttggttggatttaggagggcatctagcagagattttgagaggtctcctgaaactatccctaacctcctattgcagtttccccattttcctttaattctcactcccatccttctaaatctggtctccatgggctacattcacaaccttgcaggctgtctttcaatagttcattctatgtttcatggattgataactttccctaaaacatgcctctataagctcgtctaatcttccttagacaattgtatatctttacttctcaagccagttgggtatctagcttgttgatattccatgataattcttatatatcttttataacattataaatcacattttacttatatattttacaaagttggttacattttaaagtcaattcttatggtttaaactattttctcttgaattaggggaacaatttttgtgaacattagggaagccattttcttctgaaagttttttagccaatcagtggattactaaaatagtcagtggattagtctttgtaaagataactaaatattacaacataatttcattttacctgtggaatatattttatcctaaaggaaataagagccattatgcaattaattggatggtttttgcaatctcataagtcaaaattaagagaaaaaagttactgctttattgagactaagaatgatgattatacatgtgaaactttcagtgtgtcaacatattattttaaggaacagcagaatggaagagtgccatacagatttgaatagttttaaaaggtaatatttatacatagaatttccttttttgttgtagaagggaaaaaaaggatcaaatggtatccactgtagtccaaattcattactttaatgactccttgtagagttaaattggagctagattataatatttgtaatatattaaaaatctacctttcaccttgtattttgacctatatattcaatgacagtgcaggaaaggtgaaaaagcactattattaaaagtattttaagaaaatagaaaggaaattagaaaagataaggggctgctaacttgtttcttccatcctttttttgcccaaattcttagtcttttttgggttggaatgaaatgcatgctctttttttttttttttttttttttttttttgagacagagtctcgctctgtcgcccaggctggagtgcagtgtggagtgcagtggcgggatctcggctcactgcaagctccgcctcccgggttcacgccattctcctgcctcagcctcccaagtagctgggactacaggcgcccgccaccacgcccggctaattttttgtatttttagtagagacggggtttcaccattttggccgggatggtctcgatctcctgacctcgtgatccgcccgcctcggcctcccaaagtgctgggattacaggcgtgagccaccgcgcccggccatgcatgctcttttaaaagaaaattcttccctagtgaaaaaatatttagattgttttgtttctatctgtaaacatatttatatccctaataccccttctgggtttctgctggaaatggtgttttaaaatattataaagatctagtaagaaaacatagaagggaggattatgggaaggtggcagagtgggaagcaccagggatgcctcctcatctagataacaatggcactagcaaaatctgtctgatataatgatttggaaagtctagagtctgttgaagtctttcaatgtccacaggaaggattggacagtaaattatagttaagttgggtcaatttcaactcttagtatatcagcacctaccttcagccaccctagctctgtggcaggcagctgcacacaaattccaggagtaccttgcaggagcctgggtgggcaaaaagcatcctgtcctgcaaatatcagggatctgtgctcttatctctaactactgctttttatcatagaggtgcagacaaagagggttatagcaattgttgttttatcttactccattattcacccttgtctccctctctagctgaagtgatttccagggacttaaagggccaagtctccttttcccaccttcgtttttctcattccccactttggggagccaaacattaaagtctatgacattcagaagcaactgcatatatggggaaaattagaaagtgaccacacaagcctggggataggtggaggctcagaaaagtcctgagaaaacagtaaggttactgatccttgaccagagacagtccataacaataaatttttttaaaaaataaataaacacaaacaatagtaaaaaacccagcaaaccctggggaaggaggagaatctgatttccagactccaaattacaacacaaaatcatttgtatttctatacactaacaataaacaatcagaacaggaaattatcaaagcatttttatttaaagtagtgtcaaaagaataaagtacttaggaatttgtcaaagagatgaaagacttgtacaatgaaagctaaaaaacattgctgagggaaattaaagaagacataaataaatgtaaacatatcctatgttcacaatttctatcaaaatcccaaagaccttttttttgcaaaaacataaaaacccatcctaagtttcgtatagtctcaagggacactgattagcccaaacaatcttgcaaaagaagaacaaacttggaagactcatactttcttatttctaaactactgcaaagctacagtaatcaaaacagtatggtactggcataaagacagacatatagaccaatggaatagactaaacagcccagaaataaaccctcacatatatgatcaaatgattttgacaatagtaccaagaccaatcaatggggaaagacagtctttttaccaaattgtgctgggaatactgggtatctacatgcaaaataataaagttggacccttactaataccatatacaaaaattaactcaaaataatcaaagacctaaatataagacacaaaactataaaactctcagaagaaaatataggacaaaagtatcatggcattgattttaacaatgatttcttagatatgacacaaaaggcacaggcaacaatagaaaaactggactttataaacattttaaaatttggggcatcgaaagactgtcatcagagtaaaaaggcaaccaatagaatgggagaaaatatctgtaatcatatatctggcaaggaattaatatacagaatatatagagaattcctaaaactcaacaacaacaaaaagtccaatccaaaaaaggactttaataacacatttctagattgaagatatataaatggtaaagtacatgaaaagatgcttaacatcattaatcattaaggaaatacaaatcaaaactgcagtagggtatcacttcagactaataagggtggtttccattaaaaacaaaaagaaagctggtgaggacataagttaattggaaccattgttcactattggcagaatgtaaagtggtatagtcactatgggaaaacagtatgacagttcctcaaaaaataaaaaatagaattaccatatgatctcacagtttgcacttctgcctatatacacaaaagaattgaaagcagcatgttaaaaagatattttacacccatgttcatagcagtgttactcacagtagctgaaacatggagacaattcagtgttcattggcagctgaaggaataagcaaaatgtggtatatacatacaatggaatattattcagccttaaaaaggaaggaatttctagcaaattccacaacattgatgaagcttgaggacattatgctaagtgaaataaaccaataacagaaagacaaatactatatgattccgtgtatatgaggtactttgagtggtgaaaattataaatacagaagtagaatgatgtttgttagggctgggggagagggaatgaggagttactgtttaatgagtatagagtttcagttttacaatgaaaagaattctaggagatgggtgaggataattgttgcagaaagttatataaatgcatttaagaccattgaactgtatcctaaaattggttttatgttatgccattaataacttatgatgcatttttattacaataaaaacattattaaagaaagatcatttccatatggctaggaacagaaggcatgttaggaaggatacataaacattgcagtatgtacaacaaatatgttaaaacattttatatcttaattcaaatgtcaaaggttaaaagaaaaaataacttatgttttgggaaatattcacatcaacttcatatttaaagaagattttaaaaacgtttaaagcagcaatttaaaagcctacagtaaaattattagattatttgctcaggcagcagctggtttagcaacatttattcagagcttattataagaaaaatatcttttgctgaagtttttaaaaaatagcttctaattgccattaataacttatgatgcattattttttaatcatttaattttatgtttattaatcaataatacatgttatatacaaatggcttttcaaagcttggtttatactaccaatatagctattaaaataacagctttctcataaggtatgaatgagttttcaaaagctatagctgagttttcatttttgcccatttattttaattccttttgatctttagaaattatatggccaggcgcggtgactcatgcctgtaatcccagcactttgggaggccaaggtgggtggatcacgaaatcaggagttcaagaccagcctgaccaatatggtgaaaccccgtctctactaaaaatacaaaaattagctgggcatggtggcacgtgcctgtaattccagctacttgggaggctgaggcaggagaataacttgaacccaggaggtggaggttgcagtgagctgagatggcgccactgcactccaacctgggcgatggagcgagactccgtttcaaaaaaataaataaataaatgatacataatattttgttaagggaaaaaaatattttagcttataacttatccttgtgtaaattaactatcataatcaattttttgtttaccttagcatctgttagcaaattgtattatgtactttggcaaatattcttttagagtatgaattagtttgaagcctaatatgtattttagatccaggtctaccacttattacctgtacaaacatgggcacattacctaatttctatgtttccatctctataaactgggaagaataccatgtttatcaaagggttttttgttagtattcaatgaaataatatatgtaagatatctaacactgtgcttataacaggatttagactcaagtaattttgtttcgatagaaaaggttatttactaagggaagataaaagatctctaatttttaatactatttttctcttttaagtgtgacataagttacactgaatatgtctgctaaagacttccagattcattactttttaactactttagccattttattatgcaatggcatgaacaatttaccagtagttttccctgattgtgagtatagtttccctgtttcagattatatacaaatagaaacatggagattagagaattacggtggctaattctgatgttccaatgtttgcatgtcccctgttacatatttaaaagtgcttctgtgctcataaaacctgtacacaactctcagtttctttagggctattctatattttgatttctttaatgaaaaaatggaatgttatttaatatctttatcataacacctgccagttattatataaaataggtggtaatttaaacgtaaccatatgcaaatgtgaaaaggagagaaaggtttcctctactctgatacaatggtatatgccattgtgttgtgttatgtcaccctggcatgataatggcacacttcaactaatccacttaagtgctgatactttgcatttattgtagagtttagttgcatttagtacagtattcttgaatgtttctttgcagctattattattactttttgcctaaagtgtcattgcataatgcagagtgactctggcatcaaccaaggatctgggtgctattttgcaggatttgtaaatattacaccaaaatgttaaataattttatttatcacacatggagtttctaaaaaagaatttagttttacattttttcagtttgaaaatatggaagttggtaagaaatctataaccatatgcaaatgggaattttaatactaataatatgaaaatagtgttgaggctgggcacggtggctcacacctgtaatcccagcactttgggaggccgaggtgggtggatcacaaggtcaggagttcaagaatagcctggccaacatgatgaaaccctgtctctactaaaaatacaaaaacattagccaggcgtggtggcgggtgcctgtaatctcagctactcgggaggctgaagcagagaattgcttgaacccgggaggcagaggctgcagtgagccgagattgcactactgcactccatcctgggtgatggagcgagactctgtctcttaaaaaaaaaaaaacagtgttgaatatcttcagcagttgaaataattcatttaaacatctctgaggaaatatatttaccaaaatatttatttataatatcatgccatgttaaatagataagaattaagccaacatatttataattctgtgctaagtagaaaatcaaataaacagaaatacttacattattacactaaatatattctgcttacataaagagaagcaaatgtgaatcagaataaaagtaattaagagatactaattattcttaggttttaaactctgctccctatttttggattatgcatgtatagccctggatcatttgaaaatgcataactgagactgcagtaaaaaaaaaatgctgaggatttacaacattttgaaaactttggtcattataaatacttacattagctatatttcaactgttgatttatgaaaaataagaatttgtagattaaatatagcataatgaaaaaataatattcaattaatgttttagttaaaatatatcacatatatttgaatataatatataaattaaaatatatttttaaaatgaaaattacaaaatacatatgtagtcttcaacttgcttttttgattcgatttttgtttctaagagtctttagtgttgctgtaggtggctctaggtcatttcacaatatttacttttttgtattattgttacaatgttcagttggtttccaatgtcttggaaataaacagtgctgccaagaatattcttgtatgtctccaagtgcattagtggaagattttctgtaggacacaaacctaggggtggaattggggatgagggttttatgaaatagtgtcatttttttttcaaaccagttgaatatatttataaacccacacagagagctcctactactctatatctttctctgtattcattattgccagggttttttatttttcccaagcaaatgaaatatgtcgcctcactaggtcttaatttctatttttctgattactaattaaattgaacgtgttctttttcatatgttagcttctgtgaaataacagttcatatcttttgcaatttttttccattagattgttggcccttgaagtatacttgaaatgtataattgacattaattttgtgatcaattctattaatgcggatatcttgctccacatggtgacttatattttctgtttctttattattttttcagtgaatataagttcttcattataatgtagtaaaactaatcagtactttcttttatgatagcacttactgtcatttgattaagaaacccttttttatctcaagatcagagtactatgttcatatcttttttagcatttttcttgtttattttttcctttaccaaccaattcagacataaaaacagatattatctttcataaacccaatataattatctaaatcaagaaattaacattgataaaatacttttattttaatctatagaaattatttaaattttactgtgttgtactgtctctgtaatttcttaaaactaatatttttactttgagatagctttagattcacatacatatgtaagatataaatcagagagatcccatacagtctttacccagtttcccctaacggttacatcttggaaaactataatatagtatcaagattaggatgttgacattgatataatcaaggtatggaatagttctgcctgccagaggatccctggtgttgcccttttatagccacactgatttccctttagctctgtccatgcctaaccccaggaaaccactaatcttttcttcatttctgtaatttttttaattttaagattgttatttaaatggaattatataatatttaacttttgggggttgactgttacacttggcataattccactgagtcatccaagatgttgtgtggatcagtagctgatcatgttattaaattgctgagtagttgttgattctctttaaaatatttgggagaattcaccagtgaaaccatatggacttgggattttttggatgggagctttttaattattaatacaaatttaatttctttaatgcctatatgactattcagattatctcactttacttgagttttggtagtctgtggttttttaggaattgttccatttcatccaagttgttaaatttatgggcataaagttgtttatagtgttctcttattattcttttaataactgcaagatctatagtgataccactgttttattcttgatatttgtgatttgtttcttctcccatttatttttgtcagtcttgctatatagcaatttatcagttttatggactttttttcaaacaaccagcttttttgtaaacttttgtattaatttcctattttcaatttcattgatttttgcttttatctttatttcctgtcttcttctagctttgggtttattatgttcttccttttagacttttttgaggtaacaacttaaattattgatttgactttttaatcttgtaatgtaagaatatagtgctataaattttcctctcagcattgtttttgctgaatcccacatattttgttatattgtatttttgtttttattcagttttgaatatactttacttccatcaagtcttcctctttgacgtatagattatttagaagtgtgctgtttaatttccaggtgtttagagattttccggtttgatttctagtttgattccattatggttagagatcacattgccttttgttgctagattgggagtcagggctggctcaccttcttctgttgggtggtgaatgataaaatgccctatcattatgctcttcctccagtcctggaatctctgatcattttacctccctgtttccacctttcagagttccccttagattgtctcttgcatcatttccagggtttatagtttagttaccagggaagaatgggggacagttgagtctacaccactttggctggatagaacatcacttcaattttgctttacaattttaaatatttaatttccttgaaattgatttttcatgtagagtatagtaggaatccagtttcactttgttttattcagataattgctgtttcaacacaattatatggttcttcagtggtctgaagtatcagctctaactgttatttaactagtttccatgcatacatgagtttgcttctggactttcttttatgtttcactggtgagtttgtttattcctgtggcagtagcatacctctagattattttagtttttaacatatttggatatatcctaaggtaattatcttcaccttactattattcttcttcagaagtgttttagctagtcttatacctttatttatccctataaatttaatagtaggcttgctaaattcctaaaaaaattctcataacatttattgaaatattttatatttttatacattaatatggagattctagcatcttttcgatattgaatctttcaatgcgtgaatgaacatagtttatctccccacatatttggacattctttaacatctttcaataacaattttataattttccccatgcagatcttgtacatgtttttgttaaatataattctaagtaccttatagttttgctcttgtatatgatatctttttaaataaataagcttgttcctttgttggctttgaggcctccttcaacagaaatcaagagaaagcttatgagctcagtgcgagaacagccctctgtctaactccatgcctccatcagcagcagtggacagggaactctcaaacttggaataagaccgtacctctgcaggacactattggcaggagacaagagaacaacagtgcacaccagcacatcgactaagactgcccatcttcaggacatttgtcagcaggagccaaatgggaaattctgagcaacaggtgttcctggcttgttctcctccaatcctccctttcgtcaacacccataccctttatctgtgttctttacagtcttcataaaaggagtccaggacttccagttaatcatttatcccagaactctaatcctccgtaaggatcctttttttttgacccaatatttccctcttctgactccccaaaccctttctttgtactctattgaattcaaggtcagtcaacaaaaaagtcctttatattttaatattttactatgagtgttcccttcaccttctgtgctaatgaaaatctagattttccttcatgatagtttcccctgcatccattgaggttctggtaaatgttttaacaatcaactctttggaagaagaaaacaaaagccttgatttgtatagtgttttccagtttctgtgctgttaaacactcacaccatagccatttaagctatcttctcacttcactgaataaggagcctgggacttgatgtccacactcagctctcctaagccagtatgagagagcaacaacacatcacatcttacagtacctttaagggtaactgttctctctactccactcaaatgtagcataggtcctgaaagtcagataagtgtcccctttgcttctcattgctgctttcagtttgttctccctccttcatgaacatacccttccgtgaatctcatgtcatcagatttgcccactcattgtacctttttgttatgggcacctcttctcacctcatctttttgtcaattaaaaaaattaatccccgtgatattgtcactttcttaaaagtgattcctccataatgcttcatgattgaaatgttgatatggatgatccttctaactctctgaagtttcagttccttgacagcctctcctccagtgatccacttaactcactttcatagtcatttcctaggccttgttattgcaagtaactgctataatttttcattgcctctattgtttgctccctaccccccgaatctctgcatactgaggtgtttcaaggctcagttcttgaccctctgttggttgtcttcactccctaggtgatctcatccagtcttatggctttaaattctgcctatatattaattatcccttaatttacatcttcaactgagatctcttctctgaactctagtttcatatatccaactgcttactgaacacctccagttaaatgtcatttcttcatttcaattatctccccttccatgttctccttcttaattaatggaaactccacactttagttacttagccaaaaaactctagagtcatccctgagacgtctctctctctcacatctcacatctgataagaaaaagaaattattttggctctatctttgaaaaaatatctacattttcattttttcttaccactagcacttttgctctctgtttttttttttttgccaccgtctgtagtttgtattattgcaaaagcctcctaactgatctctgcttttgtctttacttttcttcagtctcttttgaacacagcagccacagtcatcttcttaaaacataagtctgtccatgacatttctctgctgaaaattttccagtaacctcccatcttactgagttacaggtaaggtcattataacctctgaggccctacattacctagatcccttttacctctctgacattatctcctgctaccctcccatcttttgctcaattgcaggcacactagcctcctacaaattctacttatttatagaacactgtaggtatgccccaccttgaggctcttgcacttgagtttttatcttctgtctgtgttattttccttcagataattcagatggctcatctctcactttatttaaagctttactcaaatgttcccttttcagagagacttttcatagccatccaatctaaattttaatgctgcctctaattcactggcacttctttggcctctatcctactttaatttttctttttgcctatcttacatatctctcatatgctatgttgtacttattaactcattgtatcacttcccactagaatgtaagtcccatgaaagcaggaatatttattaattgtattcactgctatattctcagtgccagaaaaatgcctggcaaatagtaattatcccataaatatgtaaatttgaaggaatgcataaattaaaaaatgtgttttgttagttgctattgtatagatatgcattgattactacaagttgatcagaaatagagtgtttctgctaaaccccctgtttctataatttgtctataggctttttgggaattttctttgtaagtagtatcatctgtgaaaaataatagttgtgactttcatttttcaattctaaaaatttttatttgtatttcttatatttgtgctttgtctaggtcctccagaaagttaaatagaagtggttaaatagtggtggttatactatttgtgattttaaaggtgatgcatctgatgtttcaacacaaggaatgatatttattgtctttggtggttattctttatcaagttgaaaaaatttgttttcctttgatatttaaagtttgtgttttaccatgagtatattaatttttttgaccataagtgattggtaattttatcatgtttaagttttaagattttattttatcatgaataagtattgtattttctgcttctgagactgttttctccattaatattttaatgtggtaaatgttgccatggattttaaaatgtaaacattctctttcattcctggaataaaactaatgtattcatcatgtgttatttgagttacataacactggacctagttaatcattttttcataggatgcttacttctagtttatgaataaaattgatctttaattttcctgttcagtcactgtctttttataattttagtatcattgaataagttgtggaatagttcctttcttctattctttgaaagatttttataccctggaagacctattccttaaatgtatggtagaagtcttctgtaaaactaattggaactgttatatatttataggaagattttatactgtggattcagatttctttgtaatgtaatagaagttatttcttccttaatcaatttttataaattctgaagtaatatgcttacatgaatatgaccatttcatctgagttttaaatttactggcttaaaatatttatcatattttttattatcttttaaatctcaaatggatccataattatattctctttaatttgtgaattctatttcttgccctcccttccaacagttttcccctcccttcccatctcacatcattcttcctgtaaatatataaattttgttggtacttttaaagatccaagctttggattttataatcattatgtttagcttttttcttgtataactttgtagtttcattgttatgatcttcttctgcctatagtctttgagtttatgctttgtttctttttccagcttcttaagttgatacataactcattaatggttggcttttctactattttaagtacttaatactattaattttccccaaatactgtttcaactgcatcccacagatgtttatatgtagcattttaatttttgtttagttttaagtattttaaggtttccattatggtttgttctttgtcctgtggcttatgtagaggacattttcaaatttacatatgcatgggttttgggttatttttttatttgggttattatgtatttgtagttgaaataaatcatggtcagaatgcatggtttgtatgaaaccaattcttgaaatttcttgggagttgctatggcagagatttctagttttctaccaaaaaatgttttctttattcctgtagttttcatgatatagctgggcatatagttaggtacctgtatttttcagtatcctgtacacctagatgttaccatgaaactaaatgttgccagtggaatttgcacttaatagttgtgtgtttgtggaattacctttcagaaatatttactccctcccatcattttaaagaaaggattctacttccctgatttttttagtctttgtttttttcttttttttgagacagggtgtcactctgtcacccaggctagagctcagtggcatgatcgcggctcacagtagcctcgacctcccagggctcagctgatcctcccacctcagccttccaagtagctgggactacaggcctgcaccaccacacctggctaatttttatatttttttgtcaagatagagttttgtcatgttgctcaggctggtcacaaactcctggactcaagagatctgtctgtcttggcctcccaaagtgctgagattacaggtgtgagccactgcacccagctgtttcctgattattgatgtagagcttggccttggccatgtaacttattttggtcaatgataatttgagaaacctgactctacagaagcttgatatatgcttgcacatttaggtttgctctgtctgccatgggcatgaaaagaatgcggccatttcccttgataatatatgttcttcagaaacattagataatgtcataatgcattattacttggatatttcacaatgtattttatgttcccatgtctactcattttgtttatttccgttgttttgctgtttcaaataattctatgaggcaattcttatacattaaattctgttcatatcttattgtttctttggtataaaactcaagaactggtgatcttggattaaaggatataaacaagtgtttgttctattcttcatttttacagtgaaatacaaaaaatctcctttaaaaagctactccttgcatttcatgttagtatttgcctggtacatcttttttcatccctttattttcaacatttctgtaatatgtttagttgatgtttctaggaattagtatatagtgggcagtctctttcatttatctggtgattttgtccacttatatttatttaagtgttttccacttattttgattattcatgtttttggacgtgtttctaccatcttattttttgctttatgttaatttatctttttatgcttgcatttatctttccttgctttataatacattgatttgttttcactatgtatttttctctttcagtgtttgctctgaaaaaatttagcatgcacatgtaatacaatctaaaattaattacttggataatagaaaaacttcaaacgttttaaataagatcaaaacacttcctatttacatatatttttgtctggtcatatattttttaatataatgaaacattattatttaagaaaggtaatttataaagacaatgcttatttcaatttatctacaaatttactaattttatttttctaactggttttaggatctcatattatctttttttgcccaagtttcgtcataataggtataattttttaaaaatttatttcatggactgtattatgtttcctgtatttaggtggcatgtcttttatcatttctcagaattcacactcatgattgcagtaaatatttcctttcctccattaataaaaattcattcctttcagagatgcaattagatatgttatactatctaattctatctgccatattatttaaactctcttttacattgtttatattcttatctccttatgctcaattcccaaaaatttatttatagttttttttaaattttattattattatactttaagttttagggtacatgtgcacaacgtgcaggtttgttacatatgtatacatgtgccatgttggtgtgctgcacccattaacttgtcatttagcattaggtatatctcctaatgctatccctcccccctccccacaccccacaacagtccctggagtgtgatgttctccttcctgtgtccatgtgttctcattgttcaattcccacttatgagtgagaacatgcggtgtttggttttctgtccttgcgatagtttacagagaatgatggtttccagtttcatccatgtccctacagaggacatgaactcatcattttttatggctgcatagtattccatggtgtatatgtcccacattttcttaatccagtctatcgttgttggacatttaggttggttccaagtctttgctattgtgaatagtgccgcaataaacataatgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtcaaagtgttcctatttctccacatcctctccagcacctgttgtttcctgactttttaatgatcgccattctaactggtgtgagatggtatctcattgtggttttgatttgcatttctctgatggccagtgatgatgagcatttttcatgtgttttttggctgcataaatgtcttcttttgagaagtgtctgttcatatccttcgcccactttttgatggggttgtttgtttttttcttgtaaatttgtttgagttcattgtagattctggatactagccctttgtcagatgagtaggttgcaaaaattttctcccattctgtcggttgcctgttcactctgatggtagtttcttttgttgtgcagaaaatgttatccagcatataaacagaaccaaagacaaaaaccacctgattatctcaatagatgcagaaaaggcctttgacaaaattcagcaaccttcatgctaaaaactctcaataaattaggtattgatgggtcgtatctcaaaataataagagctatctatgacaaacccacagccaatatcatactgaatgggcaaaaactggaagcattccctttgaaaatgggcacaagacagggatgccccctctcatcattcctattcaacatagtgttggaagttctggccagggcaatcaggcaggagaaggaaataaagcgtattcaattaggaaaagaggaagtcaaattgtccctgtttgcagatgacatgattgtatatctagaaaacctcgtcgtctcagcccaaaatctcctcaagctgataagcaacttcagcaaagtctcaggatacaaaatcaatgtacaaaaatcacaagcattcttatacaccaataagagacaaacagagagccaaatcatgagtgaactcccattcacagttgcttcaaagagaataaaatacctaggaatccaacttacaagggatgtgaaggacctcttcaaggagaactaaaaaccactgctcaaggaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagtacacatggaaccaaacaagagcccgcattgccaagtcaatcctaagccaaaagaacaaagctggaggcatcactctacctgacttcaaactatactacaagcctacagtaaccaaaacagcatggtactggtaccaaaacagagatatagaccaatggaacagaacagagccctcagaaataatgctgcatatctacaactatctgatctttgacaaacctgacaaaaacaagcaatggggaaaggattccctatttaataaatggtgctgggaaaactggctagccatatgtagaaagctgaaactggatcccttcctcacaccttataaaaaaattaattcaagatggattaaagacttaaatgttagacctaaaaccataaaaaccctagaagaaaacctaggcaataccattcaggacataggcatgggcaaagacttcatgtctaaaacaccaaaagcaatggcaacaaaagccaaaattgacaagtgggatctaattaaatttatttattcttaattgtccagttctctttctatatgttaaatctttttacaaatgctttgtatttttctaatgagtaattgtatgttttacttctaaaggtcatatttgattctttaaaatttttttttaattattggtagctcctttttacttgaacttatttgtgtgtatactttttgtttaaccatttctaggattatgcttccaaagcttatggctgacctaaagcttactctccaaattgcagttctggttttggcatttggcaacataccccaacagtaagcatgtgcttatggttgctagctcctatacagttattttactttattttgtccataagctagtaatcgtaaacacatgctttactttttcactactgtcgagtgtaacaatgcaacaagatgaacctaaggtttacttaagtgccagttgtttttgtagtgggagaatccttcaaagtatgtagtcttacatattgctggaattaaacatcctacagttaattttagctattaagatttccattttttatgttttttggaagaatataagtaaatgattgtcctaatttaatccatggaggaaaattataacaatttttaaaattttatactatcatggatacataatagttacacatatatatggggtacatgtgatattttgatataaacatacaatgtgtaatgatcaaatctgggtaaatgacatatccatcacctcaaacatttatcattcctttctgttgggaacattccaaatattcttttctggttattttgaaatatacaataaattatcacaaactatagttgccctatggtgctctcaaacactagaacttattccttctatataactgtatttttgtacacattaaccaacctctctgccttttctctcccaccttcttttcccagtctctggtaaccaccattctattcattacctccatgaggccaacttttttagctctaatatatgagtgagaataagcgatatttgtccttttgtgcctggtttgtttcacttaatgtaatgtcctccaattccatccctgttgctgctaataacaggatttcattcttatttaagttctttattcagaattaaagtattttatagtcaatggataaatccaactcttgattagtttatatgttctagggaggataagagaaagcaaaataagggttttcaaagttctttaatctggttagcacaaaggctacaggagttgaagtatgccaaaaaagaggtttacatttggataataagaagaggcataaagtaaaataaaattatagtcaaaagtgaggttgccttaggttcagcatctttaagctgatagtggcaaaggcaatggtcaattactgtaaatgtcattttctcacccttttcaatagtttcctgttttccagaattttgtttttttgatgtatcatgaattggatagtggagctttgtagtagaagaaatggcttattaactatgtgcagttactttattcattcatttctttactcatcagaaatttgcatacagtttgggaggcagtgggtaggaatgggagataccaaggaagatggaaaagccctgcttttcaggatttcacacgccagatcaaatggatttcataatcaaaacaaaaattatttcacttgattctaaattgctaactttggaatagttgtgtatatatactaattgagagccaaggtgatgtcattattttatttaaccatacattaagttgtaatttttatttatgtgatttatgaaataatgttatgaaccaaaataagtcaaagcattgtattttaattaatcaaatattaacaattttaattccctctattaggataaaggatgttaccatattatacagaaaaaagttcagtttagaaataagacctaagcggtgtgctcaccattgttccatctgtatgggcgcacccttctatgtagaagtaacttgccttgctgagaattaaaaagaaaattttatatgcgagtgcaatttcttttgtggcaccaaaactttatatataacaatttggggtctctcccgggattacattctcctccaggacggtctctcctctctcgtgaggaggcgcacccagccctagtgtggtggcctcaggggtgagaaatcaagacccaccccagtgcaaggaataacccgagctctcagcgacgcggatttaaaaaaaaaaaaaaaaaaaaagggaaaagaaactggccagcaacctagcttaaaggactctcacatactgcggcgaccactctgtgcacagaccaaggaaggagaagccgcgggagcgggtagagtaccttggtggtcaaattctggagggctaaatgtgtgtgtgcgtgaatgatcacaaacaaccctgcttgcagtgttgttcgtgtggatggtgacaagtcctactgctggacagtgtgagtgggtcctctttgcagttctaccttggcggagcggccagagaggacagcacaagtgggaagtgtgcaaaggaccttcagagggggaaagggagaaataggtcaatcttccaggacaggcaagacaccccctggtttgaggggttgagccttccagggcaagcaaggcaagacgccccctggtttgagggcttgagccttccaggacaggcaaggtgagacaccccctggtttacggggttgagccttccgggacaggcaaggtgagacatccctagtgttgaggggttgagccttccgctaatttcaagggttgaacttgacacaacccccccgttcaacccctttcctttcttctcgggagaagaaagagtagttgcactcccgcaggtccctaccctaggagagagagagacaggagagagagagagagagagagagagagagagagagagagagagacagacagacaggagagagagagggggagagagacagagaggagagagacagaagagagagagagagacagaggaaagagagacaggagagagagagacaggagagaggcagagagagacaggagagaggcagagagagacagagaggaagagagacaggagaggcagagagagagagaggagagaggcagagagagagagacaggagagaggcagagagagagacaggagagaggagagaggcagagagagagagacaggagagaggcagagagagagacaggagagagaggagagaggcagagagagacaggagagaggcagagagagagacaggagagagagaggagagaggcagagagagacaggagagaggcagagagagacaggagagaggcagagagagacaggcagagagagggagaggcaggagagagagaaagagaaaaatagaagtagtaaaaaaacaaaaacaaagaaaaaaaaacaaaaaaaccagtgtaccctattcctttaaaagctagggtaaatttaaaacctataattgataattgaaggtcttctccgtgaccctgcaacactccaataccaccttgttgtaagtgtaaacaagggcatagccagaaagcactgaggccactgacaacctgtagccttcctataaaaaatccttaacctagtaatctgcggatggccaaatgcattcaatctgtagcagcaactgctttgctaacagaagaaagtagaaaaataacttttagaggaaacctcattctgagcacaactcaccagtttagttcaggactatcctaagtcaaaaaaagcaaaaaggtagcttactaactcaaaaatcttaaagtatggggctattctgttagaaaaagatgatttaacattaaccactgaaaatccccctaacccagcaggtttcctaacaggggatttaaatcttaattaccgtacaaaggtccgaccagacccaggaggaattcccttcaggacaggaccatagatgtttcttcccgggtgaatgagggaaaaagacacaatggttattcagtaattgatagggaaactcttgtagaagcagagttaggaaaattgcctaataattggtctgctcaaacatgcaagctgtttgcactcagccaagccttaaacagaaccaggaaggaaccatctataccaattctaagttaatttggactaaacaaggtcttattaatagtaaagaataattaaaatcccaaacttagaaggttttcaagaaacgtagcttgctaaaagttagcagtgtaacacgtattatcctaacttttaatcttgtggccttagacagtctagtccacagacatgaaggaagttcgctttgaaaaagaatggttatcttcaagagggaaaaaaaaaagtggggtgggagaatttacataaaaaggaatgttccatggtaaattattgtcctgaaataaattaactgttttttttttttaaaggggatgtttgtgacaagtcagaaagttgaggcatgtcgaaaaaatatctctgaaagttgtgggaaaaaaaggttataaaagggaatttatgcaagaaatgttgtataatttaaaagtaactaggcctcctgaatgtaaaactatttattctataaacagtttatgtgcaaggtgtgtaagaaaagtaaaatatacttttggtaaaaagattgtagggaggcataagaatgtggatttttacctacattaacaggttaaaaaatatatattttgttttaaaggtttaagcaagttgtaaaacgttaattgtaaagaaaattgtgtgtgtaaacatactcgctaaagttaaagaggtatcatccagtttttctgtgaactggacagtaaaagcataacaggtttttcttaacgcactaacctgctctttaacaaaaattataaaaggttaaaaagagtctataaaatcttaccttagggccagacattaaaaattgaataaatatatctacaaagttttattaaaactaagtttaacattaataacacactaatataaaggtgaaatttagctcatcgggtataaaaatcatacaagaagcattatcaaatataaaatggtatttggctttctttggtctaaaaactaataaaaataggtgctaaaggaaatttctcagtaagaaggcaccaaggactataaagtcctctgcagatgtccccacacttaaaaggtcaatttcttagaaattatatacttggtttatcttccactttccttttcctcaaaactaaaagtcttttagcacaggtaccatccctagaatttccggtaaacgggaaccagcctgaagatcacgttcttatctagggtggaaagaaagaaaactttagcgatcctgggaaggaccctaccttgtgctgctaaccaccgagactgctgttcgtacagcaaaaaggggatggaatcatcacacccgagtcaagaatgtgccaccccctccagagtcgtgggccatagtcccaggggaaaaccctaccgaactaaagctaagaaaaatttaactctctttcatctattctattactctttattctttcctctatctgttgctgaccatctagttattaacataagcaagtcaattttgcctcaaactactgcatttaatgcttgcgttgttataccctgaaggaacttaccaggtcaaagacagttttctatttcagaaaaggaaaagtacctgtgtccctcctgactcttctcagactgggcattagtaaattgggaccatttaatccaaggagatttcgataaagacctaaatgtcaaccaggagtcttgcccccgatgtagagcttttatgctgtagttggtccaacgttctgtggcccactgaagagcaaagatggactgcaaagatggactacaaaaaccaactggtttttgtaatttcctaaaaccctacattcattttactagagaatcatagaagttaaagacttaaactttggcaattaagacaggataccaagatgcaaatgcctagttggaatggatcaaatattccgtccacacattaaacaaaagcaattgttacacttgtgcgcacggcaagccagaggcccagattgtcccctttccactaaggtggtcctccagtcgaccaggcatgggctgcatggtagctcttttccaggattctacaccctggagtaataagtcgtaccaagctctctctctctgctatatcctgaagtccggcaccctgcgggtcagcccccgagggccatccagcttccgtctcccaacagtaagttaactttgtgtctctcatgacagggaggaaacctagtgttccttagagacctgaagggatgcagtgagcttaaaaattttcaagagcttatcaatcagttagcccttgttcatccccaagcagatgtgtggtggtattgtggtggacctttactggacactctgccaaataactggagtggcacttgcgctttagtccaattggctatccctttcaccctggcatttcaacaaccagaggaaggaaaaataagacattgtaaagcaagagaagccccttataggtctttcgactctcaagtctatttaaacgcaactggagtcccacagggaatatcagatcagtttaaagcctaaaatcaaatagctgcagaatttgagtcaatattttggtgggcgaccattaataaaaatgtagattggataaactatatctactacaaccaacagcgatttattaactacactaaagatgctgttaaaggaatagctgagcaattagggccactagccagatggcttaggaaaatagaatagccttagacatgatattagcagaaagaggagtttgcgtcatgattaaaactcaatgttgtatcttcatcccaaacaacactgcccccaatagaagtataacaaaggcattgcaaggtctgactgctctatcaaatgagttagccggtaactcaggggtaaatgacccctttacaagatggctaaaacagtagttcagtaaatggaaaggaataatagcctcgattcttatttccctcgcagccgtaataggtgtacttattcttgtcaagtgctgtgtcataccatacatccgtaagtagatgcagaggctcataaaaacggcacttactaaaacctcccttaactatcctccaccttatccagagaaacttcttttgaaaaatcaagcaaaacagctaagccatgttaaaaaaaaaagaaaaaaaggtttgaaaagaaaactataaagaatacaaggggaaggattgttagatatgggttctaaatttcttttcaaagaattaatatgtcagtatgttcaattctttgccttttacttgtaaacttcctcgtgaagcaacctttttcgtttccctgactcatctgattacctactccaccctgactcattctgatcacctactccaccctaactcattccgatcacctgctccaccctaacacattctgatcacctgctccaccctaactcattccaattacctgctatctgctctgccctgactcccaacaaagcactcaccctgtcattctctttaaattagccaatcggaattagtttaacctgtgtggtctaaccctagccaataggggaacaacacagcagcaggggccacatgtgtcagggataagaaccccttcccctcccttgtccaagtgtgtgctcaccattgttccatctgtaagtgcgcacctttctatatagaagtaacttgccttgctgagaattgaaaagaaaattaaaaaaaataataattagacatgggcattgttactctaaagagcacctcgtttaacttttatgaatcaaagttttatcctatgttggtcctcaataaatcctatcatacttcccatattaatttctgtaagttaattagagtgacatcttgtgccactctcagtgttttgtttgtttatttttttttgtttgtttggcttttcacttctcactagtttcctaccctccagaatttcccatttttggagaagcgctaaaggcttagttctaggactgattctatgtcacaggggcaatgaagaaaataaatgaaaccagcatggcataaaatatagaagagtaagaggagaatataatgataagagatagatcctaggagtagaggcaaataatagtgtcataaaggaaagatttaaaaaatgaaaattaaaaatatgaattgtctcatccaaaatgggttagaaaattaatttaaaacattattattaaattgataattttaaaatctgcaatgttagatttatagcactggatctacatactatgtataatgtgaggatctttataatatcaggtagtcttgagttatattgggtaatgctgttaattagtatgttgatactataaatggtgttttatagttggtactataaatgatactataaatgagactataaatggttttactgaagcataaatgaataggataattgcattaccattcttgttgcattttctgaatgtatgttttctagagaaaatgctatgctatttcatagaagttcatgtgtgtcataaaaactaatcctaagtgttcattcatttctaatagtatccataagattaagtattatttaaatttttttgaagtatcaggttgctgaaatattagtctgaggataacaaaatccagtaatagtttttcttcctacaaaggtcatagttttatatgtgtgcatatgtgtctatgtgtgtgtatatctacaaattaattaaaattgttgagcatctcatcatgtgctagacattgtataggttatactttacatatgtttccaatttaaaactgtcatatgaaatttaagaactttcttataactattgagaggactacatatattattcaaatattatttatattttaaatatgtttttaaaagatattacgagccaagcacttgtagcacagactagtgcataattaaggtttctgatagatttggtgaattaacaaaaaattgttaagttggtagtgagctaaaaagatggcagggtaaattaacaaaaatggaaatacgtgatactccatatctcatcccttggaattatggatctgactacatcatcattatgtctggccatgacagcacaaaccaacaatttaacttcttttcgatctaatagtgtttggtacatgccataatcatattgttagttttttgggatatttcacagtgcaaacaaagttatgacagattgatcagaagccctgggtctggtaaaatagaatagccctggtctgtttttatccaggtgtcactaatcttcatgtttaactttgtacctgaaaatataaaataatagctaattgtgctttcccatttcatttatgtttcttcaaagaaccacaggatttttatgtttaataattcattttaaccactcttttccaatgtagacagtaggaaacactaaatgcaaaaatatgtgcagtaggtagtctccaaacatagacccctcaattaactacacctcctgctattcagttcctagtgtagttcctgctacagtgggtctgagctaatggatctatgagctttcttttagcattaattacttggaaacaattttcagtttcttaaaaattcagtttatttaagcatgttaatctgaaaatttctttattattttaagattagttccttaattaattagacattttttactgtagaatatttataaatctctgttctttattaaaaaacctgaaaattttaaattttagtttaatttatagcttgaatctagatttcaatttgtttattcttattttagattatgacttttgagttttcaaattctcattttcaaacaggaaaatgaatataaaaatgtagtgttgagggactgtttttccctctaagtctggactgtcacatgattaatgtaacataaaagtgattttatatcacaaaagtgataaattcccattcttgtgacatactgctaatgcaaaactttaatcactgtgccttcaataggaagccaaaatagtctgacttaaatttaatgtaaaataagtaataaccgctgataaactatttgacctagagtcttataaatgataaatgaggacttaaagctctaatttgtcccttcttaatggactatatatgtatataagtaactgatgtcattgcttcattcttggtagaatgtgctgtctgttctttgtgacatagtcacatggatggcagcaggcaaagagagaatgaggaagatgccaaaatggaaacccatgataaaaccatcccatgtcatgagacttattcactaccagaagaacaatatgggaaaaccgcccccatgattcaattatctcccaccaggtccctcccacaacacgtgggaattacgggagtacaattcaagatgagatttgactgggaacacagagccaaaccatatcaggcagccaagctaaagcttgatgggtaggcaggaggaagctaggtaagagaacaaggagaggctgtgccagcacatgcaaagatctagaggtcagccccaagcttttcagaggggccagggaagcatgcaaggagcatgcagtgttgacagctgacctgggccaggccatggagttcctttgaagccatgcttaggaatttaggtcattatctgaaggtacttcctcaaattccaactctctgaagcggcttagaaactttgtgcctggaaatatcattttttcagcacatgaaaaaacaattgaagtggaacaaaactggactcaatgatgccaagttgggaataaatgcagcaatctatctgggtgagagatgggcacaggttggctaagaaagtagcagtgtaggtattgggaagaatagacagatttggtacttatggggcaaatcttcatggttgattacgtttgtagtgtgtgtatgagaaacaggaatcttcagatgtttttggctgggttgacagtgttatcattcattggaattgaagaaaagatgaggggaaggttttggaggagaggatattattaattggtttatgacgtgagggaatttggatgtctttgggacatctgagtaaagctgcttggttaactgtcgtacacagaacactggagtttaggagaaacttgggaaaatgaaaagccccaggttgctgcaagggaatagggtctaaggggagggaacttggttgcaattaaggcaggaagctgcagttagttctttgtgaagatgttgaggatgtagaggagttggttaatcataaaataaggataatataaacatgtaatgagaaagattgaacacaaacatggaagattgtgaagatgagatgatgggaatcagtagaaggccagaagggacacacattgtgagtgataacctgatgagcaggatgtcacatacagtgagtttgctggcccatggctgtaagaaggaatcaatgccagaagctcttggctgaatgggggctgggaaagacttgacattctctcaggagtctgaatagatcatacttccaaagtcctagcctgtggtacatgcagaggctttaaatgcaaccaactctgccacacacatatgcattgtctgtgagctacaggctgctgtttacacaggcactcagaatgtatcagggaccagatctttgtatgatgagactcggggtagggtcccagcagtcataaacctacttttaggagccaaaactaggtcatagcctatattggttactggaaaattagatcagcttcgtgtgtaaacactatttcagggaatgtggtcctactcttggtggtgtgaatacagcatgctatataacacttgatgttttaggcagcattacttgacttgttttttctttttttgttacaccacagcacttgggtaaaatatttatatgattcactgagataaatgaacaaggcatttcattgaggagaccagccattgggctctggcagtcgtaggtctttcctggctatcccggggtgggggctaaagaggagcgttttgtattcttatatgagatggtcagttggatccagccacaagaggagacagaagagaggatcaggaaaacaaagttcattatactcatgatcttaaagacagggggcacagtaaaccatgctaactgggaaaaacaccaatgtggtcaggaggcaaaacataggagcaagggaaaaggattaggccagagcctttactgaggtttccacaggaagggcaaggcaggacagacttaacagtttagaattggctagtttgaataatttcagcaggctctaagctgtaagtgtggctgctggttgcctggtacctaactctgggatgattaaagcagaggcacattgactcgtggggtgtatgggcctgttaaaggaggtaaagctctggattggttagtttgcttatcaaaggcatgatcttggctagactttcctgtctttaagaattggctagcctcaggaggtcagaggtcaagcatcatactatatagaaaagtacagacacacacacacacacaatacaaggaacaatattttgggtatagccataacctatttgaggcaaataaactggaaaactttgctttagggggatacatgaatgttatcagggcttttgcaaatgccaggacttctgacaactgtttagtgtttttgctttcacagcttcacaatatcttatatagagaaaatggtgtcatacttctaagaaattacttttgtacaacatgcagggaactagacctgtttttctcctttttcactatagagtactcagtggcacatggatttatgtaaatattaaatggctataacttgctttgttaaaaactgttatagaactattcctgctgatttcagtgtaaattaattttggtaaaccttaacagtttctctttgtaacttaaattttttaaatagaaaatactatattcacatggcaaaacattcagaaagtatattaaggcataacgaagaaactaaaaatctataatcctacattctgaaatggtaattatgcataatttagaaacttacctttttacttatctataaaaatatatttttatatgagtaaatgtatatgtaatcatgtcaatcaaaaatattttcctcctatttttcctccttttataaacaaagatcaaatttagaaatttattgtgtttcaattttttttttttttgagacagttttgctcttgttgcccaggttggagtgtgcagtggcacgatctcggctcgctgcaacatctgcttcccaggttcaagcaattctcctgcctcagccttccaagtagtggaaattacaggcatgctccatcacacccagctaattttgtatttttagtagacacgatgtttcaccatattggtcaggctggtcttgaactcctgaccttaggtgatccacctgcctcagcctcccaaagtgctgggattacaggcatgagccatgtgcccggcctacagcatatatactattaaacatgtatacacatatatgcatacatggtatttatagatatacatggatatttatatccatctacacacacacacatatatatatatgcacacatgtacacttctacccacaaacatacacacattactataacaagagcatccttctctgttaccaggatctggagctcctaaaggatgttcccaggtcattctaggagatttccagggcatggtctggaggatttccaggaagaggtttcacttataccttctatcatattttacattctcatttatactaaaaattttggtttgataatatgtttgattcaaagagctgtttgttattctctaattttttcatgacttcctatttttctctactggatcttgatgaatgcagtatattcttcaagggtaataattagatttattttgtatggtcttttgatcctggcactactcttttatgtggaatcttgcttttgttttttaaaatgtgttttattgtctcctgtaatgcttcaggattactgtaaaaggcttctggttattgattttatgtttacttttatgaatggctcaatgtaaaatctgagttgaatccctacatagattacatggatatgtcctctggaaagctttgtatagatgagtggataggcagctgatcattgctctgggtcttttaaaagccagaattctgggagcattgcttaggggcaccatcaactatacaaattactgattgatttatttcttactcttacccagtatttgatcaatttctttagaaaggaaccattttctcccaaggtctaaaagcctgtttcctaatgctgctatgctacaggagtagtatggtaggaatagagagagtgatgaggactgggaataaaaggggtaaactgtcctgtgtagatcaatgaatcctctactcttagctcctcttctcactgctgtgagaagcttacctgtttttttcctagtgctattttctgtgtggatatgcagatcaagtgagttgtctctgaacaataactccttcctgaaaattctagtctatggttcccccttgtattctcagtcaatatttttcaataactttcatttctcaggaccttatgttgttttctttgtatttgtacacattttaatttttctttacattaaatattttagccgttgccctttccacgctcctcattatgctgccttttttactccctaatatgctcatacagaaggtcatcttagtagcactaactgtggtcaaatgaataagggatgaagaagaaattatttatagaaaaggatcacatgctgagatttgtagtactcgtgtagcacttaacaccaggcaatacatatatgacatgaatgtctggcaggcattcaagatataatgatgtccaataacattgaaaaagaacacctttttaaaaaattaagattgtttttctcttgaaaataattttgcattaaaagcatgtgctacttttttttctttgaaaagaattcacattacatgtgtgctacttattgatatatggactacattgtggtttgccatattagattataggttttgaaccaaaagtatgatttaaaaggacatgttaaaaataaataatgaagagagtttaataatgtaagagatccgtatgaacaagtagtgctaagtatgtatctcacttcagctcctgcagtgggactttcacatgcaaatagatgcattatgggtaccagttatatgtagttatctcccttttcctcaagtagatgaacgtatgacaggttgcatttacaataatccctatggataatatttttttctaagtatatacaagatatttttttatacctttattttatcaaacattaagcaataactaaagcaataaacattggtttacaattttcatttatactgtatctcagttgcaatgttgcctagcatgtgacatatcttccactgacatttgtaatgcatgtcaaaataaaaatgatgtttattgctttcttggaacttactcttcacggagaataaaccctggataaatgatgcatttgatctgatgatgaaatataagaacagtgatatgtattgtttggaataatccatcaaaagacactgtcagtgtatccctaaagagtgtgcttatactttatatgttgcatttttcttcagaaactgactgatagtacctgtttttgagatgacaaaaagagaacagaagaaaatgggttgctacatgaagcaaaagttagtgcattattactcacaagtagtgttattgtaaactggaaggcacatatacacactttcactctgaaagtcaaaggccaagaaaatattttagaatttgcacagcagtgaaggacgtgaatatgtatggaaacatgcaagttgccttaatactcttgaaggaattaaataattgtcttaaggccatatattgtttaaccatggtttattctgtgttatgtaaaattcttatagttcttttaataacctaataccactatggagtttctagaagcaatacatatttgctatagaatggcttatgggttagttttagtaactttttgttagttttttaaattctttttaaaaaattaatcactcttttgcattccaaaaaaagaaagcaatacccatcatgcatgttcacatatacacatacagaatcactagtctgcttgtttggtatgtggatgggaaaaacagaaattatactgatggcagcagtggcccatctggagtggctgctgtgaagacaatggctgcagcaggggaggtgtggccagggctgcaggagagtcacagctggggctgcatcctcccagagccagcaggcctgaaacaggcgggagccttgcctcctaccaagtggtggagcaggagccccatgctctgggcacagctgcagccacccagctgcagctctggacctgggcatccatatactctcggggtcccaggaagccaccctgcccccacaggcttggaagtgcctgttcccactgtctggcctttccctgctcctggcacccactttggggcagagcaaagttgtggctgagcccaggtgctgttgcaacccagccaggtgtgcgtgtgcttggggtggtgccgactcaccagtcccccgccatttggccccctccagacattgggcaccaacaaacacaagagagaggccaaaggggtactgagggtggctcagctcaggtctgcaggtgccccttggcatgaacagcctgggtgctgtggatgacatgtagatggtggcaggaggcagacaggctcctgggcagaaaaatgtgggtccctggtgaagccccaccttcaagccaggcatggcctaaagcctgggggccaggctcccaattcccagtggagtccacaactgggagtgaggacttgtggtgatttttctgggcccacctatggccacccaaggaccaatcagcacgtatttcccctcttctgagcccataaaagccccagatggacccagccagactcacacagacattaaaactaccagctgtgggaaggagctacccaatttgggtctcctcaactcattcagacaacctgcctgcagataggagctacccactccagatctctgctgagagctggacactcatcaggacgacctgcccgcagaaaggagctacccactctgggtctcctctctgtggagggctggaaacgcattgggctgacgtgcctgcagaaatgagctacccactttgggtctcctgagagctgttctctgttctgtcacccagtaaagttcctctctgccttgcccatccacctaccagtttttcatgtacctcattcttcctggatgtggaatgaactcgggacccactaactggtaggggactaaaagagctgtaacccaaacagggctgaaatgaccccctgcttgccactttgcaggtgatgagaaggagagaagagctgtggcccttcagggagcccagacctagaagctccacgagccagtgctgtgacaccctctttggggctgtgcagtttcagatgtttccaagcatccagacgccactgaattctcatccagatttgggtgcccacagcagaagttgcttggagtgcatctgatccagctccaggcttacacagatccagtgcctgtgccagtgcctggagctgcctgccccactgcagcagctggcatgcctggctgtgcacagtggctggacctggttctcacttgctcacacacccctcacctctctgctcctggcttgcctttggctggtgtggaatctgggctgtagcaagagctgagcacagcctaccaggccgagtgggcagaatgagcccagcaggcccaagcaaaacttgggcaaaggtaccaccagccacagaggtttctggctggaaaagtgacaccctagggatcctgtgacagtatcagagttccttccccttactctccttccctcccaccctctgtacacacaagaatgcaattctctaatttctgacccaagatggatgattcttgtaggctgtgtaatttactcctttgctgacatggaattaatggttcctctagatgaaggattagccctgttgctaccatttttcccatctttgtgtaacctgagaactagcatttgacatccaagccttagcctcaagatacagatataactcaactaacagcatccttagtctatgatgacagcttagacttctaagtacttttctcttccctgccctagcagggatttccatgacagcaaggctgtcttctctagtcttcctttccttaggctgttacttcaaacactagaagcttgtcttttattgacttattttctcacaagtcagacagaagtgtaagggtttggctactgttgatataaacttttatctcatttagggagatgaatcattcttctctctggattgtgttaaccaggaccaaatgatctcttattttatgatagattttgatccagtacattcttgctatctaaaacctgaatgttcatctacccttaacttctattttttcatcaagggtagaatataatatgaagaaggaaattcctattcctagactgaaacttgcttcactttctttgtgtgtagctcctaacattagatataaacaaatatgtaattaagaaatatttttaaatagggttaggttaccttaaaattaatgatacaggatagcagtgtgttgaaaattagaccctggagagagggatggtgcctgtactcagatgctaggttggtcacatactagctgtgtggccttattcagttacatagattctctgtgccttagtgtcttcatttgtaaaagggggataaaaattaaatctgctgcctttggttgttgtgaatcttactgtttcagacaattctgtttcaactattagctgttattaatcatgatgacaatactaacactattaacgaaagacagtttgtatatgtcatttcattttggttctttcaacaatgctgaaataagatatgttattctcattttttaggtaaaaatactaaagcccaggaagttttattaatttttgccaggtcattcagtccgtctgtgtctaaactaagctcaaatttaagattctccctcaaaagccttttttctcgtctgcaatagatagtctccctttatttactgacttttgttataatgaggatcctgggtgaaaactagtattatcagagatatcttatttttacagagcatttcagcagagtacatttcctacattcatagttggctgtacaggttattgaactttatgatatgatgcaggaactcaaagagcactttccatgacaaacttaatttcctcatatacttattctagtgatacagagagaaaggaagatgaaggaagggattctttcagggggaaataagtgtagtcaggatgttatagtgaacactttgatcctcaaagggtcagcatgagaaagaaagttgtgagaaggaatcaaatgttaggcagatatatgaggagggaaattttcaaagacactcagttccttcataaagtagtttagtcaaaataattgttattagaaggattagaagattaaatgactttaaaaaatgagttaatttatgtgcaagaatatgtctttttaccattatagagatttgaatatatatttaatcacatttattttttaaacccgactttatgaactaatatgaaaagatggacacattgttcttttcttagcagagtcatattaagatatattattaaaacactctcaattagtaaaaatgagatctttttatggctaatttactggagttatctttttcttagatatcagagcttattttaaagtgtacttcttaataatttaataacccatctttaactttgaacatgttaattttctgctaccttaatgactctaatggcataaaaaataaatagtacatttatgcaccattaagatctggctgttgttctgtttcatactgctgggaactcatgctagagatgctatagtccttacattttttaaagatacccttttacaatttgagctttgagaatccagaattttaggggtctttttcaggagtcttgttcttctcctaggctctgggcttaggaataaaacctctactgagctgggaacccagccactgagttatattcatttctttgccatggcctttggggagaccttatagtttggagagcctttgaaaagaagcaagatttgttgtattcactgtcaggagtgtgtctagtgtttttgtcaggaataagggatatactcaaagtaagagtatatatgaatgtgtggcaatatagccaggcacggtggctcatgcctgtaatcccagcactttaggaggctgaggtgggcggatcacgaggtcaggagattgagaccatcctggctaacatggtgaaacctcgtctctactaaaaatacaaaaaattagccaggcatggtggtgggcgcctgtagtcccagctactcgggaggctgaggcagaatggtgtgaacctgggaagcagagcttgcagtgagccaagatcacaccactgcactccaatctgggtgagagagtgagactccgtctccaaaaaaagaatgtgtggcaatactacattagtgcatataaatgtgtaggctgggtatggtggctcatgcctgtaatcccagcactttgggaggctgaggtgggtggattgcctgaggtcaggagtttgagatcagtatagccaacaaagtgaaaccccatctctactaaaaatacaaaaaaattaactgggtgtggtggcatgtgcctgtaatcccagctactcaagaggctgaggcaggggaattgcttgaaccaggaaggtagaggttgcagtgagccgagatggcgccactgcattccagcctgggtgacagagcaagactccatctcaaaaaaaaaaaaaaaaaaaggtgtgcaaattgttgcaggaaaagtcgtgtatttccatttctactatactatcagcattatatgaatattctattaacattttatgagatttctcagtatactaaatcatgccttttaacaattaaaaattttatttcacatgctgacatgacattttactgtgttaaaagtggtggcattcatgctccaataatagaaaacagggctccatggagtaatagctgatactaagcttgggccaggaaacatacaggttgagcctggagcatgttgtagtgccaggaagcattttctcattccatattcttaccaatatgtgttatcatatttgccaataggataggtgaaaaatatttgctattattattttaactagtatttcttcaattattaattaaacatttaaatatatttattggccactggcagttttcattttatgaaatgtctgcacaatattctgtacttattttcagcctatatgatttataaatgatctttattgaagaaggacactaattcttgtcttgtacattgcaaatatttttggcagttttctattattttaaatttgtttatgataatgttaaccatagaaactttttatttagccaaatttaccactcttcttactttttggatttttttgtatttttataagaaaacgattctcatttgagattattgaaatgagcacccaaattttcttctagtacttttatagttttatattttatatttatatctctaatttatctggaatttattattgcatatttggtgtgagcttgcaatctaatgattcttttttcctatggctaataaatggttcatttttcaacaatccaagtagattttagaaaatctacaacctacacagaccaaaaatattcttgatatttgtattatgtattatcactgctaactagtttttataatgatgatgttttaattcttatttttgcttctctggctagaaggtagatactataaccttctcttctcctatactaccatcatctctttaaaacctcattaactgttcttaaaagggtgaactgttctctaaaagcataaatctggtgtgtgtgtgtgtgtgtgtgtgtgtgtgtgtatgtttatatttaaaaggatgaactttttcaaaagattattctgatacatacacacacacacacacacacacacacacacacacacacacacacacagggctacactctataggatcctttatttgatattttgctccatgaataaataaccaaagtttttttcttatgtgaatggagttaactattaaatttcaaattatttttctttccttttaagattataggtttatttcgccttttgcctaaaaacaaaactagtgaaaattaaagtataaaaataaatacagtttacattaatggacattccattcaaagtaaaaataatgataataatacatcaaaagctcacagcattgtctggcacctgtatgagaaaaagttgtgaacataaaataatatgcaaaatacataggcttttacttttaaattatatcacactcaagttgctcatccttaatctaaagctaactttaactttctccaaaacatactatttgttttagataatttgcattagtatacccaaaacttttagcatctttcttactggacagacgcacagtgatatgagtaagctgaatccttagttttttgtttatcacatttagaagataatttcatatactttgcctgtaaatttaaaaattagtaactgggatttttttgactggcttctaatttgatacaccttgcctgtaaattttaaaatggtaacttggactgttttgactggcttctaattttctggttcactcattctatatgcaatacatctcaataagaaagtcgagtttacatgcagggtaaattatcattttctgtctataggtggatgtgaaagttaaattttaggtggaacagaaaaatcagagaaaatgatctttatctacatattctcatcctgaaagcaaagacagcaaggaccaagttgctattcttcagaaagagttgatatattaaattataaggatattttccatcatatctcaagtctggttgtcaaaactgagcatcttatctgctttataatgactttttaagaaagattgtttttctggaaagtggctatcagtaaaatattcagtgtagatttaattttctttgatggatatataattaatctaaaaattagtacattgtatttcctaattgtgatattgagggaaatagtactaaatagagaatctagccctggtctcttatgtagttaaacacatcatcaacagctaatatagaagatggcagagtagagggttttctagagtgcctcaccaactctgaagaagcaaaatagtgtgtagaattcacaatgtgaaactttatccaagaaggcacacaggaattcaacataaagtgaataagaactttagatattggggaagagaaggtaagtgggcagcctgtgtggtggtgtctgactgagagctgtgagtgaagtcccaatataggagagggagaaaaagtactcctctgcaatccacatttccactggggagccgtacaatccaggctgtgagagaataccttgcccttcccaagccctgaatctaaattggagagaggctaaaacactatgagaagggacatcactaggaagcaccccaagcattttccagtacttgggacctgatagaaaaatgtgattctcaatcctagctcatacaaagccaggtgggattctgtgatctagcagcagtggcagacttgggcattaaaggagcttggacaggggattgtaatgctgggtttggggcaacagaggggctcccacagccaaaactgagagatgagtgtggcatttgctccagctgtgggcattttaatagggctctctcccttcgtgggtggagcagaaggagatttgccagagaggcatggttttgtcccggtttcaagttatacagctcagtgtgactttgcagactaaaggtatactgcacatgactttactgagtgtctcaacttgctccctttattgggttggggagtgaaccctgccaggtctaaagaatgagaggagaaggctgggcatggtggctcatgcctgtaatcccagcactttgggaggctgaggtgggcaggtcacgaggtcagtagtttgagaccagcctggccaacatagtgaagccctgtctctactaaaaatacaaaaaaattagctgagcatggtggcaggctcctgtaatcccagctactcaggaggctaaggcaggagaattgcttgaacctgggaggcaggggttgcagtgagccaagatcacaacactgtatgccagcctgggtgacagtgtgagactccatctcaaaaaaaaaaaaaaagagtaaggagagaggtgggtcctatattcgtttgcctagattaaggactgggctgcctctgccttcctgtgccaacttgatacagcaataattgctctgtctcaggaataattgcttctccctcaggaatatctccaaggtgcctgcccgttgctcctgaattcccaccagagatggtgcttttacacaccattgcagggcctgagtgcagaatttccctgttgccctttccagttccacccaacttgacccccaccaccttcccacaatgctggaccacaggacccagatcattaagttgctccctggcctagctaattgcctgggacaatggattacttttctgattgaaaaagatcaagtataaaccctattgctatcaccacagagagatcttacctgcaagcaagaactattggcctgaagttcggcctacacaatccaatacaaaatttactggcagaagtgcatagcatttggaaacaagataagtttcacataacatttgctaccaccatcttccatgacacctcagcttctcaggaggacatgagtctgctcacccacctggtacaccactactacaaccaacatttgagaaagctaccaccctaaggctatttataaccaaggaaattccacagattctttgccgttgaacacacctagaagcaaagccaaatggctctactcagtatacatcatagacacattctcaagaaaaaaataaaagtcctgcccccaagaaaataaattcaaaaataagaagtgactgtttctccaaatgcaaataaattagtgtaataacataggaatatgaaaaagtaatgtgtaatgatacacataaagaaacacagtaattctctagcgacatgtcctaactaaaaagaaatactcaatattccagataaagagttcaaaatattgatttttaaagaagatcaatgagttgcaagagaaatctgaaaaccaatacaaagaaatcggagaatcaattcaggatataaatgagaaatttaccaaggagacagatatcttaaaaacaaacacacagaacttctggaaatgaaaagttcattgaaaggattacaaaatacaatggaaagtttcaacaatagatgagaccaaaaagaaaagagcattttggaacgtgaagacaggtcttttgaattaatcgagtcagacaaaagtgaaaaagaagaaaaagaaatgaagaaggcctttgagaagtacaggattacttctcaggttagcaagcttttctaacctgtggcccatgggctgcatgcggcccaggacagctttgaatgtggcccaacacaaattcgtaaactttctgaaaacattatgagattttttttcaattttttaaaactcatcagctattgttattgttaatgtattttatttatagctcctgacaattattcttcttccaatgtggcccagggaagccaaaagattggacacctctgacataaagtgactgaacttacatatcattggtattcacaagagagaagaaaaagcaaaaagtttagaaaacctatttaaggaagtaattgatgaaaacttcactaggctagcaatatatttagaaatctagatacaagaggaccaacaaacaccagaaaatatgcagcaagatggacttccaaactacatatactcattggaatgtctaaagtcaacacaaaggaaaaaaattctaaaatcagcaagagaaaagcatctagacacctataaaggaaactctatcagaccaagagcaactttccagcagaaaccttataaatcaaaaaagattggatcctattttcaaagtgcttaaagaaaaaactgccaaccccaaattttatatcttgccagaataagcttcataaatgaaaaagaaatagtttttctcagacaagcaaacactgaggaatttatcaccagctctactagaaatgctcaaatgagttctaaacatgggaaagaaaggttgatatttgccatcattaaaacacattaaaggataagattatcaggttttataacacaattacccaaaggaagaagagaaagaaatcaaatggtagcataacaggactccaccaaaccagaaagacaaacggaggggaaaaaaaagaatctacaaaacaactagataacaattaatattttgacagtcagaaaacctcacatacaaataataaccttgaatgtaaatggattaaattctccacttaaaagatatagattggcagaattgatattaataaaaccccaaaaccaactacatgctgcttactggtaaaaaaaaaagatattccatgcaaacagagagcagaggcaagcaggagtagctatacttatatcagataacacatacattaaatcagaaactgtaaaaaaaaagaaaaagtcattatataatgataaagggattaattcaataagagtatatatcagtcctaaatatatatgcaccaaacaccagaggacacagattcataaaacaaatattactagacctaaagaaagagatagcaacacaataagtgcaggatttcaacaccctacggacacactataaagattatagagacagaaaaacaacaaagaaacactggacttcaatgaaactttagaccaaatggacctaacatacatttatagaacattttactcaacaacctcaaaatatacatttttctcatcagcgcatgcagcattctccaagatagaccatatgttaggccacaaaacaagtctcaacaaattaaaaaaaatagtaactttatcaagtgtcttctctaactatagtaaaatgaaactagaagttaataccaagcagaactcttgaaactatagaaatacatagcaatttaaaaacatgctgctaaatgatctttgagtcaatgataaaattaaattaataatttttttgaaatgaaggaatatgaaaacacaacatatcaaaacctttgggatacagcaaaagcagtgctcagaggcaagttgatagggttaaatggctgcattaaaagaagaaagatcacaaaataacaacctcacatcacatttgaaggaactagaaaatcaagatcaaaccaaatccaaaggtggcagaagaaaggacaaagatcagatcagaaccaaatgcaattgagaccaagttaaaaaataacagaagatcaacaaaatggaaaatttgttttttgaaaagataaacaaaattgataaaccactagctagattaaccaagaaaagaagtgagaagatccaaataaatgtaatcagaaatgaaaacgaagacattacaactgttaccacagaaataaaaaagatcaccggagacaaccatgaacaaccacatgttcatgaattagaaaatctagagtaaatggctaaattcctgggaacatacaaatttccaagattgaactaggaataaataaaaatcctaaacagaccaataatgagtaatgagattgaatcagtaataaaaaataatctcccaacaaataaaagcccaggagaagatagtttgaaattctggttgctgaattttaccagttgtacaaagaaaaactgaaacccatcctccagaaactctttcaaaaaattgaggtggtgggaatctttcataattcattctattaggccagtatctccctgataccaaagaccagagaggacagcactaaaatagaaaagtatagacaaatatcccgagtgaacaaagatacaaaaatcctcaacaaaataatagctaatcatatccaagagcactccaaaaagataatacaccatgatcaagtggttcccccactgccagggataccaggattgttcagcatttgcaaatcaataaatatggttcatcacacaaacaaaattaaggacaaaaccatatgataatcttaataaatgcagaaagaagcatttgataatttccagcatcatttcgctataaacaccctcacaaactagtcatagaaggaacatatcttctataataataaagggcatatatgacaaatccatgaccaacatcgtactgatctgggaagagtttgaagcaatccctctaagaactagaacaagacaagaatgtgcactttggccaatcctattcaacttagaatggaagtcctagccagaacaatcagacgagaaagaattaaaaggcatccatgttggaaaaaaggaagtcaaattgtttctattcattgatgatcttatacttgattagaaaattctaaagattcctccaaaaactcttagaattgataaatgtatttagtaaagttttattatacaaaatcaatttacaaaaatctgtagcatttctctgcaccagtaatggttgagctaaaaatgaaatcaagaatgtaatctcatttacaatagctacagaagaaaaaatagttagtaatatatttaaccaaggagatgaaatatccctacaagggaaattacaaaatactgatgaaagaaattgtggatgacacaaacaaatggaaaaacatcccatgctcatggagtggaaaaattaatggtattaaaatgaccatatacccaaagcaatctacaggtttaatacaattcctatcaaaataccaatgtcattataaagaattataaagtataatcttaaaatttatatggaatcataaaagagcccaaatagctaaataaattctaagcaaaaagaataaaactggaggtactgcattacctaacctcacattttaccacaaggctatggcaacccaaacagcattgggaaaggacactcttcttttttcctttttctttgtcttttttttttttttttttttttgagacattgtctcgttcttgtcaccccggctagagtgcaatggccctattttggctcactgcaacctctgcttcccaggttcaagtgattctcctgccctagcctcctgagtagctgggattacaggcacccgccatgaccggttaatttttttgtatttttagtacagacaggatttcaccatgttggtcaggctggtctcgaactcctgacctcaggtgatccacctgcctcggcctcccaaagtgctgggattacagacatgagccacctcacccagccaggacactgttttcaataaatggtgctgggaaaattggatagccggatgcagaaggataaaactagactcctatctctcagcatatagaaaaatcaactcaagttggattaaagtcttaaatataagacctgatactattaaaatactagaaaaagacctaggaaaaatacttctggacattgatttacgcaaggaatttatgactaagacctcaatagcacaagtaataaaaacaaaaatagataagtgggacttaattaaactaaatagcttctgcccagcaaaggaaataattaacagagttaacagacaacttgcagaataggagaaagtatttgcaaactatgcatctgataggggactgatatccagaatttatagggaactcaaacaacaatcaaaagaaaaccattaaaaagtaggcaaataaatagatatttttcaaaagaagatatataaatggctaacaagcatagaaaagatgctcaacattactaatcatcagggaactgcaaattaaaaccacaatgatatgtcatctgacgtaagtcagaatatggccagttataaaatggaaaaaatataatagactttgtgaggatgcagagaatagtgaagaaacatttagacactgtttatgggaatgtaaattaatacaaccactatgaaaagctgtatggagacatctcaaagaactagaaatagaactaccattcaatccagcaatcccactactaggtatctacccaaaagaaaagaaattatcatataaaaaagacacctacacttgtatggttattgcagcactattcataataggacagatatgtaatcaacctaagtgtccatcagtgatgaataaataaagaaaataatgtacatattttctttatccaatggaatgctatggaatactattcagccataaagaatgaaattgtgtctcttgtagcaacatggatatgtaatactgtatacttatgataccatatcattaaaaggatatgatgtcattgtcttaagtgaattgcaggtcattatcttaggtgaaacaatgcagaaacagaaagtcaaatgctgtatggtctcacttataagtgagtgctaaaaaatgtatgcacacgtacatagtgtggaataatagacattggagcctgggaaaggtgggtgagtggaagcaggggtgagggacaagaaattacttaatgggtacaatgtacattattcaattactggttacgctgaaaggcccgacttcacctttacatgatatatccatgtaacaaaactgcacgtgtaactctttaatttatacaaataagaagagaaaatattgtaatcctgttagaaaaaaatgtaagaagttaatatttaaaaagcaaagggataaaagaatttaaagataccaattattctctttagttattgaacatttttcatccatatggagctcaatataatttagtttaatatttattaaatctaaaatgactgataaaagacacattgttcaggacagaaaacaatctgaactcactttactatagcaaattatcagttttaatgtgttccattaaataacgtagacataaaatatgtattaagggtcaacgttaatcatcttaatatatatgccaaggctgtctttataatcccggtactacttgctatctatataattttggacagttaacttaagcctggtctttggaactagttcatgtttcatttagttacaccatattccccagatattccttttattcttcatattacttagatgtcttttaattcctatatactcattaacttagatgactgagaactacactaagtaatgctcaaatttctagtcagatgtagccaaaagtacattgggcttgcagtcagaagccctgagtttcagtccaagctgttatttattaggtgtttaatgttaaatcatttaatcacatttttctacagcttcttcatccgtggtgtgtaggatgtaagtaggaataaattgggcaattaaaaacaatttctagcggttttcacatttaagagtgaggagaaatatgtgtggctaacggattgggtagagtgggatgatgcaaaagattagtcttgttttcctctgaaagcagttaaatttatttgttccccatatggcaagcaatggggatttgggggcagttagaaaaatgtgtaatactgtagacttatgatagcatgtcattatatctacacaattaacacaaataaaacttctgttaatataattgtatcattggattattttactcttatcattccattaaatttgtttcaatgtattgtccagtcaagtagctcatgagtttatttgagggttggaaatactgattttattgtattatattttatacttcatattacccacaccttataattgtatatatttaataaatcttgagaaattaaattatatgaattcactttctttaaaaatatgtagcttattaatagcaaatctttatcttaaataatgtttctttccaaataccatttaatttattttcaaataattctaaatttcttctcttttatgggaacatttgcattgggtgtcactagtggcactcctgtaataaatcttttagatatttttaatttccagtgttttaattctcagtatatgacatgtaatactacgcaaaaatgataaactcttttttttttttctttgagatggagtctcgctctgtcacccaggctggagtgcagtggcatgatctcggttcactgcaagctccgcctcctgggttcacgccattctcctgcctcagcctcccaagtagctgggattacaggcacccaccaccgcgcccggctaatgttttgtatttttagcagagacagggtttcaccgtggtctcgatttcctgacctcgtgatctgcccgtctcagccttccaaagtgctggcattacaggcatgagccactgtgcctggccaaaaatgagaaactcttagtctttaagcattgttatgaaaggtaagagatttagaatcacattgcccatgccttatctcttactaactttgggaccctgggaaaattaatttatctgaccttcaaggctcttatttataaaatcagcattataatatcccatttttgaaaataacttttaacgggttaaataatgaaacggcttcaaagcatttagtcaggtgcttagcacatggtaaacctttatgttgttactactaataaaatcctcctgcattttaaagtagtttcctaaaaaaatcttttgcctctaaattttgtaagctttttgttctcacttatttcaacacaaattcagccattataggggtgacttcaatgccctcacaaatgattcattaatacctcagtcttacagatgtttgacttattctgctacagtgacctttactttttaccccaatcccacaatcattcctcaatattatacttttttaaaaacatactcagagaaacatggatgtttgagctaaaaacaaaatgcaataaacttaatttactttggtatcaaagtgctctccctgcgtatttatattattcttcctgctctttctttcaatgagtaagcagaaagtataggtagttttcattagttaatacagtaaatagctctgtcgctcttaaactaggttcttttggttgcaagtggcagaaacccatctcaaaccaagtcaaaactcatttcagagtagcttagttttagctaaaagatggaaaattattgattaatgttacagagaggcccagtgctggttttggatttagggatggttgcatctgagaggttcaggcagtgttgcttactttgtctctctttagctctttatgtctccttttctgtctttgcctttcaatctaccttaacgttttggcttttttgcctgttatcttttatttttagacaagtactagaaggaagactcctggctatcttagccctatatttatagataccagaaaaagtggtaacctattattaatagctctgccaaatagtctagtaaaaactttgattggctctgcttaggtcatgtgccaatttttgaaatagacaacaatggccaggagtggggagtattctgataggccatgcctggttcatgtgttcaattcaaggcgtgaggatgtgagatttatttaaacctgtgatggcaagctagggcccactgcttatttttatataacaagttttatttgaacatagatatagccatttatttacatattgcctatggctgctttcacactaaaatggttacagtactgacaatgttacccacaaagcttaaaatatttgctgtctggttctttacagaagatgtttactactgttctaggtagagttcaaagatgatccccaataactcacgtccttatactgtgagcaaaaccttccccttgattgtgggcaaaacctgtaagtatgacgagatggtactcctgggattatgttactttatatgtaaaaggggatttttacagatgtaattagtacccccaatcaactgagttaatgaaaagaggctatcttgcataggtctaacctaatcagatgcatttttaaaaagagagtgtagaaattagaaatggaggcagtcagagagactgtctcctaatggcctgtaagaaggtaaacatttatattgttaactttctgtggcgccatgtgacaagggactgtgggtaactacagggagctgattgttccctggatgatagctggcaagaaaactggaacctcagtcatcacagctgcaagaaaattaatttggctaaccttggatgaagactcggagactcagatgagaattgcaacctggttaacaccttgatttcagcctggggagatcatgaatagagaatccagtcaattcctactcacactcctgacccatggtaactgtgagatgataaatttgtgttattttaaaccaataattttgtgataatttgttactcagtaacataaaattgacatagactgttgtacctgaagttggaatgcttctgtaaatatcttaaaaaggggagcggctttggaaccaggcagtctgtggaggctttggatttttaagaagtatgataaagaatatctaaattgccttaaacagaccattagtagagataaggatgttgagaatactcatggtcaggacttagaaagaagtaaggaaattgttatttaaaactggaagaaggggaactatcattatgttgtggcagaaagcttaatggaattatgtcctgcagttaagtggaaagcagaacttgtaaatgatgaacctggatgaaaggaaatttctaagtatactgttcaaggtgtggtctgttttcttcttcctgcttatggtaaaaatgaaagaggagtaagataattaagggaagaactgttcaacaaaaaggaatgaagtctgcatggttttgaaaatcctaagcctctccagatgatgaaagatgctaaaagttagaaatggctatgaaaattatgacattggttaaagaaattgtagataaactcagaattaataagtgaatttagcaaagttactggatactaaataaataaacaaaatccaattatacacttagatttatgccacagaaattaggaaacttgaaaaacaaaatgccatttacaattacaaaaaactctatgataatttatctaataaaaagtatacaatacctctttagaaaagtgtatacatttttgtttagaggacataaaattttataaataaatggagaaatccaccataatcaggagttggaaactctgatactgcgtagctgtcaattttgctaggctaatccatatatctatataatctgaactgaaattcctgcagttttgtgtgtgtgtgtgttgttagcaagcttgccctacaatttaattccatgggccatgaataagcaatatcaactcaaagaagcacaagttgggaggcattttctctatccgatatcacttattttaagaccagaataatacaggaaaatagacaatgtaggctgggtgcagtggctcatgcctgtaatcccagcactttgggaggctgaggcaggcagatcacgaggtcaggagattgagaccatcctggctaacacagtgaaacctagtctctactaaaaaaaaaatacaaaaaatttagctgggcgtggcggcgggcgcctgtagtcccagctactctggaggctgaggcaggagaatggtgtgaacccaggaggctgaacttgcagtgagccaagattgcgccactgtgctccagcttgggtgacagagcgagactccatctcaaaacaacaacaacaacaacaacaacaacaaatagtcaatgtaacagaataagaagatgagaaagagatccatgcatacatggtttattcatgagaagtgtggtactactgagtagtgataaaataacagtacttttaataaatgatttaaataaatatgcaatcatttggttatatgtaaaaaatgaaactttatccttaccttacaccatatacaaagaataattacaggtttattgcatatctaaacatgaaaggtatattaatatattcttgaataagaaaggatttcctaagcagataatcaaaagcattaaccaaagagcaaaggtaaatgaattaggttgcattataacttagaaattaattccatcaaatgacacaactaagagaaggaaaagttaagccccagcataggagaagctatttgcaacacatctaactggagctaaatttttatagaattttcatgtattataggtggatgaataaattggcataattagtttggaaaactgccttacctactaaatttggaaatatgcatacattataatacagcaattccacttctggatacctgcatacaagaaatatgggcccatgagtagcaaaaataaaacaaaactaagccatacatataagcacattcaacataagcaactttatttgaaatagatacacattggtaacaccccagatgtcctatcagtggtagaataatctattaatttacaatgatatgttatccatctatgaaaatgtagaaagcactgtaatatggagcaaaatgaatgtcttctatacgcatagtatggaatgaaggcagctagaaacaacatatctacatatgcagatctatatatttcaaaaatggaaaacaaaatctatggtttcgtatttaggattcccaaagacaagaggtaaaggggtagtgacaaaatggaatcaggagttggacttacaaagtatcagtaatgttctattttttgacctgggtggtaattaaacagatgtatttatttttgtaaaaatgaattgagctgcacacatagatttgtgcacttttttctgtttgttagaattcaataaaatgttgaatttacaaagcaaaagacattgggaagaaataaaattacttttgtttgaagacgacatgattacttatgtagaagatccaaaataatttgccaaaaacctcctggaattagtaagccattatagcaagttacagtacaaagttaatatacaaaagtcaaccactttcctatattccagcagtgaacaagtggaatttgaaattaaaaacacggccggggtggtggctctcatctgtaatcccagcactttgggaggctgagacaggtggatcacttcaagtcaagagctcaagaccagcctggccaacatggcaaaaccccatctctactaaaaatatttttaaaaagttagccgtagtggcacatgcctataatcccagctactcgggaggttgaggcaggagaatctcttgaacctgggaggcggatgttgcagtgagccgagatcgccccactgcactccagcttgggcgacaaagtgagactccgtctcaaaaaacaaacaaaccgaaaccactatatcatttagattggcacccccaaacatgaaatacttaggtctaaatctaataaaatatgcaccagatctgtatgagaaactctgatgaaagaaatcaaagaactaaataaatggagatttatttcgtgttcataattagcaagactcaatattgtcaagatgttagttctttccaacttgaccagtagattgattgcattgccaatcaaaatcccagcaagttattttgtggatatcaacaaactgattataaagtttatatgggtattcaaaagacagaacagccaacacagtatgaaggagaacaaagttgcaagactgtgacactacctgacttcaagacttactataaaattacagtaattaagacagtgtggtactggcaaaagaatagacaaatagatcactggaacagaatagagtggccaacaaatacagccacacaaatatagtcaattgatatttgacaaaggagaaaaagcaatagaaagtagaaaagatagtattttcaagaaaggctgctggaacaattggacactcgtaaaaaaataaatctagacacaaggcttatatctttataaaaatgagctcaaaatggatcacagacttaaatgaaattactaaactatgaaactcctagaatataacagaaaatctagattaccttggatttggtggatatagcaccaaagacaggatccatgaacgaaagaatcgataattaattttaattgattaaaattaaaatattcttctctgccaaagacattgtcaaaagaatgaaaagataagccaaagactgagataaaacatttgcaggagacatatctgataaaggaccattatacaaaaatatacaaatgacttcagaagttgtatatatttaaggtgtaaaacatactgttttgatatatattatgcatagtaaaatgattactacagtaaagaattttaatctgtccagcaccttccatagttacctttatattttgtggtgagagtacctaatatctactttcttagcaaatttttagtatgcaatattattgattatagtccttatgatttacattagatctgtagattaattcatcctatatgtttgagccctttgacctacttctgtccattttctttccctccttgtcactagtaaccaccattgtattctctgtttctgttttcaacttttctttagattctacatataagtgatatcatacttatgtatgatgttgtaattctgtgtctggcttatttcagttagtgtagtgtccttcaaattcatccatgttgtcataaatgactgatctttttttagggctgaataatattccattgtatatgtattccacaatttctttattcattaatctgtcagtagacacctatgttgtttccatatctttgttattgtgaataatgctgaaatgaatatgggagcacagatatctttatgaggtgctgatttcattacctttgggcatatacccagcagaaggattgctgggtcatatggtttgttctacttcacttgttttagtttatttatttttagataatagctatcatgagaagtgtgaagcaatgtctcagtgctttaggtgggagcatgaaagttgtggtgcttgatgcatgcacaagtgtttccagggagattttgcagacctggatttaccactggagcaagctggaggagaggtgtgggaagtactctcactccaattcaggctcctgtaggtcgattgtttatctgcctttttctattaggctatttaaaagcctaatagaaaaagtgtgcagatttccaaggagaaactgggaactggacacttcagcctattctctgcactgattgttggaggaggagtgtgaatagatccccctggaagtacacgtgcatccatttaaaatcacctctttgttctgtagcctagggagacacaaacgctgaatcattttctgttttcagagtcaggtgaattaagggctcaactctgtgggaggaactgtaaaccttggggctctgtaagtgtatttcacaaccttttcttgtcaaagagaagttgagagttagaggttctctcctgattataaaaaactggtcctggggtggagtttgtggcatatgtgtgtctcagcttttccttccttttttgatgcagatattttatcagtttcccagtttttaggggtttatcaactagttttgagatttgtcctagagggaattgacctataaataactgtttacttagtacatccataagaggagggaaagtcaagaatttcctattctgccatcttgctgatatttcaagaacatctttctgaagttcttaaaatacaacaataagaaaacaaacttttatattttgatagggattgcattaaattttgggtagtatgggcattttaacaatgttgattcatctaatccatggacatgagatatctttccattttttgttccctcttttatttctttcatcaatatgttagagtttttattgtagcaattttttaaaaaatagagaatatttttcataggaaaagaaaaaaaattctaaaatttatatgaaaccacaaaatacccagaatagacagaataatgctgatcaaaaagaacaaagctgtagtcatcatactacctggcttcaaaatatactacaacactatagtaacccaaacagtatggtactggcataaaaatagacatatagactaatattagaaacaaaagacaaaattcagaaataaatccactcatttacagtcaactcctttttgataaaggcaccaagaacatatattggagaagggaaatccttgtcaataaatgatgctgggaaaactgaatatccatatgcagaagaatgaaaccggacccctgtctctcaccatatataaaaatcaaattaaggacaggcacagtaatatcactaaaacacaggtgaccaaagcaaaaatggacaaatggaatcacaccaaactaaaaatcttctgcgcaacaatgagaacaaccaaacaaaatgaagagacaacctacagaacggaagaaaatacttgcaaacgattcaactgacaagagattaataaccagagtatataaggaattcaaaaagttcaatagaaaaaacctcaagtaatctgattagaaaatggacaaagatcaaaagaagacatatcaatgaccaacagatatagctgggcgtggcggctcatgcctgtgatcccagcactttgggatgctgaggcaagtggatcacctgaggtcaggagatcgagaccagcctggccaacatggtgaaactctctctactaaaaatacaaaaaaattagctgggcgtagtggtgggctcctgtaatcccagctactttggaggctgaggcaggagggagaatagcttgaacccgagaggtggaggttgcggtgagccaaaaacatgccattgcactccagcctgggcgacaagagtgaaactccgtctcaaaaaaaatgaccaacagatatgtgaaaaaatgctcaacatcactaatcatcagatgaatgcaaatctaaactacaataagataccatctcacctcagctaaaatggcttttatattatcaaaaagacaaaaataagtgctggcaaggaggcagagaaactggaatgcttgtacactgttggtggaatgtaaattaacacagctactatgtgaaacagtatagaggttcctcaaaaaaccctgagggaccagagaaccaagctgcagacctggttccagccccttagggttagaacacacagcccaggagtgctcagctgaggcttggaccgctgaaaccatccagaaatgaagccaatcaactaaatccaacttacaacatagtcaaaccctaaagagcatcaaagaatataaaagcagaaaggccgattccaaagacagagactccaaaggttaaaggaacatcagcccacacagatacataagaaacagtgcaagaactctggcaactcttaaagccagagtatattcttaccttgaaataactgcactagctcctcagcgatggttcataaccagactgaaatggctgaaatgacagacattggttcagaatctggttggcaaggaagctcatcaagataaagaagaaggttgaaacccaatccaagcaaaatagtaaaatgattgaagagtttaaagatggcatagccattttaagaaagagccaaactgaacttcaggaaatgaaaaagtcactacaggaattttggaatgcagttcaagcattaataacagaatagacaaagctgagaaagaatctcagagctctaatacggctcctttgaataaacataggcagacaaaataaagtaaaaagaattttaaaaatgaacaataggttttatttaataattctcctccttatactttctgtctcaccagtttcccctcaaactgatttacctactacacaaaattattcttatcgggcttatgtgccttttcctccacttatttgacctctcacctggatggatgctcctgcggaaatctatactaacgatagtgtgtggatgcctggagctacagatgactgttgccccgctcaaccaggagaggaaggcactgcatttaatgttactatgggttataaataccctctgtgcctcagacatgcacctggttgtatccatctagaaactcaagtctgggctgcttgccttccagagagatcagccacaggggaatggggacatttggtctccggcctctccctttctcctttaagacaaatgaaagggggagtaatgagagataccccatactttcaatataaacctgtaggaaaatcatgtcctaaaaattttgagggcccatctaaaactttaatttgggaagattgtgttaactcacatgtagtagtattaaaaaatgcctcatatggtttagtaatagactgggcaccaaagggctattttaaaaaacaattgctcctctggtggaagggaatgcctggaggctacttattttatttctcattgggaggacaaggatcatcatcctactttgcataggaggttcagctcattttttcccttaaaatgggaagataagggcattacccccacaaggcctcatatgatattccccattctgagcccagaacacccagaacttcggaaactggctatcgccatgtccagactgcaagtatgggaaggggaaacttttctgtctgttatccccagtactgcccctcacatccatgattctgaaccccatgataaatcccctttgagcccttttcctctttttgatgcctatcctcctttatgggactccaattggcattatgataattcttctcaatccaggtatgccccctacctcttcagcatccctaggcccctcggattgcttctttatggtggagaacatcgggcgttcccaccgccactcctctccctcagtatcaatgtagattcaaacattctgctttgtttacctccagcctgactattcctatacagagttgtgttaagcctcctttgtgctgttagtaggaaatagcaaactttggacgaataatcaaactgtccaatgcattaattgccatttatacacttgtgttaactcctgttttgcttcaggaaaagtataatgttggttcgagctcaagaaggaatctggataccagtaactttacccagaccttgggaatcttccccctcagtacatttaattaatgaagtgttaaaacaaattctcaaaagatctaagagatttgttgttactttaattgctgtgatcatgggcctaattacagtcacggcactggccaccactgccggagtggcattacaccaatctgttcaaatggcttattttgttaatgattgccaggccaattccacccaaatgtggaattctcaacagggaatttatcaaaaattagctaatcaaattaatgatttaagacagtctgttatttggcttggagatcggctaatgagtctcgaacatcgcatgcaaatgcagtgcaattggaatacttctgatttctctatcacaccatattcctacaacgagactaatcattcatgagaaatggtcaaaggacacttgctgggaagggaagataatttatccttggagataactaaattaaagaaacaaatttttgaagcctctcaagctcatttatccattgtgcctggagctgatgcattagatcaggtggaagaaagtctttctggactaaaccccacgatttggattaagtctattgggggccccactgtagtaaattttggaatcatgtttctctgtttaatcagcttgtttttagtgtgccgtaccagttaaagaatcctgcatcaaaactgagagaatgaacaagccttcatccccatggcatatttatataaaaagaaagggagaaatgttgcaggaagtcagggacccaaatggagggacgggctggagccatggcagaggaacataaattgtgaagatttcattttaatatggacatttatcagttcccaaataatacctttataatttcttatgcatgcctttaatttttaatcatgttatcttcataagctgaggatgtacatcacctcaggaccactgtaataattatgttaactgtacaaattgattgtaaaacatgtgagtttgaacaatatgaaatcagtgcaccttgaaaaagaacagaataacagagatttttatggaacaagggaagacaaccataaggtctgactgccagtggggtcgggcaaaaagggccatatttttcttcttgcagagagcctataaacagttgtgcaagtaggagagatatcatcaaattcttttcctagcaaggaataataatattaataccctgggaaacgaatgtgttcctggggggaggtctataaatggccgctctgggaatgtgtgtcttgtgcagttgagataaggactgaaatactccctggtctcctgcagaaccctcaggcttactagggtggggaaaaactctgccctggtaaatttgtggtcagaccggttctctgctcttgaaccctgttttctgttgtttaagatgtttatcaagacaatacatgcaccactgaatatagacccttatcaatggctctgctttttccctttgtcctgttccctcagaagcatgtgatctttgttagacccttattggtagttctgctttttgctctttgaagcatgtgatctttgtacctaccctctgttcttacaccccctccccttttgaaacccttaataaaaacttgctggtctgagactcaggcaggcatcatggtcctaccgatatgtgatgtcacccctcgcggcccagatgtaaaattcctctctttatactgtctctctttatttctcagctggctgacacttatggaaaatagaaagaacctaccttgaaatatcaggggtgagttcccccaatagataggagggtgaagattgaaaaactacctattaggtactaggtgcaatatctaggtaatgacatcatttgtacaccaaaccttagcaatgcacagtttactcatgggagatacctgcacatacaccctgtgaacctaaaataaggttgaaaaataaaaataaaatagataaaataaaatgtaaattaaaataaaatttgaatacagttttatttttagtagaatttctacatgtagtttccagagttaataatttataatgaatgtctacccatgtgattattttattttccaccaacatatatttttaaatatattctcttttatagccctttccatacttagtctttttatgattaaaaagaaactgtcaggccagacatggtggctcacacctgtaatcccagcactttggtaggccaaggcaggtggatcaccaggggtcaggagtttgagaccagcctgggcaacatggtgaaacactgtctgtactaaaaatacaaaattaggcaggcatggtggtgcatgcctgtaatcccagctacttggaaggctgaggcaggagaattgcttgaagctgggaggcagaggttgcagtgagccaagattgtgccactgcactccagcctgggcgacagagccagactctgtctcaaaacaacaaaaacgaaaaaaagaacaagaaaagaaactgtttattgacatttgcttctgttactcaattctagttgtaatcaatgcctaagctttgattatatcttcgtttaacttggctatattgcgtatcatttattttgggagacagtagcctcctatcttagctctttaggtgtgcacatattcatctttacatataaagggatttgagatatttctgtgatttcataaagtttttatgaagttatcttctttaaatttacttttactttacactaattgaatgtgcattattttggctgatctattttttggaagtataataaattgctttatgtatacttcagtggctttagattttttatttatgatttttagcattatgtgtttgccttagagtttatgtgcacaaaactattatatatttgttcacattaaatacaatttatgtatgttttaatcaatattcacctgcatgtagcttgctctgaaagaactagaatgctttcattttccatacatataatttttttctatatctctggagaataatgttctgcatatttttgaaatatataggtaggactatgctttgtgaaagagtctattaaagtttaccacatttgatgagttttgttttggaattaattaaaacctgaagcaaaattgatctgacatataattatgtgtataattattatggttactgtgtcatatagtaattaggcataatatgaattttatttggttttactgcttttatgtaacatatccatcattgttttagtcagctgggaaagaactataggtaaacaattatccacattgtgaagcactttcatgagtattatctcattatgtatataaataggttatgatatttatttcatttcaggatagtaaaggggcatttcaaaaacaaaaaacaacatttttttaaatgagaaaaagatcctttaattccaatagggttagaaacaagtacgttatcctcttttcctaggtaatttatcccatgcccacaggttcagttaccatctctatattaattctcaaatattcagaacagatctttcttttgaaatccaggtatgttcagccaacttcttaattgaacctccaccttggatgtctcaaaggcatctcagattcaacatattcatacatgaactcatagtatctcccatctctactaaaaggcctcattgcctggggtaaatgcccaggttttggtctcatggccaaggaaatcaaagactcagacgcacacacgcatagtgaaattggagcaaaagtttaataggcaaaagaaaagaacagctctctgtcacagagaggggtcccaaatgggttgctgagtggtagtaaaaatgtcagggtttatataaatgggctagtgaggagggtgtgtcttatctccgtggggcctgaagaactggttaggaccgggtgtgccgtatgttgagggcagagcctctagtagtccccaccccttgtgcaggccgactcttagtttgtgctgctctgcgctgcttatctgagcatgctaaaagggagggagagtttctgtgcctgttccaggcactttcttgcagctgcaggtgtccctgactcgccccataccccgacccccaccccatctcaccccactccctccctccactcccgcgcttccagctcagcttccctatctttgtgtgcttaaagaaagggagatgaatgtgcttattatggcacactgtttttactggggcctattgtttgtatgtgaagtttggtgattacccaggacacttccagctctgtgcccaagttgcttgtctgtgtttttcagcctgatcttccaggctgctctttgttagaagagaggtgatttctttgaactgcgtgaggttagaatgggagcaatttctgagctgctttttgttagaaagaaagttttctgccagggactctctttaccctaactacctaaatgatttctttctatctcctgtaacactaccttggtacgtatttcagtgattgtcatcatcacccatcctgttaggcaaaccagaaaactcaaagccatccttgttgctcctctacatccctcactctatatccaatttatcatcagattctttatttttcttttctcaactctctaatatattatatccatgctttgccatttctactgctggaactaaccctagtcaaatcacattcctcctttgttgggagtattacaataatattctctacaaggtatacccactcaggaaacagagtgatctaattaaaatataactatttttatgtcagatcttttagtgacttcccattgttgttgagatgaggacaataattattaacaaggtgaacagggactgggatgttctggcccctgccattgcttactgaatcttgcaacaaacccccttgtctctttttttcaggtgctgaaatgcatcatggcctctcctgaggctgggcctttgcatatgccctaacacaacttaaaatcacctgtctttgaaagatgggctattgtatcagctagactaataaaaattattctccacataatcatgtttcttattattaattaacaaacatgaaaaagataccatgtaaaatattagaattcagttttcttttgaagagatctttttgaattaacagcttttaaggctattagttcctatgcattcttcagatatcagttcaagcctcattttcttagggaagtttttcctctgttcactctaggccaggttatgttttattccctatctcatagaacctagactcttgtttccttttttcttagaacattgcctcagtttatggttcttgtattgtaataatacacttatcaatatcattcttgatcaatatttatttcttccatttcaagctctgagaggtctgatactctgtctctttttgtccattgttttttctctaacctctcatagtgtctggttcataatgataaataattttcaagtcaatgaatataaagtggtagtaagtgagagagctgggatttgaaatcagagctgactctaaaactactattctgcagtgacagtatatttttaacatgtgcattataacaataaattacactggatgttcagcacttgtcttggatatattcaaaagcaaaacatgagtcttagcttttccagtttaagcagtttaattatattttcataatttataacattaataaaatggggaattgtggtaaaagagattctgaggtgcatataaaaatgtttgcaggatgaaccacttaagtaagggagacccagtggacatctgccagtgggagctggctgtgaaaggcaacaaggtagaatgaagcccagtttctgtacttgagggacccaggcaccaggcagtgagtgtggcactgatggcccaccttggtctctcctggcccagcctcaaaatagagtagaaaaagggagtcgatgacaatgaattggttctatggaagaagacagcatatgaagggaaacttcattggaatcacataggtagatttttttatgttgttggctgttgtgtccaaaaacattgcagaggaaagattcaatattaaaaagcaaattggttcattgctgagagaatgtaaaatttattctcattctctttccatctattcctcttttcttcccttcctttatctattactctctttcttcctccccttctccatgactcgctataacctctgattcttcagtatgaaagtagtgtacatggacagaaatccctaatatacttgtttttaatagcaaacggggaacatgtaaccacaactctccagcgaaattgagatcatggccacataatctacagctttttctctcttctctatgtagattataatagttttatttaatagaaaacaaaaaaattatgtattaatttcaatttaaaaattttcttgatgttagcaaactatggatcatatcttaagaaagcagtgtatatttcttacccaaattctaacactaaaatattttaaaatattatttatttcctttggtttttaatccatatatttgtgtgttagtctataggataataacaagattatattttctctatatctctcttgccatttgtaactttgtgatttttacatatttaaaagacagttaataggattgaagttgaaactgtatttctattccagatgttgatgtcttcagaattgctttggaaattgtcagatttccaaattaatatcatagattgacttcttcatctctattcttaatcaaaattttccaagaagtaaagatatttggtcaccgggaagaaaattataatgcttagcagtgactttctaagcagcctgaggtgtcttattaaccagagtctgctcaggcctcaagatctgttgctgcccacatgtagggcagtttttctcataagcctaactaagggctgagctcttcttttacagtcattctataatgcacacccaaagctaaaaaaggagtggtcagtttacgttattgtcttattagaatgcatgaaattttgtaatacaagcacaaatgtatgtattctttccatctgttagacacacaccccttttagagttttaaactgtatctttttatattctatatcctatagttttgtttgattctgtgttataaacttccagagtcattctaaagatcttgaaataatctagagttcattctaatatagtggaaaaattattttaatgtcttatcttttgaaatacagatttcaaaactacctagttagcaaatgctggataatgaaatttgttcagagtttgactttttattcattttcttatcccactaacaagagcaccttgaagttctctcatcattaatgagatttcttaaaatatgtgattctgaagttttacctgaggaaaaagaaaaattcacatgtacttttgtgatggagtagcttaacttcaaaattcattttgaaacaatttttcctttcttggttttagccttgaaacatactttacaactctgtttacctccctccccaccaaacatccccttgtactggtagcttatctagttatatccttacttagaagttccaggggctaatcttgaaacaagccaggcatggacacccgaaattccagagattacctcaaggcggtttgtcaacaatctggctattgttgagatgatgtcagcctatgctccaggtcagcagtccccagacttttcggcaccagggactggtttcatggaagacaattttttcatggatgagggcaggggtttagtttggggccaaaactgttccacctcagatcatcaggcattagaatcttataaggagcttgcaacctagatccctcacatgcacagttcacaatagggtttgcgctcctgtgataatataatgcccctgctaatttgacaggagtcaaagctcaagtggtaatgctcccctgcccatggctcacctcctgttgtgtggcctggttccagtctgccactggagggttggcgacccctgctccaggtggaccatgactcaagatagtcaccagaacaggacacacagaccttgtatccagcaccactcctgcatgccttccattccaggttgcccttttaaaacccttctccccagtctaaagttttgaatggttttttaagggaataagcttgtccattccccaactgctagaatttgagtgaagttgcctgcctttcgccacaccttgcctctcatgttttctggctctcagcagtgagcagccagacttggcgtgtggttacacttttgtgcgtaaggtattttaaaatgttctatattatgttattatttatcatattgttattaagttttttcatgtctcccattgctagctgtgcttttagaagaatttgtatgctgtaattacatactttcttaattatgcttttcttgcatattcaaatgctcccaaaagtctttatctttcacttcatttttgatttacaaactgaggaatgcaaatacttccttgtatgtactttaatcccaaactctattaagaaaggcttattcagtgtgtgtggctagggaaacagtttcaatggctaacaagtgaatatagcagaaggaagaagcatatgtatgtctgacataattttttgatgttttgaaaagttatcattcccttggttgtttccccaccattcttcaatgttccttaatagattttcatttgagtttattttctcttaggtattttgtaatttattttttatttcttaaataattttgtcttttgctttcattttttttcctgagttgtcggctctttttatttcttttctctttcctcctcttctgcctttaatgttcaatttatcagtcaaggatctgtttctccaaattcttctttgagtgtatgtaactcagttttgaattgtgacttacagttttcttctgcttcatgaatattttgtgagggaatttttgtcagttcagatgtaattaattgttttattttaatttttggaacaactctctatggattaatattttttcttctgcttattttggttgatttggtattgtttctaacattcctaattaattaatgccttcttgtatcttataacaaagctggtttttttagtggatttttttgagttatgtgtccttcatttttttttttaaatgttgtgtaggatcctaaatgttcgcattgcattttttccctttcattattcatctgccaaagagcatagctacttttcttttggccttttctcccagaaatcatgccttatgaagtcctccacttaacgttgcatgtttttctaatttccttccctgcaatcctgtctaccaggaaattgtttccctatttgactatttaggatggacttactctttctgttgatggttatgctttgctagcattcctcttttccaagcatttttttctcaggttgctcttcctctatgaaggtttagagtagggtggagacatgagagattgtttactggaatttggcaatttctgtctatgtacttcagttacttgtaaatttgagcagactgttctgaagttctaattttcgtggtttcttgtacttcacactttgttcggtattatttttaaaggacatatattgagatgccattataggcatacttgttcttttaaacgtttgaggtttatagtttgaggcaacatgcaaaaacttttgaattgttatatctaccctgtggcttttaacatcatgggtgtcccttttcttttttttaaaacccttgtattaaaatctttgtgtattattcaagccagaccagatttatttttggtgtctgcatggcatatacttttcttcactttgctttcactatttttaatctacatattttacttttgtattttgaacacagcatatgcttaaattttacttttaatttctgtctgacagcatacttattttgattagaacatttagtatacttacattcaatgtaattagatgacatattgggataaattttactacatactttctttttattattccctcttcttttattttttttttccttccttggcctttttgactaatttattactttcttattctatttttcctctagttttaataataacttgttaatatttagtggacatattacagatgactgcttgagttttttactcatcacattctaatataaactagtacttttacttcttcccaggatctttgaactttatttattccctttccttttttgctattctactattgccacattttcatttgtatagattttttattctgtaagactccattattattgttaacacaattaattttcttttagatatactcacatatttacctatgccatttatcatcattacttcatatatccctgagcttgcatctgagatcatttgccttctaaatgatgaagattaaaaaaaaatccttggctgggtgcagtggctcatgcctgtagtcacaggactttggtaggtcgaggcaggcagatcaagaggtcaggagtttgagaccagcctggccaacatagtgaaaccccatctctactaaaaattaaaaaaaaaaaagtagctgggcgtggtggtgactgcctataatcccagctactagggaggctgaggcaggagaatcgcttgaatccaggaggcggacgtggcagtgagctgagatcgcgccgctgcactccagcgtgggcaacagagtaagactcagtctaaaaaaataaataaataaaaattcctaaatgtaagcctattcacaacacattatttcattttgtttaaaaatgcccttatcttcatttttgaaatatattttcactgtgtacacagttgtatattggtaaatattttctttcagcactttgaagatactgttccatcatcttctggctctccttattctattgagaagttgtctgtcatttttactgttctccctttgaatacaatatatctatatttccctctggctacatttaaaatttcccctttatctgtaataatcagtaattacgttttaatatacataaatatgtttttctttttatttatattacatgtagtttaccatgttttttgaatttatgtgttgatgtcatttatcagttgggaaaattctcagccattatctcctaaaatattgcttgcttcttcgtcattttctctcttttccaacctgggagtccaatttacatttttgaagaatttctcccctttttttactttgtaccttatattcttttctatatcttttagcttcttcctatgccagccagttgctttctttggattagtcttccagttcacaaattaaaggttgtgactgagttcttcattttctgcattcttgttggtgagtttctaatgtccatcatttctcctgggtttggtcatacagtcttacgtttcatatgcctattgttgttgttgttgtttggttttatttttttctttttgggtgcaagacattattttcctaagaaatagagggctaacttaaggctcaagagtgattttatcttcttccaaagaaatcttttactgacatcttgcaggcaactgtgctagaagcactattaattccatgtcaccttaatccaatgggtgattgagatgattcaaagtttcactttagtacctgtaggtcaagtctatttctaggaatgaggatcattcttattccttgtatgtagccctcagagtctcaatccaaaccatggggtgatcactggaacccatttcttggaaggtcttcagcttcagttgtagtccttgtttcaatttctttgctttctccatcagaattgtctggcagcagccaaagattcagaagaaaatgaactctaagtgcaaggctcatctgcatgcatgtcgctattctcttggattgtgaatctattattcttcattacattgttacattatccaatgctttcaaacacatttatttttgttcatattttgaccatatttgctacttgcttttaaatggagtgttattccacataaccttgttcatcattactgaaaatctccacagctttaaggaaaaatatttataagtttacatttctgtaattgtgtgtagattttacccccactgaataatttcaaacagtatattattgttgaaaaatcgaatatatgttctagaatcatattcttggccagagatttcagtccctccactgtatgtgaaagtcaagttgttttatctggtcttcctgtttcttcatggtcttctgccactcacctttgcagactttccattcctgtctacatctactatctgtttatttattttcacttgcatttacattttttttcttccatactctgtctgtaaagatacctgcagtaccaggatttgattttccccgagtccaaattattttttagattattgcatgttgtttgttaccatcttctccaaatataataccattctctgtgtgcaacactgtgaaccccttgagcttgtaattagttgatctatatccatagaacaagtgtaatgccactgtatcaagatatatccataccagggcctctacccctttctagttgtttccctctgctgaaaattacatggctgtaaataaatgtgctttacttcttttcatgtgcttgctaatgttgcagggaacctcaatcaggaataaaacagaatcacgtggcaaagagattaagctaattttgaccataagaaaaatgtttgcaataatttaaacaaggttatcttgaattgtcactctttaatctttgattttgttatgaatgcatagtaaatttgatatacatgtgcatggctagaagtcaaaagatagaacttaaatcagactctttgaaaggtattactaaaatataaatgtgttatggcttaaagtcatagttacataatgctacggttggtcatagtaaatcagtaaatgtattttttagagccactaaatctttcacactcattatcattctatagtgcaaaaatgaataatgttttcagcaagtctcttatagtacataccacctagtgactgaattagggaaataacattcctaagtaagttcctgtataaacatgaatatacatatttatacatgaatataaaaaatataaattataattttactttcatgccatttctacctcagaagaataggttgaatctgttccacgaatgaaacataaacaggacattcacttgtggtagagccatttgttcactaaatacacatttatacagtgactattatggataaggtattatgctagagagagaaaaatgaataatatgccatccttgtttgctagtagctcataggtgaatggaaggactatgcaatgacacaattgcaatgttctgtaataaatgcagttctacattattaacagaggcaacaaaaaggaagaggtaatatggcatggcttagtatagggtgttatatttattggagcagtataagataatgttagagagataggcttgagttatccctatggatgatcttatagagtaatcttaggaatttaaactttatccagtggatagcggagtgccattcgatggtaatacatagatgaatgatgtgcaagtatgtatgtcttttagtaatgttattttgtctgagaaatttgttaagcagggagacatattagaggctgcagcaacatcttgtgaaaacaatgaaacttataataagaaagaagtaagtgaatagagaatgagcaatggatttttaatatgtgatttgagaaagcttaaaataattagaataatggcacatttcaggttggcaagtgccattaatcaaaatcatgaaagcaagaagaggaactgacttaagtgaaagttaaaaaaaatgtttagtgttaggcagtggaacatccaggtagaattagatgaagccagcaaagatataataggataagccctaggcatggacaaaaatgctataggaatagatgaggaatgagaaaagatacagatggttatggactcaggagaagctcaatgtttcagggacatggatgtatgtgtatgtgtatgtgtgtgtgtatgtgtatgtgtatgtatgtgtagtattctgcttactaaactaaatacagtgacaatgcctggacaggccagggaaattgttggttaacattagattatcagtcataaatgagatgttgaaaaaaatgttaaaaacattgtattctgattatgacttaaagtgttgatggtgacacattaacagcaaataaataagaggcaaggcattgtgtagtacaatttttaagagattgacttgttatcttaccccatgctgtcaaagaccacttctacagaattgcttgacttttggagtgaaaatagggaattcctacagtcaaaggcaatattttacattaaacagagcccacataactatgcagacagtatatggagttaatttcagctggacactattatattcagtctttacaaattgatgcctcagccataaaagcacctcagtgcaatctctagaaattggatggcttcccattgtaagcctttttgaggtgttggacacaaaataagtttttgattgtatttggaggagatcacatgttagttgggggtttgatatgactagactgtgtccctacccaaatctcatcccgaattataaaccccataatccccacattttgagggtggatcaggtggagataattgaatagtgggggtggttttccccatgctgttctcttaatagtgagtctcacgagatctgatggtttaataagcatctgacatttcccctgcatgcattcagtgtgtcctgctgccctgtgaagaaggtgcctgtttctcctttgccttctgccatgattgtaagtttcctgaggcctgcctagtgatgtgaaactgtgagtcaattaaacctctttcctttataaataacccagtctcgggtatttcttcatagcaatgtgagaatggactaatggactaatacagtaaatcggtaccacagagagtgggtgctgctatcaagataccccaaaatgtggaagctactttggaactgggtaataggcaaaggttgaaacagtttggagggctcagaagaagacacaaagatttgggaaagtttggaacttgctagagatttattgaatggctttgaccaaaatgctgatagtaatgaagtccaggctgaggttgtctgagatggaaatgaggaacttgttgggaactggagtgaaggtcactcttgctatgctttagcaaagagactggcagtgttttgctcctgccctagagatctgtggaactttgaacttgagagagatgatttaggacatctggtggaagaagtttgtaagcatcgaagcattaaagaggaagtagaacacaaaagtttggaaagtttgcagcctggcagtgtgatagaaaagaaaaacctattttctggggagaaattcaagccagctgcagaaatttgcttaagtaacaaggagctgaatgttaatcaccaagacaatggagaaaacatcctcagggcatgtcagagacagtcttggcagcccctcccattacaggccaggagctctagaaggaaacatggtttcattgaccgggcccagggccccttgctgtgtgcagcctaggtcttggtgccctgcatccaagctactccagctgtggctaaaaggggcctaggtacagctcaggctgtggcctcagacagtgcaagccccaagccttggcagctttcacatggtgtggagcctgcaggtgaacagaagtcaagaattgtagtttgtgaacctctgcctagatttcagaggatgtatggaaatgcctggatgtccaggcagaagtttgctgcaggggcggagccctcatggagaaactctgctaggggagtgcagaagggaaatgtggggttggagcccccatacagaggccccactggtgttgcagtttttttgcttctgtagttcagcaagtgcgagggagtggctcccagcagcttcttcactcccatagctcagtgaccatctgttccacagtggaatctatttcagtgaccttcactgccaaaggagtaaaaagaagtacagcgtatgatccctcccaatctgggcctagagagggagaaagaaaaggaagagtccttactagtactaagtcccctggttgaataaaggtggccttggttcatgggtttgggcctttgacatttgtttccgttcctgcaggaaatgggccaaagaacttacatggttaatcaaatcaaaggttacatggttaatcaaatcagaggtttcttggtctagaaggaaatcattggtgagaaaaggctgtccttacgtcatttcaaagggaattaaactcagcttcaaaggggtgtttctaaaacagtagtgccatgggcatgagagtaatccaggggagatgagtctcttaagaaagttttctgaagtgccttttgataatatcatgtttcttttctgcctttcccaaggaatgtggtctccaagcaccatgaagatggtactgtatacctagtgcctttgagtccccctgggtgacagcaaccttgaatgagaggctgttattgcctgaaggtacttagggagcccaaagtgaggaattatctaattaattagtacttctatcacctcagagactttctctgtcagacatgaaaatgcttctatccagttaatgaaggtatatacccataccaggaggtactggatgccccttatctttggaatatggatgaaatccatttgccagtcttctcccaggtagcctcccattctttgggctccagcggggagacaccattgactggggggattatttttaaggcaagcctcacaagcattaatgacctgtttgaccatttttacctgacaacaacctttgagccagttggtaggttttatcctttcctacgtggaaggcttggtgaaagattttaagaactttccattggctggaatttggtagatgaagtttgccatcctccagttgtagctgaaaggtatatccttgagaggaggcccattctatttctgcaggagagtactgagtttttgtttcttttatggagccctcccagattagaggggcctcaagtggatcagaaatctggggtactctaactgccaatttagctgcttgatctaccagtttatttccctcagcaatttcatctatctccttttggtggcctttacaatgtattatgccacttcccgtggaaggaaaaccaaggataatagtctgttaatttcccgatggtacttaatgagagacctattagctgtgaggaagtctgtctcttccagatcatggcatgggcatcgaggattgcaaaagcatacttagaatcagtataaatgttaactgctttccctttgcttaaatgcccccatgagggcatttaactcagctagttgagcacttgcacccgagaaaacaggtgcactcacaatagtgtcattcaggatgactactgtgtattctcctttatcccttgttctacaaaagaaattctgtctgtaaagagagtccattctgcatcctctaaggggtttttttgaggtcctctctggctgcataggtttgcactactatctgttcacagtcatgttcaggcttcccaagtttctctgggagggaggtggctgggtttaggagagccagattcttaactgaactgtagattcctccaatagcagagcttgatatttgaggaggcaattgtttgttagccagagactccccttagaagacagcagtcctgccaggttttgtggggtataaatggctaagttcttccccatgattaacttagtagcctctggcaccagctaagctaccgctgcaactgcccagaggcaggccagtcatcctttagccactaaatcaagttccttgctcaagtagcccatgggctgttggggtgggcctcagactgaggatagaactctgtgatgattaatattgagtgtcaacttgattgggttgaagtatgcaaagtattgttcctgggtgtgtgtttgatggtgttgctaaaggatattaacatttgagtcaatggactgggaaaggcagacccaccctcaatctgggtgggcacaatctaataagctgccagcatggctagaataaaagcagacagaagaatggaaaagactgactggcttagtctcacagcctaaatctttctcctgtgctggatgcttcctacccttgaacattggactccaagttcttcaactctgggactcagggactcagactggcttcctttcttctcagcttgcagacagcctactgtgggacctcactttgtgattgtgtgagccaatactccttaataaagtcccctttatatatacatctatcctattagttctgtccctctagagaaccctgactaatacaccttcctcactgatacataaagatttaacatcttccctatgggaagactaagggcttgtgcctcaagcaaggcttgtttcaattggtgaaaggcccttttaatatttggttccccaattatggagtgagtcttagctgcctgagtttctttcattaggtgatataagggatgagctatctcactgtgcccaggtgtccataatctgcagaatcatgtaatgcccaagaaccccctcagttgtttgagggtttgaggaggggaaagtaggagatgggcttaatcctttattcacctgttgccctggtctcctctgacaagagtagacctagatacttcactgaagtctgacagagctgagtcttagattttgagatcttatgtcctctgttaccctgaaagttaagaagaggcttactgccttcctgagtgatttcctcagttagggcacaacagataatgtcatctacatattgtaaaattttaacctgaggataaaggaactcagagagaccccttgacaacactttaccaaacaggtgggggctgtctcagaatccctgaagtacaccatccaggttagctgggtggtctggttggagggatcctcaaatgcaaacaaatattgagaggcagggtatagtggtatgtagaaaaaggcattctttagttccaggactgtgagccctttagttccctcaggtatttgagttagcaaagtatagggattgagaaccaccagatatatcggaaccacagcctcatttatgaggtggaggtcctggagcagtctgcattcccatttggatttctgtgctcccaatattggggtattacaagggctgttgcagggtttgaggaggcctgcctcttcaagttatcaatgatggcttctagccctttcctagcttctggttttagggctcactaaactagcttctggttagtgaagcaggtgggatcctaaaggtggagttggaccagtatggtggttgtggcttgatcaattttcccttgagctgccaaaacttctggattagtattagtctgcaccagtgggagacaaagagcctgccttggagccataaggatggtagttcccttatgaggtaaaatatccctatgtagcagaggagttggcctcctggcatgatttaaaaggcacgagtaagcaagaggtttccccaactgcaagtgagtggttgggaaaaatatcaggttaaagtttttcttgagatgcccctcataggcatgctaagggaggaggggaggcctggactggagaggagaacagaaatggctgtgctggtatccaagaggaggttcactttcctctcttcaactttcagagtcacttggggctcctgaatggcaatgacattttgagttattggagccagggagagaagcccaaggactcctcagtcctgctggaccatttgtgagtctggctctggactcagtgacctgcatctctggggacagtccaccctccaatggttccctccagagattggacagggtcaaggtggcttcctcatgctgcctgggcagttgttaaggtgccctggcttgccacatttgtaggagttatcaggtgcatctcagggattctgggtttttaagcctgcaaggcagctattagagactgtaccttttttcttgtgtctcctctctctctcttcagtctcctcctgatccctgttgtaaaagaccaaagtagccactttcaggaggttctctaaagtgctatcttgtcccatggcctgcttctgcagcttcctcctgataccaggggctgcctcctaaacttactctttaggattagttgtccctcaaatgaattaggggatagagaggtgtaccaaggcttctcttagcctctccagaaaggaaatgggtcatctgatccctggtctatcatggatagtttggagtaattgagaggcttagttttagtccttcataagcaaccaatatgcacatctgaaagtgtttcctcctctattctcccatgttgtattagtcagggctctctagagggacagaactaataggagatatatatatatatctctctctatatatatagatatatatatatatatctatgtatttatgtacagatatatatatatctatgtatttatatatagatatatatatctctatgtatttatatatagatatatatatgtatttatatatagatatatatatatctatgtatttatatatagatatatatatatgtatttatatatagagatatatatatctatgtatttatatatagagatatatatatctatgtatttatatatagagatatatataaaataatatctcctatatctcctattgtgtgtgtgtgtgtatatatatgtgtgtgtatatgtgtgtatatatatatctgtgtatatatatgtgtatatatatatctcctacatatatatcatatatatatatgggaatttattaagtattaacttacaaaatcacaaggtctcacaacaggccatctgcaagctgtggagcaaggagagccagttcaagtcccaaaactgaaaaatttggagtctgatgttccagagcaggaagcattcagcataggagaaagatgtaggctgggaggctaggccatctggtcttttcacaattttctgtctgctttatattatagccacactggcagctgattagattgtgcccacccagatcaagggtggatctgtcttttccagcccactgattcaaatgttaatgttctttggcaacaccctcacagacacacccaggatcaatactttgcatccctcaatccaatcaagttgacagtcattattaaccatcacaagtcaaccccttgtcaacttgaacccatacacatgtcctgagattatacataatcaaataaagacaacaataaggtaataattacacctaacataataaaactatcctttgtacatcaggaaacgcaccaatccccaacccaaatactattacataaagttaataatacttaaatgctgaggtgaagtcaataaatcttatgtcacatgatagaggggaaaggaaataaaatgaagatgttttcttagtacaggtgtatacatgcacaaacatgtttttaatgaaagaaggaggaaatacttatgacaattacagtcctcatttctgcagctggtcatgtggtcatagctggtattgatgactaccttcttcaactacccattctgtattccctttgccttcagcaagcacctcagcaggttttttttttttttttttttttttttcctggtggaatgacccaagccttcattcctgaagggtctgggtcatttgtagtcccacctgggttggggtgttgcagtttcccattgacattaatcacagggcatggtaatactgtgagatgccctaatggatctcctatattccacgtatactgttccttacctttgttgtggagtagtagactgatttcatcttgatagtccaggtcaatcacatcagccaacgctgtaactcccttcttaacctgttgtcttaaaggtaggaggagcccaaagtgtccaggtggcaatcttaacatccagtttaatgaatcattgttgtgtctcctggtggaagcattcccctctctagaactaagacttctagactagtagaatgtaatgccatgggaacaggaagcaagaattttgctagtgtatcactagaagtgatggtgagtggtgccacttccacttccaccccttgattcctggacctgtgaatcctgtctatgggagaaacagtaccatatattggatgctgattcagaacatgcatggccttctggagaactttgcctcatccaagcgaagtattatcacctagttggcattgtaattgtgacttcaaaaggccattgcacagtttttatcagtccagctgcttcaggatgatggggaacatgataagaccagtgaattccataagcatgatcccactgccccacttttttagctgtaaagtgagtgccttggtcagaggcaatgctgtgtggaataacatgatgatggataaggcattctgtgagtccatggatggtagtcttggcaggagcattgtgggcaggatacacaaacccatatccggagtaagtgtgtattccactgggcacaaatctctgccccttccttgatggaagaggttcagtataatcaacctgctaccaggtagctggttgatcaccctgaggaatggtgccatattgtgggctcagtgttggtctctgctgctggcaaattgggcactcagcagtgcccatagccaggtcagccttggtgagtgaaaatccatgttgctgagcccatgcataacctccaatcctcccatcatggccacttttctcatgggcccattgggccatgacaggcttggctggggaaagaggctgagtggtgtccacagaacgggtcatcctatccacttgattattaaaatcctcctgtgctgaggttacccataggtgagcactcacatgggatacaaatatcttcacagttttgaccacttagagaggtccatccacatatctctgccccaaatttctttgtcaccaattttccaatcatgctgcttccacatccctgatcatcaagccaaaccattggctacagttcacgaatcagcatataatcacacatctggccatttctctatccatgcaaagtgcacaaccaggtgcactgctcaaagttctgcctactgggaagaattccctttaccactgtccttcagggatgtcctaaaaaggggctgtactgctgcagctgtctacttttgggtggtacctgtatattgtgcagaaccatctgtgaaccaggacttaatcttctcttcctctttcaactgatcataggtaactccccatgaagccatcagtgcaggctggggaagagaaggtacggaggcaggaggggagcatttgagccacttcctcaagtaacttacttttgccttcagaacctgcttgagcccaatcacgtatataccacttccatttgatgatggaatgctgctgtgcgtgccccactttatgactagatgggtcagaaagcacccagttcatgataggcagttcaggtcacatggtgacttgatgacccatagtcaaacgttcagtttccaccaaagcccagtaacagaccaacatctgtctctcaaaaggagagtagttatctgcagaagatggcagggcctgctccaaaattttagaggcctctgctgtgattcacctatgggggcctgccagaggctctgatcagcatccctatctgccgctgtcacctcaagcactattgaatttgctgggtcatatggcccaagtggcagagcagcttgcacagcatccttgatctgttgcagagccttctcctgttctggagcccactcaaaactggcagccttttgggtaactcgatgaataggccacagtaacacacccatatgaggaatgtcttgcctgcaaaatccaaataggcccactaggcattgtgcctctttcttggttgtaggtggggtcaaattcagcaacttatccttcaccttagaaggaatgtcttgaaagatcccacacaactggacccctagaaagtttactgaggcagaagttccctaaattttagtcagatttattttccatcttctggcatgcaaatatatcaccaataagccctgtgtgtttgctacttcttgctcactggatttcatcagtataagacatgaatgtaatgaacgagtgtgacatcttgtagaagtaaaaagcgatcaaggtgtctccgaaaaagattatgacacaaagctggagagttgatatacccctgaggtaggacagtaaaggtatattgctggccttgccagttgaaagcaaattgcttctagtgggccttatggacaggaatggagaaaaaggcatttgccaactcaatggctgcataccagataccaggagatgtgttaattttctcaagcaataaaaccacatgtggtacagcagctgcaaatggagtcaccacttggttaagcttttgataatcgacgatcattctccaagatctatctgtcttctgcataggccttatgggagagttgaacaggaatgtggtgggaatcaccacccctgtgtcttttgagtccttgatggtggcactaatctccgcagtccctccagggatatggtattgttttcaatttactatttttctaggtagaggcagctctaatgacttccatttggcctttcccaccataatagccctcaccttacctgtcagagagccaatgtgagagttctgccagcctgctaagtatgtctatgccaattatgtgttctagcactggaggaataatcacaggatgcaccacaattcagacctgagctaaaactccattagttacctgacctccataaccccctactttaactggaggaccacagtgacattttgggtccctaagaatcaatgtcagctcagaggcagtgaccattagtccccgaattatctgatcttttcccttcctccaatgcacagttaccctagtaaaatgctggaggtttccttggggaagaatgggagaaagattaacagcataaattgtcagtagtgtagtggtgtccttcctcaagaggtcttggctcccccttcattcaaagggttctgtgtctgtaaactggctcaagtctggaatttcactgaggggccatgattctctgtttttataattcaaattcatcttttgtcccttctacgtagaagttttctgcttatataaattaagtagaaatacagtaggcttcctatcaatttcacttccaggaactccgtgattaattagccaatgctagagctctacttgagtcagactattctgattgcttctttgtctctgctatccattacggtacctatgctcaccttgcttttgatggttgagtgtcgccacttggtccctgccatctcaggatccaattattccaattgtgtttaaattttgtagatgagaactgcggttcctactattagatctgacatacagagaagagcaattacagggctcttcaaagatgcgggtgctatcctcacaaatctattttgcaaggcattggtcaagttatatcttctggaccctctcagctaggatgattaggtctgaagtgactaatccactccagcatcccaatctccctaagcctttggatcctttcctctatattaaaccaagggagatcaggcacagtaggccatcttttaatccatatttcagctaaccaagcaaataaactactagaaccttttttactccccaagctgcaatattaaattcagagtccctacttagtgggcccaaatcaataaatttagcctgatccaactctatgtttcttccactattatcccacacccttaatatccattcccatgcctgttctccagatttctgtttatataaattagaaaactcaagcagttattttcgagtgtagtacacctcctcgtggtcacactctcaacctcatctctaggggcctgccgggactttagtctagttatagatctagaagcaaacaggtgttgggtgtggctcctgagaagaatcaacattatctttcctggcaactgcctcaggggaagtcatcactgttgcttcaggcagcacagggtttatctcctcagacaaaggtggaaaggctgatggcagcatgggttggggaggggctgttgccactactgggcatggggatgcttttccttctggcaaaaaagtttcatcagagtttacaaactcagtgtccccatcttcatcagcatccttccacatgttcccattccaagttgcagggtcccattcttttccaatcaatgccctcactttaatggtagacacctggaaaggctgcacatgcactttttgttgtaggttagccactcacatgataagagcttctgtctttttttccacaatttcagctcgttctctacaggagataggtctctcagggaaaccttggcagatttgaggctcagtatctgcttctgaagttgggagatagaatccctgggttcctcattttctttcatcactttgtctactgaacttaggagcaaccaaccagctttattacattccccacatatggtcaaaggtattatatatatagtcacttaactccttgcctctcatgtttggtgactcaggagtgtcaaatgcatttattttgtgtatctctataagcagttcacaccaaggactgtcagtgttctccatactattagaagtagagtccttagcatttttgagtctaatcatattaagcagccaactccagaaaccctaaaaccaatgaaagaactctatccttaatattctgttcctctagaaccactcctggtaccaaaatctgtattagccagggttctctagagggacagaactaataggagatatactggcagctgattagttggtgcccacccagattaagagttggtctgattttcccagcccactgactcaaatgttaatctcctttggcaataccctcacagacacaccccagattaatactttgcctccttcaattcactgaagttgacactcagtattaaccatcacacatgtcatcattggggtcccatttagggtcctccaatggtactgctgtttttccaattgtataaagctcttccccttgcttggcactatatgaggtacaaagctcatccccaaatttctctgccacttgcagggctgtctgcttctcagcggtagtcaggattcgattccaaagtaacattacatccttccaggagagttcaaatacttgggttaaattctggaaagcctctatataactgtccgggtcatctgaaaacctgccaagatccccctaaatttgtcttaagtcctgtagagttcaggagacctgtatcttaatgggttatattcacaaggcattttctataggggcatgagcaaggcttggacctgcctaaaatgatttttaggatgggggcaaaataatataagaagttttttcttcaaagtctgaggggtcacaggagtcccagtgattcaggatacacttgaggggagtgcaggctgcaggtggtttgttacccacctgaaaagagagaggggagaaaaggcatgccttagtctctcccttgctaatcttgaatttgaagcatccctcaaatctcagtaactggtactggcaccatggatgggctcttgctgcttatgccatggttgtgagtatgaccttcccccatgaagcagaaaggactagttggcagggatagtcatgcttacctgcactctgtcctagccttctgttgttgacttcctctggttcctcagatctagttttctttttagggctccaaactgaagcatgaaaaatacactggagtaatggtaaggtgaagctatggaaatagatccttctcaaacaaaggaaagaaaaggaaccctgagaactggggacctggcctaataagatgtcttccaaaaggaaaaaatcagtccttcacatagaaaagctccttgtattttcaggattatgttgattcctgacatggtgggaaaagaaacaacttaaatgcagaggagggaaggtccctgggggaagtggtctcttgcactatgctaatgggtttcttcaacaggggaaagaaaactctcttaatttttacatccccctgtttctaagaatagacagaaacaacatggttcaggtttacactcccgataactaagccaagtattcattctacccactaatattatctttttggcttgcaaaaacacttgtaacattgtatataaagaagggatagaagccacaagagtcttgaaagaaagaaaatgtgataggaaagactggaagttttggtgcaacacctgaacaggctgtcgggaattggagccaatccaggagtcttccagtaatgtcgaggcatggccttggccagataccttcaattgccccaggaccttattctgatcccacatgacagctagaattctggaagagaagctggattggaataaagtgaacatttccaacacccgagggtgaagggggattgacaaaatcctcccctgcaagcctgttctctgaatcttatagaccagcagctgcactatccactcttaactggctgacaaaggcccagtgttctatctgtttttgtaaaaaatctgaggacaagaagcctcggaatgaaagtaaagagtcataggtccactcttactcaaactttaattgatcctggatgaacccccagaaatgttgtggcatttttgctcgcatagtttggtgagtgggaaggagtggcacccagtggcttcttcactcccatagctcagtgagcaggagggagcggggcccagtggcattttctctctcttagctcaggtagtggaaggggatgttacagctcttttactctcgctgcccacagcttggtgagcaggagtgttacagctctttcattcaagcagttcagagatttctacattcttgtcctgtgaccaaaaggaataaggtatgtggacactggagagtgagtaaggcagagtagaattttattgagcaacagaaagaaagctctcagaagcaagaggggacccaaaagcttgttgccatctgtgaagctgagtcgggtttttatgggcttagaatgggggaatgaatgctgattggtccatgggtgggctcgaaaaaggcatcatttgatgggttaaaaggcatcattcagaagaaatcaactgagagagagtagataagatggggatggcagttttcactctggtcctagactctatctggaactggaagctcagttttcaggctttaggctatccttggcttgaaggtcaagtttcaccagggacccatccctgtccacctatgaatttgtctgtctcctgtatctatcaatggggcactgcctaataaagctgtgagaagagggccaccatcctccagacctcagaatggtagatccactgacagcttgcaccatgcacctgaaaaagccacagacacttaacaccaagctatggaagcagctgggaggggagttataccctgcaaagccagaggaatggagctgcccaaggccatgggagcccatctcatgcatcagcatgacctggatgtgagacatggagacaaaggagatgattttggaactttaaggtttaatgactgccctgttggagatcagacttgcatggggcctgtagcccctttgttttcacgatttctcccatttggaatgggagcatttattcaatgtctgtactcccattgtacctaggaaataactaacttgcttttgattttacaggatcataggtggaagggacttgccttgtctcagatgagactttggacttggactcttgagttaatgctgaaatgaattaagactttgggggactgtgggaaggtatcattggttttgaaatataagaacatgagatttgggaggggccaggggcagaatgatatggttagtttctgtggccccaccaaaatctcatcttgaattgtaatccccataattcccacattttgagggtaaaagaggtggagataattgactcataggagtggtttcccccatgctgtgcttgtgatagtgagtgggtctcacaagatctgatggttttagaagtgtctggcatttccccttcttgcactcactctgtcctgctgccctgtgaagaaggtgcctatttctccttttctgtctgccatgatagtaagttttctgaggtctccccagcgatctggagctgagtcaattaaagctcttttctttataaattgcccagtcttgggtatttcttcatagcagtgtgagaatggactaatacagggttgtatatcagaagtcatataaagatagaagaatattaaacaggtacatttaaattttgtcatgaggttatgacaagttactctgacttcactaagcaaaccacctgagctgtttagatatcttaagtctagctagcaaaataaaacactgtctatatcaatgtagcagtatatgtgaaagggatttgtaaattctgtaatgtcataaataggagtactatttttgtactaatagaaaatttttaagtgtggcttgttcttgtggcctgttaacatgaatgtgatggtagctactattacaaaattaccacctcttctctactctcgaggatggtgattcactagcaacagtttctctttaggaactttgatatcagggaatgcctttcatagttccgtatcccaggcatttagcctgctatttgcacattaatacattaatacattaattcatttttttgaatgaattaataaaaactatgtgactgttctggaagattctgccatattcctactctgtgagtggtgggagggggaagctaaaatcaaggaggcttcacttaattattcttatccattcatcttctgaatactcttaagaatcttcaatttaaccaatagtcttaaataatcttactaagggtttttaatacatttaatgagttataaatcaaggataaggatagaaaattggcagtccatagatgcattttgtttggtcctcccaatgttgacatttctcagggttaaataattataataaaaatttactgtcagcattaaaaatttattctagttcacctaaacatgtattcttttctctttttcttctccaggcacactggcttccttttttttttttttttttttttttgtaaaatgccacatttactcttaaattctggactttgaactggctttttcctatgccaggaatgttcttcttctaaatatcatcatggtcaactctatcactgtcttagtctttaatcgaatgtcaccttctccatgaggcctcgccagattgccgcatgtataatttcatacatcatgccccaaaaaattctccccatgtacttccagtctctcttacactgctttttctttctactgcatttttaatctaacattttatgtgatatacttgtatatgtttattatttattttctgtctcctcaatatattataagctacatgaggattgagatctttttgtttgtgtgtgtgtgtgtgtttactagtgtatttcaggcaattggaataatgcttgataaattaggactatcaataaatatttgttgaatgattcaacgaaaaccccaaatatatggctccttttgaaaaaaaagcactatctgttaacattgggcttacattcctacatcctccaccatttgttggaactgagaggcaacaggtgctttaggcaagacatgcatgcattcctcggtcctctacagccatcaccaccacacttgtcttcccagtgctgagccttatctgcattggcatttatcttcatatttattcttttttttacaataaagaggaaaactatgtctagtactcatatctatatcaaaagggggtaacatgggataaagaaagatcaagaaagttatatgtttattgaaacaagggggacagcatgtttccatgttgaggtgatctacgtgttaaacatgtagaatatatctcttcatatgtccacctagttcattcatttgaattatttttctgatgcctggcttttgaatttctgacctctgctctaaatagacataactgcaactttacttaaaattcaaagataagaagtatggaagcatgcattatcagaaagaagataaaattatggaagcttacaataagatcaagtatcttgagtagctaatagtagaagttagttattttactgtggaattttattacattttaagttgccaacccacacaaagataatccttgtggacatctatagagaattaaattttcagttagctaagatgctataactttgggcataaacttgcatttatagctgggcatgtaaagcaaacagatgccaattggttgggacagtactattaggcatatccccttagccaataatgcaaataagttagccttgctacagcaaagttttgccttgcctttgaggaatggaagcagattaaagcagggaagagatgtcaatatcatccatactttctatccacaaaactaatcagaaaatctttgacatttactcagagtaataccatacctgaaataggtgaatctatgaattcttaatttagtaaatctgttagaaacaggtcaccattttcaaaagctgttacattaattcactttggtgtaaagcattgtctagcactatttcagcacccagtattgacagaagtgatcacttgtgtcatcatatggcacacacttttccgaacctccatatgcttttggctacctgtctttctattttgtacactttccctttgaatatttttaggtttgcaacacttttatgtgattatcatagtgttaaacagaagttataatttactgtccaggattattttacatataacatgtaactgaccctttcagatgttttttattattacataacaagcttatcaaaaagaaaaattgaataacttagaaataatatttattaaattgtaattattaacctgttagcattaaagtcaggataagatagctgagctgtattgcaatttcaattacaaaaatgcgtgcttattcttcattttggaagcccgccaactaaagaatatattaggcagtgaacgcaacatgacaagccattcaattcagcaatttctagttggtcagatacatcttcaggcaaatttaacctttataaggcttattcttggtctctgttttgtagagattacagaattgtttattttaaataaaaattatgttgagagaggtataatctaaaagtcattgaaatttccacttctatcaattttaggttacatgctgctaggtaagaggaattaataaaagtttagaaagtcttcattcattttcaaagtaaactgctagtagagaaactgccttactttctaaaccttaatagaatacgtttttattgataaatgtccaattcattgacttttgtcatctttcaattaattgcttacattttttgtttttaataaggttttaaaagttgttataaccatttatcacaactgtgaactgacttgacttgaaaccattagcaaaataaacacctgtattttagtagctacccataagcaataactacatactatgtaagtgccccctgacctcctgaatcctgcttcaattttgtttagcctctgtttaagctcctggggattatgggggcaaccagtatggcttccaaagaaacagagggataagtaacccaggtgtgtcctctttgtgccagtagtaggaactatgccagctggctgccctctggcactgtgcatagtgaacagaatatttcttgcattccccaaagggaaattttagtaaaaggaacacaaatgaattggatcattattcccatttctcagaaaaggtctgtgcaagagaagggcacagacttcattctttgctttatgacacaagtttattaaggttgccattgcagtgatttttgtaaatgaaggaagcatcagaacatcactgaaatacatactataattgggaattacagacagtaataggatatcctgacttggtaatgagaagagaaaatgagacttccctaaactttttctcagtatgtatgatcttatctaaaacttgaaattttggtgtctgcacaaaaacccaactcaaatatctcagtggattaaaacagcaaaatatatctctcttgtactacattgtgcaagggagcttcgctcatcataatcactgaggaccacaggctggatgggagttcctgccccatactttcatattatcaaatgaagggcacaaaggggtggccaaacacatgctggcacttcaggcttgcccccatgttgcttttgctcacatttcattcatcaggtaaatcacatggccacacctaggtacaagagggcacagaactgacatttgtaaataactctaaaactactaaacatcccgatgctgaatttgtctcagtttaaggaaatgtcagcagcaaaaattagtgccatgtgctgggttttgacagtagtaagattataagcattttcttatttagtaggaaggaggaggtttataaaatcaaatggtataatgattcttctaattttttatttagaatttttattttatttatttatttaaaaatgttcatttttattaactaataaactgagatttaggtttaggtataattatgttcttcttaggtaattataaaccatcagtggaacatgcaatttgaaatatctgattactccctgacacagagtctggtaatagatgagaaaaaggctttgtgaatcacggttctgattagagtgtagaattatgtatctaggaaccagattgttaataaggtggcaaagcccatttatgctagaggaaaaagaatattaaatagataagccattaagttaatttgcttatattcttttaaatatggtatttatagattacatacatatttaattccatgattttctgtgttaaaagtaacattaattccttatagaaaaatttgaatatgcagaaatgaatgaatacaaaatattataaagtaaaaagcatatgaagttagttgctattaatatttggacacactttattttagttgcacacatatatgtgtaaatatacatatatcatttatattaagtggacactttcctatgtccgtattcttcatgaatattattattaataactaaataatgtttcatcatctggatgcatggcattctatggttcaatcaaattaaacaccctttatttgaaatttaggtgtttctagtccttcactataataaataacgatgcatagaaaactttatatgtagatcttagcaaattggtctgaatattttctcagagtacgtttttagaaatggacttaattatggaaggtgtttggtcattatttaacataattgatacatattgccaaatttctttctagaaagtttgcattattaccagcagtgtatgagagcacctgtacaaatttacatggtatatatattgaacctgttatattaatgcttacagataggctttataaatcttttaactgtttgctaaatttcgaaagatgggttgttgagcagatggattctcaaacttaagcaagcctcagaatcacctagaaagctcactgaaaacagattgttgggccccattcacagagactctgatttagtaagtttgggaaggggtttgagaatttgctttgcaagtaagtccccagataatgttgatgcccttgtcagaggcttgcttttgggagaactgttgaaattgactaacgggagtttgttttaaagtaatagtcattattcttcaacatagtaaaaataggcacttacttaactttagaagctaaatattttctaagcatatcaatttttgtgggttagcctttaattgtattctaaaagtgtttcttaaaataattccttctatgcaaaatactgtgcatactaagaaaacataaatctaaccatttcctatgtttttaaatcaagcagatcttttatctctgttcgttagtttatgacacaaataagaagtttagtcaagaaatataatgttaaaataatgatgctgtgaagtttctaagtgaatgtttatggttgtacatcttttttttcattttatggcttcagccttatcttatatgagtcaaagttaaaaaagtttcagggataaatttaaaatacaataaaactattttgttttatataaacatctagaatagaaactttaaagactaattagatacttgaggagtactaaattaaaaatatttaagtacatttgggaaacatcattttgcaaatatcatccttctccctacagtctaaagcccaagaaatgaagacaaacataaaggtcaagtaattgaatagatatatgagtaagaaagacttttcctgacccattcgtattttcatacttagattgtgaatgtcaattagctcaatcaagccttgctgataatgtcagctgtcagtcactcctaggtagtgatgtgtgaagtttgtcagcgggtaatgggccatttgagtgatgaatgaaataatgagggcacagaagcctaagcaaaacgtctccatttttggtaaattcctctccacatgggaaattaagacaaggaaagaaaagccatataaaatctcttttaatacggtgtttattttaaaaatatatatcttaaaatatcttttaactttttatttttaaaaattaatttaaatggtcagtgattaattatcatttcccaatagtattgatcagtgtaagcaacattaggtactgcaagagataagcttgctcccagattcacgttgatattttgacttgaattgaatatttaaatcgaacttcttcagaagtttatcagcagactttctgagtccatggactatctatactaataagaccttgctttatatctctgaataaagtgtagtttctttctttaggcttaacacatttcttgttagtgttctagtaggtatttttatctgattgctgttagagttagagttagtggaatatttttcttttcttttttttttttgagacagcgtctcattctgtccattcaggctggagtgcagtggcacaatcctggctcactgcaaccttcgcctcctgggctcaagcgatcctcctgcctcagccccccaagtagctgggagtacaggtgggagccaccatgcctggctaatttttgtattttttgtagagatgggtttcactacattgcccaggctggtctcgaactcctgagctcaagcgatccacctgctttggcctaccaaaatgttaggattacaggcataagccactgcacccagacaatatttttcttttatatcttctgttaattcattgcatactagcgaaacttactaattttataatttgtcagatgtaatcagccatcataatatggtccctttagtttctttttccttttggcttatctatctaaacatctatcagtgtaatcatatctgtaattaatgatcattttatctcctcttttccaatagttttattgcttctttatttgcttattatcttttgcatatttctactctagctttttccagtgatgcatttttttttttcatttatgctgtgtccttcacaggactgtgaatccttggagtggaagcaatgtattctacttatatttgtgacctagtaattaacatagtgcctgaaatagagtagatactcaaatgttgacagaatgcctgattgaataatttttcacttccacttaaaaattgtttggggcaattcctgtgaatgttagttcaatgaacagcaaataacaagatagggaagcagacctctgttgagtggcacagatctagggtctgggggaaacctgggtactcaagggactcatggggaaagaggcctaatagatagcttggcttcccgtgggatgcctaactgatgtattactcaagttaagaaagaggtacccattgggtctttgaaattgaaaatattttattatttttaattgttttcagggtacatgtgaaaactcatataatttgtaaagttcacatcagtataattgaggtacccatcaccttaaatgtttgtctttatgttataaatgtttgaattattctcttctagctattttgaaatgtacaatagattattgtaaactagagtcaccctactgatctacagaacactaggtcttatttcttctatgaaactatgtatttgtacccattattcaacctctccatccttccttctccactgatcttttcagccttcagtaaccaccaatcaattctctgtcttcttagatccacttttttagcttccacatatgagtgagaacatgcagtatttttatttctgtgcttggcgtatttcacttaatataatgaagagatggctgcattctcatgtttattgcagcactattcataatagctgaaatatggaatcaacctaagtgcccatgaaggggtgagtgaaaaaagaaaatgtggtatatatacaatggaatattattcggccataaaaaagaatgaaatcctgtcatttgcagcaacatggatggaactgaaagttattatgttaagtgaaacaggccaagcacaggttttccattttttaaaatgtaagactatatttaattccaactggcccataaagcaataacttcttttattattggtactgagacatatatagatagccagctattaactggttatgaaactgggattcagtaagattatgtcaaaatcaagtctgcttcaatcaatatcccaggagaatattaaacttataatttgattaatatagaattatttcataataaataagtggagtatgaaacaattcatgatgaatttgctatccagctgaaattaacatgccactagttgcagaaataataaaaatagcaatataaatagataatgtttattaagaatttaatgaacatgttaggtgactaacgtgatgaatgctttgcagagattatctcatcttcatgcagcgtttaagacaggtatgattggggttgcattttacagagagaaatatatatatatattttgaaagcttgttaaatagcttgcctaagttcacacttatatgtggtggagctgagttgctaaggaaagccattattttaaccctgacttttatttcacatagaaagctttaaaataaacatgagtgccagagccttactctcaaattattatttaatttatttggggtgtgactcagtgatactggtatttttttaaaaagctgcctagtgagttcaatgtgcactttgagttaagaccagtgaactattaaagcacactgctgagagcttagctttgccttccaattgtatcttgtcaatacaaaaaaaggttatgttttttttgcttggaagaataattttaagatttattttacctcttctatcctgcacacattgtccttatttatgtatctcacatttacctcactgatcctgcctacccatgtattggccattgtctcctgaaatatttcagcacataggctgggtgatataagaaatctaatgtttacctctgcaagtgaatctatgcttagattggattgtttttactagggttttgccgctctcgatgtaaatctttttttaaatagttgttcagttatcattatattttactattttattagctctactaagtaggcagcaggacctagttgattaggtcgtattaaatacctctttctatgattattggtttaacaatgcttataaaaattgctgtgtttatggtttcagatattttcatgaagttcaaacaactatataagactggatttggatccatcttgctatattttctaacatagtaatttacccttcccctatttccaacccaagcatcatcattaaaataaaataccagcaaaacaatagaaaaataggcaatcagcataaatatgcaattcagaaaaaatgaagtaaagcaaataaataacaaatataaaaatgtttaacttaattatatatgaattggcaataattttttccataggctttttattttacagatataaaatagtatatatgttcattatttatattgacctaggtgttacttcttttagaatgtaagctccataagggagagaattttgtctattttgtttagtgatatattaaaagaactgaaactggtgcctgtcataaaattgacactcaataataaatattattcaaaggaaataactattgaaagaatggatttttttaagtgcatgtgtgtatgcacgtgtgtgtatacgccattaacaaagatatggtaaattgcacacagtactacatgactggcagcagtataattggtacagcttttctaaaaagcagtctgtgaaaaggtatcatgtttttctcaaatatttattctatttgaattatttacacttctagtactatgctttaaggaaatacttagtgaagtgcagatttatagaccaaaaactctgttcataacattgataaccataagagagacaaaaatcactgaataagtaaaatgtggcattcatcattccttcaaaacagactaaatgatgtgaaaatgcagcaatgataaatgaaaaacgagagaagacaatagagcgtgcttccaattttgtaaaaattgagagagaaagatggaaaaaaattaagtaattaaaccacagtgttaatagtatttatatctgggtggtgagactaagcgagcttttaagtttttgcagaattatgaaatgcagaaaatttctatacgaatatgtactactttgttaattagaaatatattatttcacgccagaggcggtgctcacgtctgtaatcccaccactttgggaggccaaggcgggaggatcacctgaggtagggagtttgagaccagcctggccaatatggtgaaaaccgtctactaaaaatacaaaaaattacccgggcgtggtggcacgcgcctgtagtcccagctacgcaggaggctgaggcacgggaatcgcctgaatccggaaggcggaggttgcagtgagccaagatcccgccactgcaatccatcctgggcaacaaagcgagactccatctcaaaaacgaaaaaaaaaaaaaaaagatttttcatgcctaaaataatgtttgagataaataatttttgaataagtaaatgggtgcaaaaattcatgatatgagccttctctcagagcaattttaaagaattagctgtaaggggattcataacttctttttttgagtacagttaagcaattactctatccttcattatgtgttgagtgcttatttgtagcatgtcttttttccactgaggaaggactactttctcatggactgaaaatgctctttgatctgtagctatggtttgcttggtggagcgggcggtgaccaagaaatgacagatgtggattctaatatgtgtgatttgacaggattaatagaaatggtttactttcagtaagtgtttttaaattagtactgtgtccttagatttaaaaagaaaatcataatcaatcaattagcaaatgttaactttgttacccaatgaaagtgtttttagtcggccatttataggggacaaaaggggcataagaattgtagactttcgactgctgacactacggttgggcctggaaagcttatttaaaaaaagacaattaaccaataatatatgacaatgctatattgtgcttcattggaattcaaatagggagtattttcaagtaatttttaacatgtaacatgaggcttagaattgaaattggttatataaattgatatttgccttatttaaaattttatctttttaaatattttctcaaaactaaaattggaaatgaaggacttcatgtaaattctgggcaaatataatgtttatgttgtaatttaatattaaatcagagtatcaacctgtgcagtgattttgatatttaacacagagctcttgtttaatttttttctctaggattcagaatttcccatagatatgcaaccaaatccaaacctgaatgtttctaaagaaagtctttctccagcaaaatttgactacaagctgaaaaacatttttagactccatgaacttccagtgagctggtaggatttttgatgttttattaatacttttgagattttattttcatgtcaaaattttaatgctcttacagccattcatggttgaaatggtttgcttttagcctttcaaaattgctactcatagcatgaaagaatctgcttatagtagctgtaagaatcttaaaagtaattggtttaagcacttggtggcagtacagactaagtgcactattgtgtattttattgtagaggttggagtaaaaatgcacaaatcatttttagagaagtttctaggattactttaaagataggatctcagcaactatacatttcatttgtttattttactcaccaattttaccaatgtactttttccctgttaataagttctttttacttgtttgttatgaggactgtaattttgtgaactataattacataggtttaaagatgagacttagtattactcaacatttattgaaataaattgttttatgaatctgcgtatttatattcatacacatttattttaaatcttataaaatggagagtatttttattcaaaattcaaaaaatctgtagaaaatatgcatatataaaccttataattccatggtacatttacatttcattaagtggccagcttttgttgataatcatggatacatcattttaattatggtttagtttatataagtaacattattttcttgcatttggtcatagagtcccaaatttatgtaattgttcttcaagaaatctaagacttatacaaaaatatatggcatttgttttgtaattgctcctattatacttaaggaggactaatgactcagaagagacattaaccactctttaacacatatattttacctatagtgagtatttttttttcatttgcaaagcttcctctgctcttgatgaccatatggcatgtgcaatctacttcctaaaccccatttgtttgattatttcctcatagcaagaatattgtctatggtatatgtcgtgagaacatagcacatatgaatacttctgtcataaccaaaagcagtaggtgaatgaattgaaaaggtctgttagtaaagggaaccataaaaatgatacatttataccttagtgttctatttcaatgtaaaacaagtgcctgtacattcatatgctagtcttttgatgtaaggtcgtgactttttcttatatgtctatcgtttggaattctacacaatatttcttacctaagccatgccaataatgcatcttctacaatttcaatttgtcatttcttttatctaaaataagaacttcagacaacttcagatgatctccccacctttttgtaacattaattttcattgacagtaattctgtttatccttctcatatttcatcaccataactaatgtttatactacaataacaaacacaactggcttataaacaggtttaggaccaaactcttgggactctttacaatcatgaaccttggctgatgggagtggccaatgctggtctacttgtgtgattagagagctctgagcagttggggttcagtgagtgcagcttgtgtgttttgtggagataatggaacgtgttagtcaatacagcaattaagtggaggttaagggaaaagcttctattaaatgaaaatgtggagaagaaacagagggaaacatttagctctcagtcaaaggcaaaatatggatttcagcttaatttatttccagcctttggaaagacagctgtcctgattactactactgcaactcaaggaataatggttttgtaacaatcttcactagttagcctattaggagggaaggctgtcacattattagtttattagtagaaaaataaatcggtaaaggaaaaataatcactagtctcttagagtaacataccgcagtggaagattaagttgtgactttgggacaacttacttacatgggacactttttgcctgtctacttcatttccaattggtctcattttctgcttccttatactactatttctttttttgctgtgtgtgtttgtcagtctcccaaacacatggcaaaagtagtagtttattctgcgacttctttctctgtactctcattctatactaccagtccttaactagacataatataaaactcaatttaaaattgttagtgtttctcaaatagtttcataatctgtgttcttaattttaaaaccagtggccgggtgtggtggctcacgcctgtaatcccagcactttgggaggctgaggtgggcagatcactaggtcagattgagaccatcctggctaacacagtgaaaccctctctctactaaaaatacaaaaaattagctgggtgtggtggtgggcgcctgtagtcccagctactcgggaggctgaggcaggagaatggcatgaacccgggaggtggagcttgcagtgagccaagatcgtgccactgccctccagcctaggcgacagagcgagactctgtctcaaaaaacaaaaaaaaacaaccaaaagaaaacagataccaccccctctacagacatacacatacagaatcttagtaagtctacaatacagtgtttattgacccaattatatacttttttaaggaaaaaagaaagttgttttttttttttttgtgcttggggactatgtatttttaaaatttatttttgtttttcatttgccatcagtggaaggaaagttcttcagctatggtgtgtaggtttcttaacttcaaaaatatagcagtaaaagtaatgacaatgataatggaaataatatcaataacaatgctttgctaagcctctataagtgccaggattcagctgctgtatacacacactatgtctgacctttgtatttctataaggcagttattatttttctctctctctctcgtttctccttctctgtcacatacatatacgagactcagacaccttgcgaatcacaaagaaagaatttgtgtcagatctggttaacccaaaggcaaactacaaaatagtgaataagccatgcattattttaaataaacaaaatgaaaaaaatctctgcttttatagttgggcatacaattttgccagtaatacacaactatatgacctatgatttgggcaaaatgcatgacaagcacgacctaggataattgctataaacttaaatattaaaataagtagttagattgtgtttaagtgcagaataattatgtttttttcccctctggagaaacagatttatcaaaatgtgtttttataatgtttttctaacaaggtcataataaaataaatgcatattaaaatccaggtaatttaaaaatcattgatgtattactagtttgcattttcatagagtatggtttcataggccaaagaaccagacagattttaaattaaattagtttagagagtttttgagctctgatttaggtagatgtctttcttctactcttacacgatgcttcccatcagcctagaacatgtctttcagtgactgccactagttgtttgtttgtttgtttgttttgttttttgagatggagtctcgctctcttgcccagactggagcgcagtggtgtgatctcggctcactgcagactccgattcccaggttcaagggattctcctgcctcagcctcctgagtagctgggaccacaggtgcctgccaccacacttggctaatttttgtatttttagaagagacagggtttcaccattgtggccaagttgtttaaaaatttttttttcttatccggagaactccccatcaaacctatgctgtttcctcatatcctgctcattgtctctaaggaggctgacaaaagtgcggactgaattaatagcctccacttgtccttgccattctcctctgccatcgggttctcttcctttcctctcctgaaactgctcttgccggtcattagccactccccgtgtccaccaccagtcatcactcactcattctcattttcttcacctctgaccactcctgcttttcctctcctgactcctattatttgcatgattctagttttcctgctgactcccaggctcatatccttctcagcatcttcagtgagctgctcctctctggccagatttctggttgataggttggccctagactcaactttatagcttcatcttttcactctcatttgcaggtggcctcttccattctctggctttaaatactttccatatggtggtgtctccaccatgatgtctctcctgagcttgaatatctaataggtttctccaaattttcatctgtccaaaaaataactttggttttcccccaaaagacctaatcttctccttatctccctcatttttgcaaacgtaccaaatctgtgtgaacttactcaagctaaaagcctaggagtcattttaattcctcattccctcaccctgcaattcccaccattaaatctaccagaaagtctgataggtctttcctccagaatatattaattttttccccacttctttctacctgtattactgtggtcatttctcatactcttgcaaaagcctcctaatttaccctgtcttaccccacaataattcactggtgtcacaatagccaaacatattttgaaaatgtaaatcagatcatcagatttcctgctttaaatacaatgatgtcttccccttgttgaaaaaataaaacccaaacttactactgtgtggcctttgcaagatgagactcttgcctacctccttggctgcatgctctcccactctcccttgccctatctcctcaatgacaccagtcttctcactattctgcaaacatgccacacttattcctactccaaggtctttccactaccttctccacagactcccagtattacttctccagtttttacatgtctagctcattctaacctctcttagctcaaatgttacctcctcagagaggcagtgcctgaaaaatgtagctaatatttttattcctcactcccttagtcactttcagtcctttcattctactttatttcattcatggttctcagtaggcatgcagtgttttcctagtttatgtgtggcagagatgggtagatgctcaccaatccagtttcctcttctctgagcccattgggagattatatcttcagtttggaattgaacttgggaatttggccatgtgcctaaaaatgaccaaaggcagtgcatatcacttccagacctaacccctaagacttccagtgggattcactgttgactttgaaagttctaagccatgtgatagaagaagcacggttccctgaaacatttgttggttgtagagttctccaaactttatcaagctttaatcttccagactaatgagctatctctttgtgaaattagatgttaggccacatatgataaatgaattttaaaaataaaaatattgaagagattttcacattcactcattcacacaaaaaaatgttattgaacacgtgtcaggcactactctgggcagttaactaactagacagaaatctgttctgagggagattacattgattgaaggaagaggtaataagccaatagtgaacacatgctgtatttgatggccataaatgctgtagaaaaacataaagtgagacagagggaaactgagtgtaggatgaattcagttttaaagagagtgaccgggacttttcttgagaaagtgatatgtaagggaaacctgaagcaggtgatgaagtgagacatgtggagcactaggaagaaaattagagtcagagagaacagcaaatgcaaagcccttgaggtgggagcatatccaaaatattgtgggaacagcaaggggtccggcatggacagaataagtgaccctggagaataggagggggaatataaagttatgtacttggggatcaaagagcctgtgacttagggccttataaatcatggtaaagaggactttgaattttaatctgagaatgtcaggaaggtattagaggattttgaacagaagaattacacagttttacatacataaaaacaaggtgtctgtaactgctgtgaggaaattatactgttataggggtcaagaatagaagctggtagactagttagcaactatttcagtaatccaagaaaagtataaggtttcctggagtaagttgacagtgatatagaggctaatgaatagtcagattttcattatttttttgataggagagtcgacaggattttctgttgggctggttgtggagtgaaagaaagaatttaagaatgattccaaggtttttggcctgagaacaggaagaatagagtgaccattaatttatatggggaagactgagggaggaacaggtttgaacaggtttgacatgttaaatgattgatggtaattaaacttctaagtgaacttagatatacataggacaccttggactgtgctgtgaacaaagttcataactgtgtatgctgcctagcgaacaggttcatgtcagtactattccttgtattttaattgaaacagacaccagaaataaagttactaagtagcttttactgtgaaaatatgggcattatagaaatgtaacttttggaaaacatataatttaattattatatatggatatgtataatataagctttaagtataaagcttaagtacttaattatacatatccatatatacatatccatatatataatgcttaagtacttaattatatatatccatatataaactatattaattaaattatatgttttcaagagagtatgttatattttaaaatgtgagttttgaaattaaatattttgaaaataattatagatatgtatttttccaatggatatttagaataagcttaaattatgttgtaatttttatgtttacatcccatcaaaacaaacaaacaatatattagagccaagtctatatttaaattttgcatttctaagagaaagaacttatactccatttagcttcaagaaaattccccttaggaaggtgataattacatacaattgaaacacttgtgatcattacttataagtattttacagaataatttaaaatattttctataatataaagatacagtctgctagttttacagtttattatcaaagtactaaggtattcagctatcttctattaaataataatatttatgccattaaattttaagaagaaaggtgtacaatatgcagcaaatataaacattcattttaatgagctatttatctttttggggtgtgttctatgaataaatacattatctaattagtagattcaattttcgatttatttcagattgtctttagagccattgcatgtgtttgtcttcaactttaaagtaagtttgtttagacattgggttttaaaacctgagcaactatcatcttccagaaggtgttctaccttgtttttttttttttttatggtcaactcacagccaaaattatggaaaggctttatcgttggtcacagatgatgcacagagcattttcaattccagtgtttcatagactcggtgatagaccgacagttgccctcctgggactgtaaacatttttcattctcttttaattatctagatctatattaataaccacagtgacctataagaaggcattgttggccatactataattatatatagcaattatgtgtagtgccaacaatacataaaaatcccaccctttaactacggttggtaagaaatgaaactatgcttttctgccttaggatatagtttcagtttttgaaaaattaagacattccatttttacataaaactttttctggagtatattattatggtaaggcaggtctatttccatggactgacaatacattaagaatattccaataaatatagaaagcatctctcactccagcttcctccttagctacatactggtatttcctattacatactgtataacagaaagggaaatgcaagttcaaagcaaaggttaatctttgtaatgcagaatgtcagagaagatggtttagaacaagtaccaatatatctcttgttctctttgaaaatttatttagtatttcaaactatattatattcacacatgtattcattattctgtttaaataattaaaggtggcaagacatggtgaagtatgagcaatcagtagttttgatttaggtgaagcacccatcaagtaatggcagtagtaattgccatttgccaatgtcttggcaagttgaggtgaaaccaatgtctttagtccgtgttaaagtcaatgcatgtggaatggtatcccataattgacttacttattttttttatgatgaatgggttgtaaacatcagtgcctgtgtcatagatctaaatcttaaaccaattttggcaatttcttatagggccatgactagagaatgatattgtcatattggtttatatcattaaatttttcatattaaaagtgcttttatagtctaatagaaagtaataaaacttttattagatttatacaccaaacatataaaacaatattgatgctctgatttcaatttttaaactcctgacattatcccaagctgcaatgactgttaattcagagtacctcatgaaataggacatttcaacttgcatgtcttgtgagcacctcaaatttagcaggtctcaataccagctctcctttttcatcattttcctcatcttcatgctcaccaactttctcccattttatttaatgttattatcatccatatggtcatctaagatgacctgtgagtctttttaacatcctctttaccacttatttgtcacatgcaatccatcacttaagcctgtgtattttatgtccaaaatgagttgttcagtcattcacgtctgtcaaagaccatcatctgtcacttaggcttccccagcagtttcccatggtctgcctccagtcactcctccaacttgaatttatccttcctactgccatcatagtagtctttctaaaatagagatccaatatcttatttgtgctttaaaatctttatttttcaagcccttaagacacatttggctcttccctatgtagctctaaccaatttttttttctagttctattgtgtcctttgcttctgcaccccttatgctctatattcaatgaaatcccttcatgtgttcatgcattggctcatgttcctttgaccattatgtctgttacctcctttttccacttgcaaatattcaagcaacctaaagtatgtttctatactatactagagctcctttctgttctcttgatactaggtacataacatagaaaatgcataatacaggggtgcatagaacagatcctatggattctaatgatttatttttgtgtctgtgtctcccaacaccacagtaaggactcttgagagcacagatcatatcttgtcactatgaatagtccctgacagataggaagtgacttaatatgtgttgaaagaatgaatgcatgacttaagttattatgagtgcctatagttctatagccaggtttttcaacatactgtgtattatctacttataacctggctatcaccagctgtcaccctctcttttaaaatttatttagcttgaatgtcaagaaatttatatgaatgcctgtggtataattttcctactcattatcataaccataactggcattctctgtgcatatagggtagctataaacactactctcgtaataattagagttacttctgtcatatgctcatgaccaaattctcttgcccttttcagaaagcacaaaagaggatccctttttttcagcctgccttattctctcagaattctaggtttcttactcttgcttgtctgttttctcaacagtcatcccccaattctcatacggactttcttgtccctgtttccagacactggtttctttagtattcctaagactttcactggattcttgaatcttctgctttttcctcatctatttggccttctcgattctaaattttgacagccagttaacctttaaacttgagcttgctaaactgacacctgggttttcactccataatctcccagttctattctttaactgtccaatcagattcttttggcacctgtatttcatatcattctccatttggggaatgaggatacacctgacaaacccacagaatgctttcatggggaaactcagtaacaaatataaatttagagtatattgtgtattctggattgaatccatgggcttaggacttttcaattgatgaagagtatatgaaaggaaaactaggcatttcaggtacatttgatatatgaatgtcacagatatggagtaaaatgtagtcaaaatctcctccctttttcaataagaccaccaataggaggaagataattgatttggtcaaggccaagaatataattgggtcatatcgctaaaacttgcaactttatgtgagaggagaaaagtggtcttgaatcgagaaaaacccagttatttccccttggttttcttcacgcattcaatggttgtatactcaattcctaccttgtgttctaaacattaggaattaaatggtaagtgagagagagagacagagatttatttctgtgcttctttttatcattacactagtacaacctagagatccaattattgactatgggcctagaagaaaaggacagagaacgaccaatgttattttaggccttagagtggggtggtaggtaataggttgaaggagtccagctgtcatatttgagagcggagataaactagtttgcatttacccagagttctttttgcatattttcttcagaaggaattaaaaggtgcccgagcaaggacttgggcctcctagtgtccaaacagctctagcccctaatcacggcaaagcaatatcaggaaagggataagaaagttgaaactgtgtaggtcatgagtaatgagataatatgttttatggtatacaaacacatgggtaattcttggtgagggtagagaccgttcccagaggggaaaaagtacctgtatatttctaatctcctatccaagtactcaccaggtctaaccctggttagcttccaagttttgacaagttagggcatgttgagtgtggaatggccatggactgcacattcctgatctcaatagggaattctagactaaatcttttaaggtaacttgtttctgcaataattcttgcagatgccattgacaagttttataactttcattttgttatgttaaattgggctaataacaacttctcaagaagcctaacaaattgttgatattaggtatcattttccttgctttagtaataatattgaacatttattaagctgataatattaactgcctgagaaattgtgatctaggaatagaaagaatttacctgcatttgttttacatttatgcttaaggaaactgaaataacagcacttggtgaaaaaaatatacgtctatgtccaaattttctagcttttcttcctaatattttcttatgcaaaacactatcagggaactgacatgataatgccagaaattctcttcagaggaagctgaattagtatgtcttaagacctgctctgtgtatttaaacagaatgattgggaaataactaccgtaatttcttagtgataattttgagactttttctccttttgtgcaaaatgttgtagtacatttaagtctagttgtttattacatgacaatagagtatacttttcctttttgtgcttggcagagaatgtacatttatttgtgatgtttatgtagatattaaaaatagatattggacttactatatactaaagcttagttgttctagaaaagtaattttatcgattttaatctttactgctagtcatattgctatttacttatttttctttttaaaaaacaagccaacaaaaaattcctgaaaattgttaattaacagatttagatactgaattagcccaatcaaatgatgtcttaggctattaaccaaagtggtttaagaattacatacatttatttttatttagctatttccaaagtgattttttaatttaaatagtggcttttattctggaataggacatagtaagtaaaacctttaaaaaaaattcaaacgttgtatctttgttgttgttgctgttcttttttgagacagaatctcatcctgtcactcaggctggagagcagtggcatgaagagggctcagtgcagcctggacccccagggatcaagcagtcctcctgtctcagcctcccccgtagctgagaccactggcatgcaccagctatttaaaaaattttttttttctgtagagatggggtcttgccatgtttcccaggctgatcttaaattcctgggctcaagcgattcttctgcctcagcctcccaaattgctaggattacaggcatgagccactgcacctgtctcaaaatttcctttttatacaaggaaccacatttataaataaaaatattttattttttatttgttcaccctactataaagtcatttagatgaaagtagaaactttgaaataataggctaaataaaaatgtgatttatgaattagtttatgaatttctattaagagatcagcaaacagttatgcttaaatcttggatgatgttaccacaatgatgatcacaatgaacattttttgaaaagttgaaccaatcacgttaaaggcttttcacataatttctcatttaatcctatgaacagttctttaatatggtactattattcatccattttacagaggagtatatagcagttgcccactttcccatctgaatatctgaatctcctactggctatcaacttctttgggaaagaactggctcttctttacatattctagcatagtagagcttatgacaacatagttggcacttaaaacacagtgacttgatgaatgaatgagttcctagaaaacagtgagtctgaattttctagtcaagtcatatgtacaacagaagggtcaaatataggtgagttttaaagactcttcttaataagtatgagttagccagtttctcaaccttagacatttacccttgattcccatctatatatcatgaaaatttaatagtaccgattactatgtatctgtttatgtatcttggacttttggaagtccacaaaacattctaatatctaatattgtttcacctcccccatgaatcaattttttgcctctgttggggcagctttgctctgattgagaatatatgagttaagcaatgggtgaagacattgaaatgttgatttcctcagaaaggagggatgtagggttttgctctttgcctaccttctttatgtgcctcaccatcttgttttcacagtgcttccttttagatatctttatgacattgccataaaaggtcatgttggcatattaccttaaaatactgaaaaggtaccattttagaagaacatttgatgatgaagtgaagcaacagccccattgctcctcaccacccctcatgcccttcaggtctgatttaacctgtaatgtgacttcaatattttaaggtgagatcaaccttttctttttggagaggtattcataaaaaggctaatgacccacttgtgctcataaggaatgacacagggaaacctgggggacaaagctaccaacttttcttctttggaggaaattttcccttagcttagcactatccttaaaaataaatcattaaacaagaacaattttgtgacaaggaataaagggaaattggtaaatgaaagtgaaatggtaaaatacagaggtttaagagtttaaaattaaataaattaaaatgtggaaatgtaaccggacccaggttcagctcctcaccacttgaaagccaaacacagaaggtgagggttagtgggaggaaaagcaggttttaattggaaagccagcaaactgagaacatagtgaactagtactctaaaataccatcttaaattttacagtttaccataggattttttaaggggaactttgtatggcagacatgtgggagtggtgcagggtgcagggtctgcgtgtcttgttctcgtggctatcttgtgagttattgctggtctggaagtctgattggcattatcttcactctccccaatagtggtggaatgattgtttgtgactcttgctaagcggaaggactatgcaggggctccatgcctggtttgtagcaagattagattttggaatttcttaagcaagaacataattagattagcatgcattgccagagggcagtgtgtagagagggaaggaatgaagaagtgaaagtggagggaaggaagaaaaagaaagagggtgatatttaaaacctgggtccctggttatggtaataaaacaaaacatctttaaattttaatcagggacacactttaagaaataaagattaaaggtattaaaataaaagaaattgagaggttaaaaacctgaaagtagaaggcagcaaataaaaaagttgaacttgagggcaaaaaaattatttttagtttaaaaataaagacaactagggatttctttatatgcctagtaaacaaaaatatattagaagataaagaaggcttgttggaaatagggagactaaagataaaagaagtaaggatccacttgaagtttgaaaagggggcaatttaaaacaactagcaagaattaaagcaattggaaaccataaaataatggcaagctgctaggctataaaactgtatgttctatgaagatgtaagaaagaaaatatggtggaaaatggggaaaaaaggggaagtttataaaagctccaagctataatcaagtgaggttgaattctggctaaatgtccctgtggagatgtgcaaaatgcatacatttataggagcccatttactttcacctgatcttaggccctgcctgtcagtgtgccacagacttgcccagattggcaaaaaattcatgcccttcggaattttccaaggcaatgtgctctgtgtctcacagtctttccccctcagacttgctccacagcatagataaacacttattttggttcgaggaagagcatttaagtactggcattcattcaaaatatcatttgtatcagtgacattttggtatttattatcatttataacagcaactgttttgtataaatataagtagacctttctacttgacaactgtgacctttaatttcacctggactgcacatattatatataatggagatttaaagagtattatagaaatggatagggggtatcaatttcaaatgtacaatgtcaaaactactagctgcagttgaaatgaaatttatatgtggacacaatttttttttaccttttttggttttgtttttcttttttaaattatttggagataatgagtaaaattctactatattctggtagcatcactctgcaagatttactctaccatacaaatgtatgttttttggtattctattttgaaaggttgtgttgttataatattggtattgaaaatattgatgagttaatattttaaaacataagttagtatttatttggttaggatgaagcagttgatgataatgacaacttttaactgcaggtaaaattgctaaataatacataattacgtacaacttgtggcagctttgtatttagagataatgatgtttaattgggtgtttttcttttaaaatgaaaatgagtttattctttttttaatagagtaatgcatgctcccctttacttcacttttcaaataccaaaacagataaaccctattaacaatttggataaccattatccttttagaaatccctacaagccccatccctccacacccagtcaggatcatataaagactattctgaaacttgctttatgcagttaagaccttgtgactatccttctgtgttagccattccatccttgtttatatatctgattaatattaataaatcatatataataatatatcatcatttttataaataacagctctgattatattttaatatagctctttatgtacttgtctgcttcatttggatttctttgtaatttatgagatttttgtacttttcctatttgtattagatatttatggatacaatatatttctggggttaagttaccttctagaattaaactacgtctatctaagttaccttctagaattaaactaagtctattaaactaaatctatttaagtgcttaatttaaggaaataaggacaatagatgagaagatagttcttgatgcaataatatttttatttctatgtattatatagaaacatgttaattattttagctattgacttgtagtgaatttattttcttctactagagtatatgtgagggtaaacaggaatattccattaatcattgtaaaaatgtatatacattataaatttcataatgccaggatataatgtgataggtataaatgctttcacttaataaattttatcccaagtgtgtcaagttatattttttttacattaaagtaaaaagaatttctgtctgcctaatttccttctacacctttttcatttatggaccactttaactcatggtgattagaaatccttcctcatcttatctcgaaccctcatctcagctcctcgtggactgaggtttattaaatgatttcctgacggccattttgaagactatttatcacctgaaccatgctgccatcccatctgctaccaatataaattgggatgccttatgttgcgagtgactgaaaatgcaacaaaatttgatttaaagatgaaatgaaattattggattaattaattaaaaagatcagaagtaggaatagctgcaggttaagcttgatttgctgccttaaagatattaccaaatacctgatcttaactgttttctgtcttttgtatcagcattatcctcagttcttctttcatggtagcaaaatggctgaagcaattttagacatcatatgctttcacaatgctctctaggaaaagagactctctttccattatctttcaaagaaacaaaatgtaagttctctttcctgcaagcttaggcaaatgcctccctgtgttgcattgactaatcaaattaagtgctaccccagagttgaaaactgttaccagggagaatgaccactgtatcaagaaagctatcaaaacttaccctaaaggtggggataagtttgaactgataatgaaaggagagggttgggggaagattcctttaaaaaatgcctgggtattattaccagaaagaaagggaatgatgctaaataattatacattgtactgctcaagtttccatcactggtgtctctgagttttggcaccgttgttttaaagaccctgttcttgtactatttagtattgcatagtacaaataaaattaccactgatatcaggcattcagccttttatttggcaatattcatcaaatatactcagaacgttgttctatgtcctggacagaccaaacaaaagaaaacacatctcatgatagtttaagtattagattaaatgacctacataatagtaggtgatacgatttctggagcatggtatgtcctcagtagatgatagtctttcattttgcctatttagaataggcagccctccttttcagcaatgtagtgacctgagacagggccttatcaactatgaatatatctttaagacattctttacctactcacctggacctctaagtgttacttatacctattgaaactcacctttgatttctggtgctgtttgacttgagatggggctaatttgttgacaggatgattcgatctccccactgaatctctgctgccatctcttttctgtcttcttaggtgctcacctgtgtgattctagaaggcgggtctgcttcagctctgatcactctctattatcccttcattttcctctaagtaaacaatcattaatcaatagtgtatggtaagagacagcagttttatgtagagaagtagattactcatttgactggggcaagagcttcaggtaaaataaatgattgatactttaagctcactaaattgaaacaatagccatcacattgtatgctttgctgtggtgattcctcagggatctagaactagaaataccatttgacccagccatcccatcactgggtatatacccaaaggattataaatcatgctgctataaatacacatgcacacgtatgtttattgcagcactattcacaatagcaaagacttggatccaagccaaatgtccaacaatgatagactggattaagaaaatgtggcacatatacaccatggaataccatgcagccataaaaaatgatgagttcggctgggcgcggtggctcacgcctgtaatcccagcactttgggaggccgaggcgggtggatcatgaggtcaggagatcgagaccatcctgactaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtctgcagtccggcctgggcgacagagtgagactccgtctcaaaagaaaaaaaaaaatgatgagttcatgtcctttgtagggacatggatgaagctggaaaccatcattcacagcaaactgtcgcaaggacaaaaaaccgaacaccacgtgttctcactcataggtgggaattgaacaatgagaacacatggacacaggaaggggaacatcacataccggggcctgttgtggggttgggggagtggggagggatagcatttggagatatacctaatgttaaatgacgagttactgggtgcagcgcaccaacatggcacatgtatacatatgtaactaacctgcacattgtgcacatgtaccctaaaacttaaagtataattaaaaaaaaaaaagtcccacagcctttaactccttttactgactgtgttgttattttctatacaatattttcttttcttttcttttcttttttttttgagatggagtctcactctttcacccaggctggagtgcagtgatgcaatctcggctcactgcagtctccgccttccaagttcaagtgattcttctgcctcagcctcccgagtagctgggattaaaggcacctgccaccacacccagctaattttttatatttttagaagagacggggtttcaccatcttggtcaggctggtcttgaattcctgatctcgtgatccacccgcctcggcctccaaaagtgctgggatttctatacaatattttctatattttctatttccagatagagtagaccaaagtaattgatgacctcataagcatgtttcataaatgtctctgagagattcactatgtcttattaaacctttgcctgaaatcttcttgcattattagagagaattaaggtcaaaaacaaggaaggaaaagaaataagcagttttatttatctacccatccattcacccttctacactttcatccatctgtccatctaacctctatttactcatctattgatagactagaaagataaataccaaaatgtacgggatataatctcctggtatgccgttggaataaagatgttctttgaaaccaacgagaacaaagacacaacataccagaatctctgggacacattcaaagcagtgtgtagagggaaatttatagcactaaatgcccacaagagaaagcatgaaagatctaaaattgacaccctaacatcacaattaaaagaactagaaaagcaagagcgaacacattcaaaaactagcagaaggcaagaaataactaaaatcagagcagaactgaaggaaattgagacacaaaaaacccttcaaaaattaatgaatccagcagctggttttttgaaaggatcaacaaaattgatagactgctagcaagactaataaagaagaaaagagagaagaatcaaatagacgcaatacaaaatgataaaggggatatcaccaccgatcctacagaaatacaaactaccatcagagaataccataaacacctctacacaaataaactagaaaatctagaagaaatggataaattccttgagatttatcctggataaatgatttttactaggccctggaaaatttagacatccctcatatagcactttttgaaatctgaaatcctagttattttcatatcacttcaaacccttcctggagatattgggtccatccataataggacaaagtttctagtgtagtttatgggttttagtcctcaaccatagcaaaaggacatagctgcagtttggtatgattttaatataagtacttggatagattgggatacatttaataaatttagtgagataactaatcacattctttaactatttaacattttttttattattttatttttttacagatgatagtcatgtacattagtataacatgctgtcaccattggtgaggcattcaatgaactttcaattgtgaatctttaatgtccttgcaagatataaattcatattaaatttcaacgtaatatggaatatatttgactcggatatatgtaactggaaacaactttaacttggatatttgttaaagctcagggaccagcaatgtgggttttcgcgttacactgcctacactatcacttgttgactgtgcaacctttgtattgataactggacttagtacaggcataattttttaatctgacaagtgtacttgaccatgaaacatcaactttactgaactgtgagtggattaagtgagaaacatgtgtcatatagtaaatacttaatggaatatacctatgtttacctagttataattaatatgttacttgtatttctaaatatatttccaatcctggaaccaatttatagttcatcttattgaaaccaaagtttaaaacacttgctttttcattttgtgatgtttaaactgccatataagtaattctggtttataaaagcatctcagttatgataataatagcattttaattttgaaagccctttggaaaagttattttgaatattaaaatattaaaaatgctaaatggcatttgggtatatgaatatgtaagtaaaatattaatataaagttcttgacttatttttaataattatctctttcatacaacgctatcctgttggtattcagattttacacattgactgacattcagactgacttggcagaatatttttatatgacgttattagctttttatgacaactaagcaaagagagcaccagtaagtaactagattctttgagctaggatgattctcaaatcccatcacttttaaaatatcagtgaaaaaactaacatgatttgaaggctagtttaaaataaaataccatcgtttcgagatttggaaaaaatgtatagttaaataaatcacttagtgtcttcttgaactataattctgcatttttgttaggggtaattttaaataaattggttctaaaggcaaaattcaatttaagaaaataaatgttagatttttctatagcataattattatttcctttttttaaaaaaatcttatttcaccctcaagcacatcaaaaagaatagttgccacctagaaagggcctttgtgctttgtatgtgtatcatgctttgtttttctctggtatttcttatcttcatataacaatagcttttagcattgtattttaaattaaaaatgttctactatcaaacttattctagtgagatttcttgcctttcaaaattacagtattttatttcctttaagtgtctcatattcattctgttttcacccttgatagatgtaaagtcatattatagagctatataaaacagggtggccaatctactaaaaataaaatacaaaagcatattttttttcaaaatctcattttttagtaaaacatttgcactcacaatactttagttttgagctttgttttctttatgaagtccagaaaaacattatagatgtctaatttttctcctctggagaaaaataaaataaaatatattacaccccttttatagagaagcacagattatattttagcttaattagctaaaatcacaacagtcatggttatcaatgaataacagtcatacttacagtatgttattgcaatggtgaaacaaattttcagtggcactgaaaaggcaataagaggtagaattcagttaaaattcaatgatgagggaaagaagcatataaaggggaaagaagataaacaaactagacttttgaacaaggtggagtatacatttactgatttttctgtagtatgataaagttagagagacagacaaaatggacttgaaacaaggtatacatcagttgtcatatcgtattgcaagaaaaaattattttttgcactcaagctacagagccctaaacctatcaggccatgtaagggaagtgcttcctgtattaattactaaagaccatgtgagggaactgcttcctatataattactggaaaaaatgatgaaagattgagaactattgattcacatcacatagcataaactttgtgtgaactggcactttaatttatagccctaaaaattcggctaggagactggagctgtcactggacctttgtacaagagaagggtgtggctgctaaaccaagagattaagagcccagcactgtgcaggtcagattgactccatctggcccctagcagtttcaccaaacactgccaggattttccaaaataagtatcccccatcacatatcattactttctgctgaacagattataaagtactatctccaggcatttcctgcgtttattgggaactggaagttttgaatcctcattgacttgaaagagactgccaacaatcaaacctagtcattatggcactcccaccaagactggaaatagccccaaactgctgctggtaattcctgatatcctcagctttcttatcttccatacatattaattttgtcagcagggtagttctttagggccctcagagtgcttctggaacctgtggagattcattaatggagtctggttgtaatgcattcagctaactccttttaaagctatacctgatgtcatgctgtctgttctatgatcctcttttccactgtcacgtgtgtatgtatgttttgttttgtctgtttcttgttttatcacctaattgcttgtctttttatccttgacttgctgttttgtaaagaacttagcatttatatcttctatgcttctctatgccctatattttcaaaggctcattccaaacctaacgtggtcatacactgtggctgaaccatattctaccttcaatgaatgcaccactttgaggatggggacctacaatttttgaagtctcttctgtatctgtgcttccaatattccatttctatgcatgttctcaggcaatttggggttcacacagttataaaataagtttatttctcattcaaacctgggcaatggagatgttcctatttcgatagcttttctgagcatcttttttttttgcaagtggtgacccatggaatctcagggatttaggatctttctaattttgtaatactggtgtcttcgacacatgaccttcaagattttgagaagggtgaaaacagaatgggatgggagttttatggccagccctgggagtgttatacattttcagagctagatgcaaggaagactggacaatgtgtgctaaagttaaagcacatagcggaatctctgtcacatcgtctttctgctttatacttaagctggtccccttcatatttatgaggtggctgcttgctgtataattttatacttaagctggtccccttcatatttatgagttggctgcttcctgtgtaattactaacaggccatttgcagcagcaaatgttatatccagtgggagagaggaagaaaacttctctctcaatcatagattgcaaatcttttcttatagctttggtcagaaagtatggaggaggattgagcaaccagacaaaattaggattttgtaaggagaggaaggagcggtaaatagataccagacagttaatctatcgtgagtatgacaaagaatcaagacagaatggtatcacagaacaaagagagtagagagttttgaaaagatggagtgcccaaacaggattataatgatgctaattttagaaattagatggtccttggaagctccgtataaatagtcccaaagaagtcatgagattatttctcacattatggtttatggagaagtgcatgaaagctgaggaaatgggcccttggtatttattcataatgctgtgctccatgcagttgactttacttcctaaataaatgttgcattcttgatgaaagtttaggctaaatacagtgagccctcaactttgaagataatataagaatattatcataattagagtttacatcatttaaaaatataatttgcttcattaaaaattactattagaaatttataattttgtcggcatatttttttttattatactttaagttttagggtacatgtgcacattgtgcaggttagttacatatgtatacatgtgccatgctggtgcgctgcacccactaactcgtcatctagcattaggtatatctcccagtgctatccctcccccctccccccaccccaccacagtccccagagtgtgatattccccttcctgtgtccatgtgatctcattgttcaattcccacctatgagtatatttttaacttttaaaattctcagaaatctaaagtaaattataattttaacactgaaattatttgctagtgaagatacaaatctatgctaattgctctaataacctagataattaattattatgcattcctaaaatggaatcctattaagttattttactatgatggatgtaatcattttgataataagtaacctacacatttttctagattaatcacagatgctcttctaaagttgtcttaatgtgatgaattataattgttcacttataagcatcaagggtttttaaactctcttgataaccatattcaaattttatcacctagaggtagatttatatttttattcaaaataacatgtcaggtgttatgcgtcttattttctgcaaaatagctaacttgtatgtaattctgaaataaactaaataaatattcaaactattagataagtagtacgtatgtatatatatatataaacccattctatctgaatcaatttaaaggttacttaaattaggtctttcttggactcagtagcccctactgatatcttcaaactgcactttatcctccaaagtcactcaattctttcaaaacaagaaagcccattatttaacagcctcacattgttagatgcgaggaagtcacattgatgacttccttttacctaaggataaaaaccaaagtcctctatacttcatcctctacctccctagctagtctattgccctgttgctctcaactggagtatttcctaagccatatttgtacacctgctgtgtccctgatgcgagcataaagtatgtgagtaaaaaatgtttttgaaatattatctgctttttaaaatgatgtaattcctttttttccatttcctttatcccatttgaaacagtttggttctatacttatgcctgggggaaaaatatgacagaaaaaggagatgggggagtttaaaaatatctttcttaccttggcgctttaaagtgcttaggagcagaaaaggctcactgcatagctacagcacatcagaacaaatataatgagttaagactcatccaccccttttccctttaccttcagataattttatgggagccaggaatgcaagagatctgttcttcatttcctgacaagaccccagaaaagaaattgttgcattgtgtgtctagacagataccatcacagagtttcagccctccggtgtgaagtaggaattgctcaatgattcctgtactcccaagaatgaaaatgaagtggcagaaagagagctattgaaacaaaataggccatagggagaggagggaaccagaagtttccactgagacttgtgtgatatattgataaattatttaagtgatgcctataaagccggatgatatttaggcttttatggtgttacccccagtgttggcataaaatgggaaaccctaagaaattatgctcaaaggaaaaattcagctaatgcagagaaagattaagaacctacatttcttgcattcttgaaattacactctagaattcacatcagctgtggaaatttatacttacttctttgtgtgtatttaagtaatggcataataaaaataatcaattcaccactgaggtccaatcatttcttcccttcaataagtgcccatacgttactaacatctgataacaaaatgaagcccaagttcttttgtaacattttatctttttcttaaaaaaatgaacttatcttagtgcttctttatttttaaagagaataatctacatttcttacttcctctggaaggtctgactccagagaaaggttaaaggttgcgctatatacccctaagtcttttcttatttttattttctccttcattccagaatatctatttagctattgatatgtgccaggcactattttaggtggtagaattccagaagtaaagacagtctctgtcctcaaagaactcaaaatctaactgtatggcatacttagaaaaataatgcaataaccacataagggggcctcctaaagcaaactgtgatgtggaaatgaatgtcaaaaaatctccctatcataggtagcctttgagtatagcattgagaaatgtgtatatttgatgagaaatacttttttggaaaaataattatgttgtttttcattaaatggaaaaaatagaaaaaagtttcaagatgataattgattttcatattaatgaatttatttaattcactgtgatctaccatcaccgtttgcattaaaacatttctgaggaagtcctagccaatgcaatcaagtaagagaaaaaaaatgaaaggcattgaaataggaaaataagtcaaactgtctcttcactgatgatatgattctatatctagaaaattctagagtctcttctaaatggctgataaaactgataagtaattttaggaagatttcaggacccaaaatcatacaaaaattggtagtatttctatataccagtaatgcccacgctgagagtcaaatcaagagcatgataacatttacaacagcggcaaagaaaacaaaatacttaggaatacagctaaccaaagaggtgaaagatctctaccaggagaattgcaaaacactgctgaaataaattagagatgacacaaataaagagaaaatcattccatgttcatggcttggaagaatcagcattgttaaaatgaccatactgcccaaagcaatttacagattcagcactactcttatcaaactaccaatgtcatttttcacagaagtagaaaaagctatcctaaaattcatatggaaccaaagaagagcctgaatattcaaagcaatcctgagcaaaaggagcaaagctgaacacttcatactacccaatttcaaactatattataaggctacaggaaccaaaacatcattgcacttgtataaaaacagacacatagaccagtggaacagaatagaatagaaaactcagaaataaagccacacacatctgatctttggcaaggatgacaaaaacaaatggagaaagggctccctgttcaataaatagtgctgggacaatcggcccgttatatggagaataatgaaactggacccttaccttttaccatatacaaaaattaactcaagatggattaaagatttaaatgtaagacctaaaactatgaaaattctagaagaaaaccctaggaagttcccttcttgagatgggccttggcaaagatttttggactaaggcaccaaaaggaacttcaacaaaaacaaaaattgacaagtaggacctaattaaatagaagagtttctgtacaacaaaagaaattatcaataaactagatagacaccctacagaatgggagcaaatattcacaaactatgcatctggcaaaggcctagtatctagaatctgtaagaaacttaacaagcaaaaaacaaataaccccactgataaatgggcaaaggacctgaatagacacttttcaaaacaacacatacaagtggccaacagacatatgaaaacatgctcatcatctgccatcatcagagaattgcagatcaaaaccatgatgcaaaaccatcgtacaccaggcagaatggctattattatttgaggcatgttctcactctgttacccatgctggagtgcaggtagcatgatcatcgcttactgcaaccgcaaagtcctgggctcaagggatcctcttgcctcagcctcctacaggaagctgggactacatgctgaggcaggtttttttttcctgtagagacaaggttttgctttgttgcctaatctggccctgaacttctgggctaaagcattcctcccacctcaacctcctgaagtgctgggattacaggcatgagctaccatggctggcctgattggctattattaaaaagtcaaaaaacaacagatgctggtgaggctatggagaaaagggagcatgtacagtggtggtgggaatgtaaattagttcagccactgtggaaaacagtttggagatttctgaaagaacttaaaacgagctatcatttaacccaacaatcctgttactaggtatatactcaaaggaaaaccaaaaagacacatgcatttgcatgttaattgctgcactattcacaatagcaaagacatagaatagacataggtggctatccatggtggactggataaagcaaatattatacatatacactgtggaatactatgcagccataaaaagaacgaaatcatgtcctttgtggcaacatggttggagctggaggctataatcctaagcaaattaatgcaggaatttaaaagcaaatagcacatgttcttacttataaatgagaactaaacattgagcacacatagacgtaaacttgggaataacagacactgtggactaccggtggggggttaggtcaaaaaactgcctattgcatactatgctcactacccgagtgcaatatacccaagtaacaaacttgtacttgtgccctctgtatctaaaaaaaggtagctataaaaccaaaaaatcatttctgaaatgctgaatagaaaccttaaaattttctactgattcatacccttacttttaaaaaagttagctttaacattttatccttcacctgttgatatgatttggcttggtgtccccacccaaatctcatcttgaattgtactcccataattcctatgtgttgtgggagggatgcagtgggagataattgaatcatgggggcaggtctttcctttgctgttctcatgataatgaataagtctcatgagatctaatggttttataaggaggagttttcctgcaaaagctctttgcctgccgccatccacataagatgtgacttgcttcttcttgccttctgccatgattgtgagtcttccccagccatatggaactgtaagtcaaattaaagctctgtcttttgtaaattgccagtctcaggtatgtctttatcagtagcatgaaaatgaactaatatgcctttgattaaaattatgcctaagaatgttaacatttactcctagaaacaaactctcttcagcaatatatagtgcctttgtatgtaattcttctgtagcaatcatacaaaaaaaaaatgaaagcacacatgttttcatagtatactctttgttttgagttgaattgtgtctcccaaaacaatatgttgaagttctaatcccctgtacctgtgaatgtgattacatttggaaataacatttttgtaggtgtaaacaagttgaggacattttggattagcatgagccctaatgcagtatgactgatgtccttattagaaaagaagagacacaaacatacgcacaaacacatacacatatgcatgtgcgtgcacacacacacacacgagagagagagagaaatagagaggagagagagagagcaagagcaagagagagagagagagagagagaatgctaagtgatgacagaggcagagattggagttatgctaccacaagccaaggaatgaccaggactattggcaaccaccagaagttaggagaaagtcatgggatggtttctctttcacagcctccagaaggaatatgctgtgctcgtaccttgatttcagacttatggcctccagaactgtaaaagataaatcttggccaagcgtggtggctcacgcctgtaatcccagcactttgggaggctgaggcgggaagatcacgaggtcaggagattgagaccatcctggctaacacggtgaaaccccgtctctactaaaaatacaaaaaaaaaaaaaattcgctgggcgtggtggtgggcacctgtagtcccagctactctggaggctgaggcaggagaatggtgtgaacctgggaggcggagcttgcagtgagccgagatcacaccactgcactccagcctgagtgacagagcaagactccatctcaaaaaagacaagataaatctctggtgttttaatccatccaacttgtattactctgttacaacagccctaggagactactactgtgttctaattgctctgttcataaacttggaaacaaaatctttccaaaaaatacaaagcattccacaagttttgcttttattgttcacttaagtaacttgtaattatttcatgtaattacctaagtgaattattgtcacataattcttgggatcagtcactcagttggagattcaggtatatctattaaagatcaacagtcagtactgcccttagacttggacaaatcctgctcttgatcctcagaggtcctaccatttggagtgacttccttgacatttttgggtctttctttggtgccaggggatgtctggggctgggagtgccatctgccagatgctttgattggcaggttaccgtatctcaatttatcatttttggagtcctctctgatcctcttatgtgtgtgtggattcaacccaatgccctgtggagctcatgaacttgtgttgatggcatcttttcaggactttaatgtctgggttctggttccaggaaggtggcctggttggtggatgttttctgcttactggtatgataattcttttacacgatcatggaagattgagctactggaaccatgctgatttggggtgacttctcattcacattggacatatgacaattcaaagatccaggtgtgggctcttgccaatttttgcctaggttctcacctgttttcattctgacttgcagtgctgattctagtctgtagcacccaaggacaatcaccacaccttctcttcaggcttgtcagcatatttcaggaagacttccaggatgttagagcctatctcccctgagagcttttgctttttattctcttgctccacaatgccagtggaccctctggttcatgttttttcttgtgtccaatccatgtttgtatgtcgtgcacttctaggtcagtgttaagccatgcctgatgcaggacagatattcttgcatgaatggaactactgatgtgttcctaacctaatctccctgctggtgttggtctgcagaaggccaatgtcaatatcaaaaaaactcttattttagaaatgtactcattgtggtctgaagagttcacaatagtcatgtttggaaatgtgtcattttacatttatagtactcccatgctgtaatgtgttgtttaaaatttatgtgttaccattacaaatggtaaagttagcatgactacaaagtaaattattgtttatgcttttctgcgtgccctgggaagacttgcatttgtggtcaacatcaatgaagcatagcaatatcttttgggagtatcattggaaaccaatattcatgatggatgatgcagccttataagcaatagtgtgagcatcaaataaatggaattagggaactgcagagccaagaacatctatattgttcaatataaagaggttctaaagatctatagcattgctatctttttcctgtggctggctgtaagaaattagccaggaatggcatatttgacagaaaagaacaaagaaattgttccaggtcctgaataggaggagatgggggcctggccactataaggaatctttaagtttgttgattggataataaacacagatgtaaacacttttcactctccattattcgaaagctttattgacaaatcaaggtatttcacatgagacaatatattttaagtaaaattgttcatgtagacaggaacctaacaaaaaatatttgcttgggctacctaatttctagaggcaatcctgtcaacagctatttaaaaaggggggtgggaagagagaactgggcagagggaaaagtggacaaagcctcaggcaatccagtggggttatgccccacatctgactgaaatggtttggcctttacacccctgcctctctcagttactggtccctggaggaatatgaccttatacaagttggctctctgtggctgagacagagaaggtgaagaagctgacagctggagaccatctgctgtttgcacaccccaacactgggcagcaaatcctttcttgaaatgggggtctgggcagcacatctttgtgtctaccacaaatataatttcaggacttagtttgagagagatctgtaaatgaaatttaaatatattctaaaatgcccaaaacttacatgccaaatatatatatatatataacaaacttatatatatataacaaacatatatataaaaaaactaatatatatatgttttaggcattttagaatatatttaaattacatatataaatgtatgtatttatatttgttcaaaattatggagaggcagaggcaactaattattgttaatttaataactattaatagcccttgtcttattaaatttaaaacactttgtctaaaatacttgatttcccaattactaattgatatggtttggctgtgtcacctcccagatctcatcttgaattgtagttcccataatcctcacatgtcatgggagggacccagtgggaggtaattgaatcatggaggcagtaaccctgatgctgctgttctcgtgatagtgagggatttcttacaggatctgattgtttataaagggcttttcccccttttgcttggcaatcctcctttctgccgccatgtgaagaaggatgtgtttgcttccgcttccaccatgattgtaagtttcctgaggccttcccagcgatgtggaactgtgagttaatcaaacctcattcttttataaattacccggactcaggtatgtcttcattagaagcatgagaatagactaatacagtaaattggtaccagtagagtggggtactgctataaagatacccaaaaatgtggaagtgactctgaagctgggtaacaggcagaagttggaacagtttggagggctcagaagaagatagaaaaatgtaggaaagtttggaacttcttagagacttggagggcttagaaaactggaagatgtgggaaagtttggaacttcctagagacttgttgaatggctttgaccaaaatgctgatagtgatacaaacaatgaagtccaggctgaggtggtctcaggtagagataaggaacttgggaactgaagcaaaggtgattcttgttatgctttagcaaagagactggcagtatattgcccctgccctaaagatctgtggaactttgaacttgagatagatgacttacagtgtctagcagaagaaatttcaaagtggcaaagtgttcaaaggaagcagagcataaaaatttggaaaatttgcagcctgacaatgcaatagaaaagaaaaccccattttctggggagaaatttgcataagtagcaagagactgaatgttaatctccaagataatgggaatgtctccagggcatgtcagagactttcttagcagcccctctcatctcaggcccagagacttaggatgaaaaaattgttttgtgggctgggaccagggcccccttgctgtgtgcagcctagggacttggtgccttgtgtcccagctgctctagccatggctacaagaacccaaggtaaagctcaggctgtggcttcagaggattcaagcccaagccttggcagcttccatgtagtgttgagcctgcagatgtacagaagacaaaaattgaggtttggagacctctaactggatttcagagtatgtatggaaatgcctggatgtccaggcagaagtttgctgcaggggtggagccctcatgtagaacctctgccagagtagtgtggaagagaaatgtggggttggtgctgcctagtggagctgtgagaagagggccaccatcctctagactgcagaatggtaggtccactgacagttttccctgtgtgcctggaaaagccacagacaatgccagttgtgaaggcagctgggaaggaggttgtaccatgcaaagccacaggggtggagctgcccaaggccatgggagcccacctcctgcatcagtgtgacctggatgcgagacatggagtcaaaggagatcattttgaagctttaagatttgacttcctgactggatttcggacttgcatggggcatgtagccccttcattttggtcaatttctcccattttgaatgggtgtatttacctaatgcctgtactcccattgtatctaaaaagtaactatcttgctttcaattttacaggctcatggttggaagagacttgccttgtctaagaagagactttggacttggaattttgagttaatgttggaattagttaagacttttggggactgttggaggggcatgattgtgttttgaaatgtgggacctgtgatttgggaagggtcaggggcagaatgatatggtttggctgtttccccacccaaatctcatcttgaattgcagttcccataatccccacatttcttgggaggtagcttgtgggaggtaattgaatcatgagagcagctacctccatgctgctgttctcatgatagtgagtgtgttcttacaacatctgatgtttgtataaggggcttttcctccttttgcttggcacttctccttgctgttgccatgtgaaaaaggacatatttgctttccttttgaccaggtatgtaagtttcctgaggcctccccagccctgtggaactgtaaatcaattaaacctcttttccttttcttttttttttttttttttttttgagacagagtctcgcttgttcacccaggctggagtgcagtggcgcgatcttggctcactgcaacctctgcctcccaggttcaagctattcttctgcctcagcctcccaagtagctgggactacaggtgcccaccaccatgcccagctaatttttgtatttttagtagagatggggtttcaccatattagcaaggctggtctcaaactcctgaccttgtgatctacccgcctcggcctcccaaagtgctgggattacaggtgtgaaccactgcacctggccaattaaacctctttctttataaattacccagtctcaggcatgtatttattagcagtgtgagaatggactaatacactaataaatctgataatgttacaatttttaaataactaattttctacatcacttcttctccacacttgggttttaaagtgctttcttaaatatatccatgtctatgtatatctacatctgtatctacctaggtagagcaataatagatttataatagatctaccagggtagatacagatgtagatatacatatctatatattcttaagtttttatttgctacaaattttataattatctaggttgtacatgtgtttcataaaaaataatagtgtaattataaaattaataaaatagcattctgttcttatcctcatcaacttgcttctccagaattaaacacttttacctatttgtctgttacttatctccacatttctaaatagcctccttttaaaatggatttttctggtttaaagtttgtatctctatttcttaatatcggtatcttaacatagaaaacctatattgcttaaatcatcacacacttcttttctctttattcaccctcctatgcactttctttctctccagtctcccaatttgtaattatatcataatgtatcactaattcaatttttagtgttcatataatactcaatatttagtatttacacaatatgactatggaagtactattttcagttgaatcaagttatgataatattttatttttgtacaaccttttttcctggggttattttcattattttctcttgtttaattctatacacctactacgaattcatcctcaaactttttgaaagatgtgtaaaacttattttaatcaaattggtttcatcttctttcccccttggagatagagatctttccagcacccctttggctctgatctggaccacatgctgtctaggttggctgcacagatgtcaacttggagcctccttttggcagcaccttaagaaactttttggcatctctttgttgaatcccactttctggacaccatattttgttccctcttgaattatcttctcatattgatggagtgcattctccatcagctttaggagaaagaaggcaaagaacttgaacattttgagaacttctatttctgaaaatgtctttattattctgattcatacttggttgaacaaatttctaggttaattttttttccttcagaatgttgaagtattgctacaatgtcctaaacttgagaatgtgtgtggggttgtcaagaagacctcatcataagggtgaggaacagtatctatgtaaaggttagaatctacaggtgttctctctaggctggtttgtgttttccagagaagaaggatccagtgctctgctttggctgaaagagagaagatgactgtacagtctcactattcagaaatcaatttcagctaacctctgattctcacccttcctctcagctgtgcctggtatccttaaagctatctctgccatggatcaatgtctttagacagtgaatcttttgcctcctgccaaggaggatgtgtagtttagggaaggagattggagtctagatgctactgatgtaaagtttctaccagtctgcctgttttcagctttactcagtgcctcataatctcatatttttcagggttctgagagaaaaaactggtttgcttcttgtgagtgttacccctacaagctgcttggttttagctttctcaggacagctaaattggttaacattcatatgctttgcagcttctaaaatgttgttctctctctgcttctgttgctcttttatatttcctttaaccttgtgggatttttgtttattccttattgtcattttagctgagatttaaggagaggaatttagcatcttcatttaatgtattctttaaatcacaacttctgatcaataataatttctgcctttttgcctctccattataatgttcctctccctgaaatagtaaatgtcaggaatagcacaaaattctgatcaaatatggcagagtgaaggttttcattacattttctactccaaaagaaattgcgaaaaacaaaaattacactaaaaactcaacacacagaaaataagacaacaatttaagtgaaacggaatcagccacaactctgaaaagaatactttaaaaatagatcaggagatacatgaaatatacagaaaaacatgcaacaagctgtagaagaaagggtgccaagtgcacacccatctgtatatttcttgcagcacatagaagttttctaaaatacattcactatagaaataaaaattaaactagtagcagcaacatataagctctgctgaaaggtagttatagatatggatgagaggcttgaaaaaaatcaataaaaatataaaaacaaatgaagctgattagacaaggggaagaagaaatgaatcatgatgtaaatatcaaacaaggtggatattgatagaccatagactttgaaaatataacagaagagatgaagcttatatgggattttagttcaggacaaacctatgttttcaacgggcgcccatcagaacctcttccatggccaaagggtactaaatagagtcagtgggtaattttcaggataggtgaaactccaatattatgtttgcaatttagagaaaaataacatttattttctaagatactattataatacctagaaaaagtagtctttggcagggggtgggggtaagaattgagtaaagtttgatgttgtaaataaaactataaagtattttaaagtataatttaattttcagaatgggaaacctgttttggttttaccaaaatcgcatatattaacttttaaatttttatatatagtatgtaacagatgtgtgtgtgtgttctatctttcatacattctaatcttgaatgaatgatttattcatttaattgccttctcaatacagaataatttcaccaaaaattatacgtgtaaaaccagaagtgacttgttacttccctactgaagatattttaagtaaacttagcctcactcccctctttgacagcctgagcaagctggaaacctttcctgtaatcctttcttgtatctaaatcaggggtatccaatttttggcttccctgggccacactggaagaagaattgtcttgggctacagtaaaaaacactaactatagctgatcagacaaaaaaattgcaaaacaatttcataatgttttacaaaggtttacgaatttgtgttgagctgaattcaaagccatcctgggctgtatgttgcctgcaggccatgggttggacaagcttgatctaaatgaaagaagtattaactaatctgaaattatagattcttgaaaaatgtcctttctcagtagataagaattttatgtaacatgatacttggtattaaattctaatgagaataagttttacaacagatttaagttgagcttcagatactcaggctgataatatttctttgtaggatttaatttttattgacacattaatgaaactattctctactttagagcagtagggatgacataaatttcattattttaaggaataaattttattaaattttcattaagttactaaactgtaggatgtttaaaatgtttttaacatgatcaatgcagttaccatggatattgctctttattttaaaaccacctcagaataaattgtggtctgctggtcaaccaggcttcccttctactcctcaaaaaagccctgatttgtagaatttgctgatttctgtattaaaccctgcattatggctgattttgagctatcaatctgatgtcactgatggtgactttagggagaaaggtgaacaatgggctctccttggccatgtgagccagctctagcacactactgcattaacacacaggggtgcatcacttaacaagctgagtgtgttctgagaagtgtgtccttaggtgatttcttgtgtgaacatcatggagtgtacttacacaaacctagatgatgtagcctactatgcacctaagttatatagtataggctattgctcctaggctataatctgtacagtatgttactaaaataaatactctaggcaactgtaacacaatggtcagtatttgtataactaaacatagaaaatgtacattaaaaacatggtataaatgattttaaatggcgttacctgtgcagatcacttcccatgaatggagcatgcaaactggaagttgctcaaatattttctttctttatatccttattctttagacatttttttctatttttaaaatgctttataatttttagttttttgaaagtttttgttaaaaagtaagactcaaatacacacattagcaaaggcctactcagggtcaggatcatcagtcaatatcactttcttccacttccacattttgtcccactggacgatcttcagagattatcttcagagataataacaaggatggagctgtcatctcctgtgataataatgccatcttctagaatacctcctgaaggacctgccttaggctgttttagagttaactctggctttttaataagctagagtatactctaaaatgatagaaagtaaataataaatatataaaccagcaacagcattatcattaccgagtattatgttctgtacataatcatctatgttatacttttctgtgactggcagcacagtgggtttgtttacaccagcatcacaacaaacgtgagtattgcattgtgctgtgacattgtggtgtatgacatgactagggaataggattttttcagctcctttgtaatcttatgggaccaccatagtatatactgttcatcattgactgaaatgtcattatgtagcgcatgactgtaatcatctttgtaattttcttttttctcaaaatttatatacacctttaaaaagtcaagtaggaccagaagcatttataatgaaaaatgatccaaacctcattctaccaacatccttcccagacagaagttactctcttgaactgtttctgtttttagttctgccagttattatttcttcccaaatctaaataatttgctgtaaggctattttttgatttggcaataatatgaacacttccaagtctttcaattagaattattttctattatctagtaactttctcccctctattttctctgttctctacaattcctgttagttggatttaaggtcattataagtgatactcttgtcttttcttccatatattttattcatcttttctgctgtttcaacctttttttgattttatgtaccaatcatgtgtttgtatatttgtgctttttctcattttttcttagcattgtcttcttgcttaaataagaaaatattacttgaatttatgaatctaattaaagttatttataatcttttttaattcctgaaatatctgtttttcttttaagttccttttttcctcttgagctatatccttttattgctggttttcacatacttgttgaccttttgttgtctattcatatttagcaatgtgggatgagtatgatttgtctgctgaatgatttgagtgtcctctttacctatatatgaagttttcacactaggacattttaacaggtctttgagcacctttcatagatgtgcaatgtgctcaggcttcaatttgggatttttctggggaactcccaaatgccagaatggagaagccttaaaatctagtgcataacctatcagcctttgttttgctcatgcatttcttttctgtttattaaaaaagatgtgagtgtgtgtgtgtgtgtgtgtgtgtgtgtgtgtgtgtgtttatgattctctttggcagaatgtgttaggctgcctgcactcagcaatttagcaatagaggagagagaatggatggtgaagaggcacgtggggagtagctgcaagatgcagttgtttcatggacagaaactgcaccaatcctatcctcctgcccccatccccagttttccaggcttttgcacagtacctacggattccaagtccagcgcttctttagagttttgccaaagatatatggatctttttcttatgcagatcatttccatgcattctaagtgtagcttcatttttctgtttgatataatgaagacttcagtctgtcttcatttacccccaaatttttgaaatctctcattcatcaaaaaggtccttcttttttactaatttttctgtaattttattccatttttttcctacacaatcatatgaatatgaattggaagtcatgatctattgcacagtgaatccatttggaatcttacaatcagtgaaccatccctgtacctctttgggagctatgtacattgtatcttgtatatgtacagagttacgttttttagattttgatacaaacacccaaaaaaacactgagcaatcccattagggtttttgtttgcttttaaaaaatactggcatcaagaaattcttttattctaaaagtatacctatttgaaaaactcatatccaaaattctggtttgtaaaattatgagcattatatatgaagtttagaggacatttatggagattccttcatatagaacaaaacaaaatcttataaattattataatgtcatgttactggatatgatttcttttttaaaaaccacagtcaaaatataaatctgcattctttaatgcttcctttgacaaaacaatctttagaaaacatttattgtcacactactttggcctgaactatgaattctaatttaatttttatatactctgtgttaaaaataatttgatttggggagaaatttggaggcgcttcaaggcaattgacattatgaagacaaattctgtttatttcttgaaagtttctcttcatatgagtttaattgaatttttttttttttttttgagatggagtcttgctctgttgccaatgctagagttaagtgttgccatctcggctcaccacaacctccacctcccaggttcaagcgattctcctgcctcagcctcctgagtagctgggactacggctacacatcaccatgtccagctaattttttttatttttagtagagatgtggtttcactatgttgtccaggctgatctcgaactcctgacctcaggatccgcccgcctcggcctcccaaagtgctgggattacaggcatgagccatcgcactcagctgtgtttaactgaatttctaaaacttgaatatgattttataataagctataagtttattctctcagtatttcaaaccatataatacaattcttatgcttctatcttataaccatttaaagttatttagttggttagctatttaaaggttaatcctatgttttaacaatattaaatactttatataagaaatgtgttcatattttatagtaaattatcaaaggaatacagccattcaaaaaataaacattatttgccacatttatttctgtgtatactgctatgaatgcaactcattattcttagaatatagtttctctgtattgtagaatatatacttctatgtgtatatgtagcttttatgtatatatgtgatattaaatgaaaattagcacatatatgcatgaatggatgtcaaatgtcccctatttttcatatatacacaacactaattcatatatgtgtgtatgtgatatgcacatactatctttttttgtatatatgtatatatgctttcaaggccagattaagcagaaggatgctcaaatttctcctccctcctcctatgcctgattattctgcaccagaccttcacttttattgagtagctagggttgggctgacacttttcaggctgaaaggcagaaacatttatcttcactgacaaacaatttgtgaataccttccttgggttgtgagacacttgctctaacacaattctcatctgttttattatggagtccctgcaacatttgacatcctcttactgaatttgcgtgttgtgaaccgaatggtaccataggttgattgtaatatatttttttaaagttcatgccaatttttctgtctttgaaatttagaaattaatgtgggattatttcacctgtattttttaggaaggaactctattaatttttcctctgaatataaatgtaatctgtgtttctattagaaaactatgagaatatgagaaaataccaggaagaaataatatctatataatatctatgatcctactaatcaatgataattgctattagtattttatatatattctttaatcatgtatttatgcataaacatgcatgatattaacttaatgctagaatcatgcagtttatgtttgcagacttttgtttgcttaattttgaatgacattaaaggcttggtttttaattgatgcatgatatttcatcttatgtactttctgacatgtgatcacctcctattgttgcatatttacgttatttttatttttgatattctgacttaaaccatgataaaattcatatgtaagggtttatgcacatctacagtagtttttagccattttttaaggttttgtatgtaacctgatcattcctttagcacatttaaaaaataatatccatttgtgttttcttattgatttataagtcattttttctacaatggtgttaatctttgggctatcttatatgttgcaaatgatttctacttttttggttgttttacattatgtgtattttttatatatatactgtaatttaaaatgtccactttagtacagcctctatggaaaactggttggcaatttctcgaaaggttaaacacacatctactttattatctagcaactttatgcataagtatataccccaataattgaaaacatatgcccacaaaagacttatacaaaaatgttaattacgtctttcttcaaaataacaaactattggaaataatctaaatttacgtcaaaaagaatagtttaaaatttgtgatatatttataaaatggactacaactcaggattaaaaggaataaactatgaatttacacaaaaacacagacgaatcccaaaaacatactcattgaaagaagcaagacccaaaataatgtatattgtatgattctcttgctgtgaagttcaacaactggtgtaaatgatttatagtgtatggagtcaggagaatagttgcctccatgaaggggaaagggaatgaaaggaaagagacacatttatttgtcacaaatcaacaaacgctactattatggggctgaattttgttcccccaaaattcatatgttgacattctaacttcctgcacattagaatgtgaccgaatttggagacagagctttaagacataattaagagtaaattgagttcattttggttgccctaatccagtatgactggtgttcttaaaagaagagtagattaggacataaagacacacaaagcaggaccgtgtaaagacacagaaagaagacagctatctataaaccaaccctgctaacatttgatcttgaatttctactttccagattgtgagaaaataaatttatgttattttattacctggtctatggcaaaaatcaaaaatgtttataaaaatgtttaaatatccagaacccaacaatgtaaaatcataatgtttggcatccaaacaaaaattacctggcataccaagaagcagaaaaacatgactccaaatgagtacaaaaacatcaatcatctataaatgatctggaaataacaatgatgatagaattagcatacaagtatattaaaacatttaaataactacatatcatatgttcaagaacctaaaagaaagcttaagcaagtgtagtagacacaatgggaaatataaaaaagacacaaattcaacttctagagacggaaatcatgtctgagttgaataatgtcacttatgtctgttttcctttgcatttatgctaagtgcatacaccatcctgagataaaaatattaaaacaaacttttttgtaatttctttgcaattttcatttcttattgaaatcataccttaaatgtattttgtatataatctatttttctgtattattaaacaatattcagaactctaattgttttgttacccatcactttctcattgatttgaaatgccagtttttaacatttatgagtgcaggtatgtgtaaatgagtatacgaatttaaaagtctctatcataagaagaaatgttctttagcaattaagagtgcaggctaacaaatgactacattctaactgtaaccttgaccacattttttttcatgagtcttgacagtaatctacttgtatgtaataaatgtcatgtggatagttgaacatattttacagggttgctgtgagatttagtaaggtaatgcaagtacagtcttgccttgaattataatagggacattttaagaaattttaaaggaaatttacaattaaatgttaaaggaaatttaaagcatattttatctattctttcatccagaggtatgtgagtgtgtgtgcacgtttgtatgtttaaggtttgtgtattggattttattttaaatgtttctattttgcctcttaaattttgacttagtcttttgtatagttcacattctttcaagaggatgttgatttttttcttcttgtttttactcaaatttgaataaagaaattgctatttggatcaagcattaggttgaactatatgaaatttcgtttttactgtgtaaaaatcctatatagtgggatttcatatggatcaacttaaaattgcttaaaaatcactgagggtagatacataaagaatctccagtaatgcaatggctgggtcaaatggtatttctaattttagatccctgaggaatcgccacactgacttccacaagggttgaagtagtttactgtcccaccaacagtgtaaaagtgttcctatttctccacatcctctccagcacctgttgtttcctgactttttaatgattgccattctaactggtgtcagatggtatctcattgtggttttgatttgcatttctctgatggccagtgatggtgagcattttttcatgtgtcttttggctacataaatgtcttcttttgagaagtgtctgtttatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagacccattactgggtatatacccaaaggactataaatcatgctgctataaagacacatgcacacgtatgtttatcgcggcactattcacaatagcaaagacttggaaccaacccaaatgtccaacaatgatagactggattaagaaaatgtggcacatatacaccatggaatactatgcagccataaaaaagatgagttcatgtcctttgtaggtacatggatgaaattggaaatcatcattctcagtaaactatcgcaacaacaaaaaatcaaacaccacatattctcactcataggtgggaactgaacaatgagaacacatggacacaggaaggggaacatcacactctggggactgttgcggggtggggggaggggggagggatagctttaggagatatacctaatgctaaatgacaagttaatgggtgcagcacaccaacatggcacatgtatacatatgtaactaaccttcacattgtgcacatgtaccctaaaacttaaagtataataataataaaataaaacaaacaaacaaaaaaaagcaacctatcatacattaatgattgaactttaaatatagtaatatgtttttcaaggaaataattactagatggtatttaagacaattcatacattgttgtgttattttattaaaatgatcacatttttataatttaaaaaaaaaaagaatctccaagggctggtagtggaattctgctctatataagttcagtgatactgcacttggagagtaatagggagcagtgagtggaagcactgccaagcatatacatcttctttctccacagtcaggtgtttttggtttttgatgtctctatttttggcaaagccacctcttaacatttttttttctgtatcttgatttcagtttggtttagtttacaatctacatagtcattgtgcttgtgttttttctgcttcttggttttacagtctgttaaggaatagaacctattgatgtcacaatgtcagttacctacttctctgatgtttcggtcagttatgtttgcttgagtgtttcaggacacctgcttcctgatgttaacatacttggcagcagacctttctcaagcttactcttatttccaattattgcttcttaatacagaaagtatcagtggggtttattcactcactctttcattctttcaatcattcgtgtattagttcagtactgacagtatcaaaagaatgtttgctctacttttatgaggtttttgtctataagattaggtaacaattacaaaacaaatggaagcaatacataattccaagctatgatagtgaaaatgttctaacaaatttaaacccactttttcagagatcgatattgaaaatgactctgttttctttcaatatggtcccaacttctgtacatgtagcaaaaaatttgatgaaatgtttggatgatacatttttctaattaccagagtgattcagttttccctattttaaattcctttggtcatttcaatcaggattaggtaggatgtgatgttacagcctgtgtttaaattgacatcctatgtcaaatttattatatatgtccttaagaaattaggatttactttgattaaaatctttctgtgcctcaggaatgagtagtatattttatgattttctaaggataactttctctgtaatttaaaagaacaataaagtgtttatttccttttcttaaaaaaataaaattcactgattcagttaacctagagaaaacaaccattgtgcatagttactgagggagtatgttaataatcactttttaaaacaatgtggagaatgtctgcatcaaaggattctgccatcaccctaagtattttctccctatcttatctttttttctcctttgactaatagctttaacattgatttagttgaataaaacatttgacatttttaaggttcagtgcacaaaaaatactatttaccattcacagggttaggattattttgtattaaccaaaaaagtatgtatgtacatatgtacgtatctatttatctatttatctatctattatctatctatcatctatatatccacatacatacagacacacacataatcatcattgatatttaggatatttgtagttttctttgattagatatactctgtaaacactttgccagtagaaatgtactgtataatgtgacagtgatctataaaaatgcattttatttcattcaaacttaaaactatgcacataatctggttatcttctaaaacaggtgatatgcttctttagattaagatttgccttcttgtgctttcgggaagggtttgaacaatgagtgatatgtgattgaatttatggtgaagaggcagaaatgctcttaaatattataaattccgtagattcatagtacaacattctcttcagctgtgccaaaattatccctgtagaatgtttttatctagtaatagcagcgatgagtagttgatctcatggcaatgtgataccgcccctcatggacacctgctaaatcaccagtatctgttttatctgaagtcatagcttgtggtgacaatgtttaaatgctcattaagcacattaaacatagctaagttcaaagtgaaatttagctggccaaaaacttattactcgagtcttgtaatatgttttgtacaagtctttttcaacttgtacaactatcactgggtgtttatgaaaaagtccaaacaagttttcactatagaatgtttgtgtctttgtacccatcagacctatttggtgtttggcaaacaaagcaagcaatcatgatttttctgacttaaaaaaatgcatgattgagtgatttcttgctacaagaatttagtgcttcactgtgttacaaccgaacaaaaagtgaacactacagttgtccttgttaataaaccatactattaagcatattaatttttgctaaaagcgtggttaaacaaataataatacaagtacataattaatgaaaattattttcaggttgttactgatatttaaaaaataaaaacgttgtaattttaaacaacttaccaaaggacagaaatctaaatactaagtttggtataatgagtcttttaatttcatctttgtacaccactattttaatgtactgacatattttgtgtgttgtaatcgccttggtcagcacaatttttagataaaggaagtgaaataaatcgagtttcttattagcacaatgataccattatatttcttaatttttttttttttttttttttttgagacggagtctcgctctgtcacccaggctggagtgcagtggcccgatcttggctcactgcaagctctgcctcccgggttcacgccattctcctgcctcagcctcctgagtagctgggactacaggcgcctgccaccacgcccagctaatttttatttttttattttttttgtatttttagtagagacggggtttcactgtgttagccaggatggtctccatctcctgaccttgtgatccacacgccttggcctcccaaagtgctgggattacaggcatgagccaccatgcccggcccaaaaacaatcattgtatttctaactgaatctttatattacacaaagtctgaagttccctaaacttggaacttgggaatatcagtgtggatatacatttattacataattatcatttattttcataaatgtaaatacctttatataaatcaatgaaaatttaatattacatttcattttctgtcattatttcttttcatctttaattaacaaaagtttctcagcctttagttaattgctttgttaatgatttttcaaacagaattagaagactttaatatttaaaggaatatttccatattatgaaaaataatactttaaagaatgtttcatttgtagttcttcacaatttggagaagttggagaatgttcagtgaaatagcatataattatgcattttaattaaagtagccaatgctgtgacttaaaaaatggaatattatgcttcagactttacttttcaccgtaaataaaacaaccacagaaatgccagacagaacaggaacattatggtacctgcagtacactcgggttacatacacacaccaaaagagagaatgtgaaaatctagggagagggatggaagctatttgtgtgtgtatgtgcgcgtgcatgtgtgtgtgcgtgtgcacgcaggtgcactcgtagagttacaagtaaagactagaggggctttcctctgcatggttaatatttacatatgtgctaattctgccattgattaggtcagtactattgttaccatggtttttccttttttgacacttctgtcattgtttcatttacggtgaaaacgaaaggctgagaatgggggccatgaggaaacggaggtctgagtagtgagagcagtaggctgtttgaggatggatttggggagaaaacctgtagtctctagaggaaaatccctcaaaagccttaccattaggatgcagaaattaggacgcatagagtgaaaactgctgacagagtatgctcttgaaacatcttgggccatgcacggtggctcacacctgtaatcctagcactttgggaggctgaggcaagtggatcacctgaggtcaggagtttgagaccagcctggccaacatggtgaaatctcttctctactaaaaataacaaaaattagcctggcgtggtggcacacacctgtagtccaagctccttgggaggctgaggcaagaggatagctcgaacccaagaggtggaggttgcagtgagctgagaccatgccactgcactccagcctgggtgacacagacagactccatctcaaaaaagaaaaaaataatcttgaagattggaggaggttttggctagaatagaagagagaacccttccaagatgtataataaacataaagaacaagaatttcagacctctatcgacacacagctgaaaagaaagcaatagtggtttgtttctcttctgcaaaagcaggtggataattaacgtcttcccttgtctatagaaagaaatgtttttgacagttgagaaattgttttttccataatttaagtcctacccactgagttcttcctcactgggggttgacacgtagtaggcctggggagtggatggagataccaactttatggttaccatatgagtcccaggtgccatcgtctgtaagtaccacaaagtcagagttagtttaatccagcaaaaaaagtctattttcatagacaaattctcaatattaaacctgagctatacttgatgtattaaattagtttgatgagaatttttttctgtaattaaaaagaaacgtaacaagaacacagtttacatgggaaactgtctcatatataagtgaataagtaagaattgtaaaagtctttgctattatgtaatttaaattaagttagtgcatattaaattcttttgaagatggtacttgtggtcattcatccttttcatttttatttatttttacatgaaacctagctaatataattatttttacaaagctttactttcttcagtgttttcttattcattaagaagaaagcattatcttcacattacaatttatttttgggataaaaatttgtctagttcaagtttaaaataaagaaaaataagaaacaaaatattgttatgtattgctgctgtttttatttacttctttctttgtcagtaaaatcctcccagtaagccattgcattaccacaagtttttcaattacttaccctcactgatgtcactaattatgatgcattaaccatgagaatgttaatgcagaaaaataaaaacaacaaccagaaaaatcaaaacaacaaatactaagtataagaatattgcgaattaaaagatgcagaatatttccactgagattatgcaaatagaaagagaaaaaatgagttgatgcagctatgtatgtctctgatagttaatgttactgattatagttcttaaattgttgtttttttagtttgctcaatgctatatattttcttgttttacttgaattgtggaaacatttgtgtcacagaagaacaaattaatcccaatgtaagcagtagaaagtgaataataaaattaaaatgaatcaatggaataaaaaacagaaatgatagagacatcagtgaaatgaaaagctggttctttgagaagatttataaagttggtagatatccagccagactgatcagaaagaaagaagtttcaaattcaataacaaaaatgagtgatggttcattgctacaaattttccaaatgtttaaaagataatcagaaagtattaagaacaattttatggtcaataaacacactttgatgaaatgaacaaattccttgaaagacacaaactaccaaagcttactcaagaagaaatcgatgagctaaagagcccctaagaaattggttaggttgagcatctcattttatttcttttttatgaatggtcatttcatatcttttgcctatttctctattagactctcagtacttttttatttgttgggttttttaaattttatatattgatcccttgtcagttttagacgttgcaaggaacttctctattttttattggttaatttcaactatggtgtcctttattgaatggaaatgtttatttttaatgtacccaattttcctcttgtggattttaatttttgaattttattcagatctttccccattcctaggtaaagagatactctagtacatcgtaatttattttctttattgtttttctattcagatatacatatttaattcttctgcatcccaatttatttgagatttaatgtagcaatcctgttcatattggtaattttccgagatctctatcctgttccactggtcactttgttcttgaccaaacagctttattatggtagcttgtaagtatattttcatgttggtataatgagcctccccactttctttggtctttttaaaatcaaaattgacataaactcttcatgcacttttattctaccagatacaccttgattaatcatattgacttcctaaaaaacactgtatttggaattttcactggaattgtgttgaatttataagttaattttgggataattggaataattacattgctaaatggttttattgatgcatatggtaaaattttgttgatctctttcaagccttttaatagaagctttgcgtatttctcaatgaaagtcttgtgcatgctttgtttaatttctttgagtagcttcccatatttttcttgtcttctctttcaggaatgcatgctagtcaaatgttggacctattgtactggctttctgattttttttttatcactttctctcctagttagtccatccttttttcttctatatggtcccactctctgaataacttctttgactttatcttggaaatattaaattggcattttaattttaagtaacatatataattttcaaaaactgttattcctgcataatctttcttcataatattcctgcttatattctgtgagtacaataccttcttttatttgtaatagactattaatcatggaattttaaaaatatactttaattttaagagcagttttaggttcatggcaaaactgagcagaaggtacagagatttttcatatatcccatacccccacacgtacatagcctccttcttatcaacatcctcaaccagagaggtatattcgttttaatttataaacctacatgaatacatcattatcaccaaaagtcgtagtttacattagggttcattctcagtgtcatatattctatgggtttggacaaattcataatgacatgtatccaccattatagtatcaaacagggtactttcactgcattaaaattcttctgtgctctacctattcatatcgctcccccctcgtacccctggcaaacactgattttcttcactgtctccatacttttgttttttctaacatgtcatgtagctggaatcatatagtttgtagccttttcagactggcttatttcacttggtaaaatacattgaagttttctccgtttctttttgagacttgatagctcatttgtttttaatgttgaatgatattccattgtctagctgtaccacagttcattcattcacccactcaaggacagcttggttgcttccaagtgttgaaaattgtgaagaaagctgctataaacatccgtgtgcaggttttcagctcctttggataaatactaaggagagagattgctggattgtatggtaagaaattaccaaactgtcttccaaagtggctgtaccattttgcatctcaccagtaatgaagtagagtttctgttgatccacatccttaccagcattttgtggtttatggtcattctaacatgtgtttaatggtattcattgtggttttaatttgcatttttctgatgacatatgatgtagaacatcatttcatttgcttatttgccatttatatatctttggtgaatctgttaaggtctttggcccattttaaaatcaagttgtttattttcttattgttgagttgttgtaaatgccttttgtttattttagataatactcctttatcagttgtgtgttttgtaaatattttctcccagtctgtggcttctgtttttattctcttgacagtgtctttcatagagcagaaaatttaattttaaggaaatccagcttatcaatttattttgtgaactctgcctttggtattgtatcaaaatagtcatcaccaaaccctaggtcatctagattttctgttatgctatcttctaggagttttatagttttacttttacattgaaacgtgatcaattatggaatctttgcagttttttctgcttgtatcacttctgcttatcttgagttactttttatatgtttatctactttggttcctgtttttttatgtgggaggttttcctttattgtttggtgatcattgtctcaccattatgtctaagaatgaaacactttacgcttgggaggggtttgtgtgatgtgatggcccaaaacaaaccatcattttaactggagaatgccaaatgttgatgtccataggtcttttctctctgtagagaatcaccttccatatacgaacttccaggaatataagcctggtttctggtgacccaaagctgattagcagaggacttggggggaaggtcactactctttttttagaatgtcattttctctttttgtctttagttgggtgccttacctttgccttactttgaaatggggtccaagtgttgaatttttaaaaataatatatcttgcaatttttctatgaatgaggatgtgagaccaaggactctcaggcctaactgcttcttaaacagactagtcaatttctctacttttactttaatttacatgatttttttaaatcctcttttgtatccctctctgtaaacacttaggcttgctctcttctgttttgctaagtcattaccatttctccatctgtttcctgttcattatattgcagggtggaattacaggtgccccttttttttagcaagcatagcatgtgttattactctctttgttttttgttatatctttaccttgttgtgtttaaagcagaagttagatatgtattttttctacaatgcatttatttatagtgctcagattagtctctgaacacagaaagaatttcataatagtttcagattgaacattacaaacatgtaataatcacaatttaactcaacaaatattttactaaatctcggtaactgtgctaggcaatgggaactccattcttgtggataataaacaaataaaaactatatgagaattggagttagtggtaagtgctatgaagaaaaacataggagatatgacagagtggatgtatattttaaagagtttgttaaagcggcctcctccttgtttcttgatatttctttttaaaatattcttgtaacacaaggaccaaatgaatcactgaaaaattcactcagaaataagagtgagacttgtaacggttagtaggggttataatcaccgtacaagaagtatatctcttctcgttgctttgtctgcctttggcgaattggaaatataaacctgtttaatgaatgtgttcttaaaataccctttggaagtttaaattactattgaaaaagctgtataatgcagttatattcctttgtttatgtagctagaagagagaaggaaaagaacctgaggctaatagaaatagattacatttcactatggagcatagattaaaataatgtattttattgtggatctcccttcagaattcaaactaaatatcatttactttttctatttaagtaataacctcagggctctttaaaaaatcattatcagaagataacctaatatatcattgatatagtttcttcctatcattgacaaatatcatattagaaataccacctttttatagtcttgaaataatataatagaaaagggctccaaaaatgcaattgttccagtaaaaatagtcatggtgtattctttattttatcgaaagagaaataatattaaatccttcccttgcatttctttgaaagtgaatacttatttggtctactcgaattaataatttattttcttttgaatgttttgcagatgtttatatatcagtagtttcatttaaaagagctcttaaatgtcagtacttttctactaaaattagtaaacataaacatttaaagtattctaatatcattttaacctattttttaaagaacagtgtaattgatttttaaatcatgacattttaaatcatggtatacagaaagagtgtgattttagagtaaagagtatttttaatttgagaattaaatcaaatggctataaaattgtatctataaaactaggtacacagtgaaattcccattgtcagcatggtcctgtctccacccaggtaccatactccacctgcaagtaaccatttaatatattttttcgtatccttcggaggattcatttatatgcaaacaagcttgaacatacattcttatttgcccttatgtacctaaaatttagcttattttaaggttgctttgaacattgtttttatcacttacgtctaaagttctttctaaattggcatagaaagaacttcatatctacattgtagtattacgttgtataatataccaagattcatttaatctgtttccaattggtacatatcagccttttgtccaatattctgctactgcaatcaatgacctatatttaaattgttttggacataaaactttacagggaaaagccccagaagaggaattactgaatgcaagggtcaagttcttgtaattttggtgaatattaatattgccagatttccactattgtatcatttttacatttttaattattttatattacccccaccaaaaaattgatagtttatttccttacagctttttttttcggggacggagtttcgctctgtcgccaggttggagtgcagtggcgcgatcttggcgcactacaacctctgcctcccaggttcacgccgttctcctgcctcagcctcgcgggtagctgggactacaggcgcccaccaccatgcccggctaatttttgtatttttagtagagacggggtttcaccatgttggccaggatagtctcagtatcttgacctcgtgatctgcccgcctcggccttccaaagtgctgggattataggcgtaagccactgcgcccgacccttacagcattttttcaagattttcggtttctatctatatgataggtgcgtaatcaaatactcacgacagtttttagtttcagttatcttattataaatgagattgagaatgattttaaaagctactatttgtgctttctgttctgtagattttctgttcatatgttttctccatttttcttttgatgtggttatttcagtttctatgagcccttttttgtatgagataatttatttttgtatggtataaactttaaatattttcccatttgtcattatctttcgagtttgcttatagtctataattcttaagttttgaataaaaaattataaaaactgttttcatgcaaacttttgaagggctactcccgtgtttgatagttttatgattgtatattttatattttaatataaatgcatttgtcctggcttgtcatataaagcgtgaatgccactttattttttttccagatgacactgttttgttccaataaaacttttataattattcttttctcgttatatttaagatgtcaccttcatgatatgccatatacttgaatgctttttctttctacctgtggtctatggaactcaaaatggaactcaattttaatatgaccaattttgtttgtaatcctatttatttcttttctgttttaaaatgttattcttcaaaaagacctataatataacattcaaataggaatttttacattatagattttaaataattttcctatgatctatttaaaaattttctcttatattattttctctaaaatattaaattacagattttatttgatgcattattaataaaagttcaaatttatgagtttctaaaggtattttaatagttaattttgacagctatctcatcaacatgtctaaaattttattattttctcttactcctattcctttgtcaaggctcaaatcaggagtcacctctgtttcttacttctcactctgcagtcctattgattctgactactaaaaatatcttagtttcttcacttctctccaacagcaacttggttgtctctatcttagacaaaattgccatcaccactcatttgtgttagtccaacattctccatgtggaagctaaacagatctcctaaagaaatgaaagtaatcttgccccatcccttactaccaacttcaaaaacttgaaaggcttcttaccttgcagtagtagtgtttgaagtactcatatctcaatatctgctaatatgcattaaaaacaaaatagaacaaaacctcatcagttaaatattttaaaaaggcattttaattgtatgtatatgtctgtatttgtgttcattttatttatagtaaggttaaaaaatttgtgctttacttggatatttgttatttgagggaggtgacatatctcttcatataatttgttcatattattttgtcttattttttgtaataatttaattaaaaattttaaaccttattatgccacttagggtctgaatatttttatagttgtatttgacaaaaagatgcttttaagtttttacatttattcacatctatcaatacctttatgagtttgggtgtgtatgtgggtgtgttcactggcaaatatttacttattttattctaacaccatatttatgttacttccttacttttacaattttatctgtaatttgtttttatataatttgaattaggaatatcacagacttttttttttcagaattaatcagcatcatttattgaacaatgctacttttccaccaatttttaaattctatggttatttatattcaaagtcctagtcttctttctattatagtctgaccatctgacactattttaacactattcaaattatgcgcttttaatgtatatttaaatatttctccttatcttaggattttcatcttcaagaaaatctttagcaattcatttggttccttgggaaaacatgctgctggtacttttatttggagtgcattttatttacaatattcttttagagaatttatgtcttttcaatattgatcaatctcatggaagaatatgtcatggcattccacttactcaagtatacttttttatctctcaagaaattcttgccattttcatcatatcagatctacaaaattcctttaaacttatatgtagttattatgcattatattcactgttacaaatattatgttccaacttttatattccttatttcacttaactgtctaaatttattggctatggggaataaaaaatagtaaagctaaaaatgatcacctttatatcattgctgactttaatgggaatgtacctatagttaaaataataagtatgatattacctgtgaatttggaacagccatttttaatcatgattatgaattatacttttatgcatattttaaattttctttttaaatcaaagttttttttacttttagcattttaaatatatctaataaatactttttatgtattactataattgagagatagctcatgaaatcaagatattttagaaaaattcagaattttcctaaccgtaatagtcagagatttggaaagcccaactcttaattttatttttctttgcttattccttcttttcttctattgcagacagttttcttcatgttccaaaaattaagctactgaaagctttggtcgtttgagagactcctctgaagctccttctggctccaagtccagaaatcattcagaaggcttttctcccaacttttggaccaagtagtctggaccaagataaatgtgtttcattgcacaatatggcttatcttgtagtgatatgtgatttttcactggcattagggggcatttcccaagaaaagtactggcaggtggtcttcatttcaagaactctgcagtattttacttgttgagtgctatttgcatttatagtgtaaatgagattagtcaatgggatttttaaaatttactatcagtattatttttaggttttggtatcagagtatcagaaatgttctggcctgataaaatgaagttgggacacttctgtcatctcataattctgtcaaaatctgtgcaggtttctattcagatctttagatacttagaagtgggcaaagtttctatttcctatagtgttattctgttaagttgggtttcagatagccataggaatagagagagttccttagaaggcatctgagttgaagggacactcactttttgctgaccactttcttttctgtggttgtaaaagcagtctgaatttttcaacagtgacgtccccactccacttctatatttgacctgaataccattttgaagaactagctgaaataatgccagaaccttgcctatcatgtcaaatctgtcaggtaatagatgaagatgaatacagtttttagagtctcccttgactatgcccagtagcaattcccaagatctttataggcttgggaattctatgccatattttgcacttgtctaaatctgcctccattcatgctactccaagtttgggcatactcccttcacctttatttggtcttcatatcagttgtttgtaagaaataggaagtaggaaataaggaaggtgtgcagagatatttggtcctatcagaagcttatttttcctttgtctcctccttattttttgttttaggtcaaagctagtttagccattcttatctgcctttcttgaatttgctccctgctttagtatacagacactctgcgccccataaatcatggaaatgagcattaattttacattttgaattgtggactctgcaggtttctaaaattgcttgatttccctaccctccaccaaccaacaacaaatatctactttcttcccgagccctgcttcttcatgctatggacatttctgcagaaactgctagaattctatcactaaccttcctggtggggctctccttagcatatgctctggttttacatgattctttattttctcaactctagttttatatgattcttcattttctcaactcaactgtttctgtgttgaaatatttatatattgataagctgtgttttccagagctgatataatttattcatttcaaaaacatattctcaaacagtgatatcatcaagatagtggagtaggattgtgatgtttaatattgagtgtcaacttgattggaggatgcaaagtattattcctgggtgtgtctgtgagggtgttgtcaaagaagattaacatttgagtcagtggactaggagaggcagacccaccctcaatctgggtgggcaccatttaatcagctgctagcgtggctaggatgaaagcaggcagaggaacgtggaaggactagactggctaagtcttctggcctccatctttctcccatgctggatgcttcttgccctcaaatgtcaaacatcaaattctttggcttttggactcttggacctacaccagtggtttgccaggggctctcaggccttcagccacagactgaaggctgcactgtcagcttccctgcttttgaggttttgggacttggactggcttccttgctcctcagcttgaagacagcctattgtgggacttcaccttcaccttgtgatcgtgtgagtcaatacaccttaataaactccccttcatatatacatctatgctattagtcctgtccctccagagaaccttgactaatacaaggagacactagccttcatctgtccatacacaaaaaatatggacaactatttacaaaccaaaataccccagaagcagcccacagtcacattaaagaatctgcagcaacccagtggagcaaaaatatggagaatatccacatagaatcactggtaagaacagcatacccaagtacctgagatgccagaagaaagctaggagtaaagaagaatggtataggctatcagcatggttcattgacaggaaccgctgtggttaccagtatcctggtccacagagaacacaggcatctcttgccactgaggtaaccaatagcctcaaccactttaacaatcctctgttaaaagaggggctgcacgctcctccccttcaagaagtggccactgttgaaagtagaggtgctcctttctcaaaatgtatacccatctcttccaaccctgagtatatgcactgaccctggaactgtggctacttcacgagtgaccataccccagacctgggctctgtgactacaataggcgtgatcatgtttcatataccacagccattgccatagtgagctagattgtattgcaagacccagagccaagtcctctctgtggatgcccatcctctagacacaagctcagctactctataaagagctaggttctgctctaacctcagggccattttaactctgcatacacctgtgcactcctgcagactcctctgctgctttacaaacaccctttctttgaatactgttacagacttggcagtgggggagtcagtgccccaggtaccagttctattatcaccctgggttccagagccatagccccttcatgtttgcccatgcttcaggcctaacctcacctctctggcctctccatcagataccagtaccaccaccactacaaatgagtacacaagacagatacagttccaggacagattccccttagtaacaacttctctggtatgagaaaaggaggtcatgaggacattaaaaagtatcaccatcaaagactctaacaacacttgctgccactgtggacatatacagtgttggttgctgaggatcccctgaaatcttcatcaacactgacctcagttaccacagcagcacagagactacatttctggcattctcactggtaccagaaaagctgcactttatccagtaagttcccttgcaacaaccctagacaaaggtctttccacatggaaactaacttataaagtctgcaagaggtccaacaaatgtgcagacatcaatgtaaaagcaacaagaaacatagaaagccaataagatttagcattatgaaaagaacaccatgatcacccagtagctaatccctctaaaaatggagatacgagaacagcatgacaaagaattcaaaataattgttttatggaagttcggtgaacttcaataaaatacagataaataattcaattaaataagaaaaataataagcaacaaaaatgatagagaaatcaaaattataaaaaataacaaacaaaacttctagagctgaaaaaatacgatgcaatggaaagtgtcaaagcagaattagtcaagcagaaaaaaaaatctgtgaatttgaagacaggctattttaaaacacaaaggagaacaaagaaaaaaagaaaaaaaattaatgaagaaagcttatgggctttattggatagcatcaaatacaaatattcaagttataagagtttaagaaggtgaggaaagagaccagaggtagaaagctcatctaaagaaatgatagcacaaaactttccaaacccgagaaagataaaaattattcaggtacaagaaggtccaaaatctgtagtcagattaaatccaaaaaagactacaccaagacataatcaaattatcaaaaaacaaataaaaagaggggaccccaaaagcaccaagagaaaagaagcaaataaggtagttccaataagactagcagtgcacttctcagcagaaaccttatagtccatgactaaatggtatgatatattcaaaatgctgaagggaaaaacaacctgccaaccaaaaataagttttatccagtgatatggttgggctttgtgttcccactcaaatcttaaattgtaatccctataatcctcacacatcaagggcaggagtaggtggaggtaattggatcatgggggcagcttccgacacactgttctcatgatagtaagtgagtctcacaaggtgtcatggttgtataagtgtctggcatttcccctgcttgcactcagtccatcctgccaccctgtaaagaaggtgcctacttctcctttgccttccaccatgattgaaagtttcctgaaacttcctcagctatgaagaactgtgagtcaattaaacctcttccctttataaattacccagtctcaggtatttcttcatatcagtgtaagaacagacaaatacatccagcaaagctgtcttttacatatgagacaagatacatacattcccagatgaataaaacctgagggagttcatcatcaccagacttttccaagaaatgctaaagggagctgaaaggatactaatgagtcacacaaaaaccctgaaaatataaaacccactggtaaaagtaagtaaacaatcaaattcagaatactctaataatgtaataatactgtgtgaatcacttgtatctttagtataacggttgaaagacaaaactattaaaataataatagctaaaataatttttaaggggtaaaataaaaatatgtaaattgtgacatcaaaaacataaaatggggggtggaatgaaagcatagatttattttatgcaatcaaagtttttgtctgcttaaaatggcctgtaataactgtaaactgttttatgtaagaattttggtaagcaaaatgcaaaacctatagtagatactcaaaagattaaaagcaaggaaccaaaacatatcactggagaaaatcaccaaatcagtaaagaagacagctaaaaaatgaagaaaggaacaaaggacctaaaaaacaacagcaacaataacaaaatggcagtagtaagtccttacatattaataatgatcctcaatataaatgattacatcttccagtcaaaagatgtaagggggctgaatgggtcaaaaaaaaaaaaaccaaaaaaaaaaaaaaacaagatctaactatatgctgcctacaagagcctcactttacttctaaaaaccatgtataaaagtgaaaggttgggaaaacatattctatacaaacagaaaccaaaagatagcggggatagctaaacttatatcagatacagtagatcttaagtcaaaaactacaaaaagagaaaaagaatatcattatatgataaaggaataacttcattatgaagatacaaaaattataaatgtgcacctaacatcagaatacctaagcatataaaccaaatattaatagatctggagagaaagaggctgcaatacaataatggaaggggacttcaatatccaactttcaacaaagaatacatcatccagactagaaaaataataaggaaacactggacttgaactatactctttagaccaaatggacaaaacagacatatgcaaaccattccatccaacagcagaacaatacattttcttctcaagggaacatggaacattccccaggatagatcatatgctaggctacaaaataagtcttaacacatgtaagaagattaaaatgatcaagtatcttttttttgaagatgttctttcttcacttctctattcatgtatctgccagatttccaaaataatatcagtcatgatagttttatatcaaaagtcaagaaagtatttcactgacataaaatatttaagactaagcatcatgcttggaatatgctcaaattagtatagcataatataaaaattaagcatatgttatttgtgggtttttttctcagtaaataagttgtattttccagtcaggtgattgagtaatggaccatgtcagacaagcactgcctttagatctctgaaatctgccagctaatggctatctctataataatgagttacctatcacctttttaaatctcttaccagccctttccttgcttagtctttgttattgttttattgtaagcacatacacatgcacaacatatgctctgtttcctgcaattttatatacatgtaatattttgagacagctttgaaagttggaaaattgtaaacctttcaaatattttggcttattgactacattttcatgatggataattatatctaattataattatatgtgtatatataattatatgtataccattaagaatagagtattctgaaaacgttttaaattgctgagtctttccagggaatagtatatgaaaaaaattagaatgaaaagtaaaggcaagaaaagttataaatggtaaaataaaaagcagtagtttatactttttaaataagtttacattaaaaaaaattgagttgaagtctcactctgctgcctaggctggtctagaattcctgggctcaagcaatcctcccacctcatcttcctgagtagctgggattacaggcatgtgccatggtgcccagcttgagtttacattttgaaaatacttcttttttcagattcaacaaaatctgcctattgacttgtttaatcctatcaaattaattttcttctctatatttacatttaaaatgcattcttatgtgattatatatttgcagcataatcctattctttctaaagggattttttaaaaaacaaggaagtcatcagaactagagtaaaatgttcattataggcattttgtgagttttcatttctgaacgatatttattttttctacttggcatgtaagcaatttttttaaaaacagcatttcagaggaacagattagatagtgatccaatgaatgaatactttataaatcttgtttttgtacattttattagttccttataaacatattagtgcttgaatgaatgtaaacatattaggacctgataaagtaactatgtgaaaattagccccatagccacattcccctttcatcttccacagagcatcatactaacaggttctaaaaattttaaaaatgaaacagatgaactcattataatatatttaagcttaagatgtcttttgaaaatcactcaaaatttggtaagaaatcatatgtttctaagataaagagaacaagttggaagctttttattccataaatattattaaatgcttataataaaatatgaataaaatgttttaactacttctaattattgatttagccttatttattacatgagaattttttttttgtgttagtcatgtacagggactgtagagataaaatcaaagtaaaagataaagtctttatgtatctgctcaattttgttgtgaacctaaccacttaaaagataaagtatatttttaaaaaagaaactttatcctcaagaggtttataatctaattaagaatattcactatacaagatagttctgtcataaagatataaatcagatggtataatacttttggtcctaatttggctatttttggaaattcctttttagttaattttacctttttattatggaaaatttcaaacacccacaaaagtggaatggtacaatgagcctccatgtaccatactcagcttcaaaaatcattcgttttatattatttacttttttgctcttctctcctctctcatctttcctgagatgtttcaatgcatgtcgtgacatcatgtcatttcactcataattacttcaatatgtatctttaatagggaaaaactttataaagcacataatcataatggcataattacatgaaaaaatagatagtaatttcttgatattatctaatacctaggcctcattcaaattccttcagctgtatagaattcattttagccatacaagctctgaaggaaatatttaagatataaaattaattttattcttttgacgcaataagaagacaattatgagtgctagttttctatgcctgtctcttctaaagcaaaataacaactgtcatcctgaaccgtctctgaattatctacacattccaaacggagtggcagtgtttattctcattttaactgagagatgtcagcaggtgcatgagcttctaaccttgtgatggcaatgtgatgtcatgaagcttttcagcaaaagaatacaattattgtcacgagcatcaatgcactactggtaattgcaatcatttttaaggagaaacaagaggaaggagaaatcttaccgaatgaaaaaaattaacagctctagaccatttttacataaattgcataaaattatgcttgcttatctaacttacctacagatttaatcaaaccacaaattatgttttagactttgaatatttgttacattataaaacattttctcaatatacttgtaaaattatagtgcatatattttaattttagttactcttacaataagaaatgtataacatggctaaaaatgtacaaaaccttaagaaattttttactggctgtttttccctaaagatataatttcccagtggggtaatagtttaaggtttcatagagacaatcttattctagttaaaaatatataaatacatgttattatttcatagaacaaaaattgcctcattttcaacaaaggtacacttaataaattattctacattacttttaatgattgacaatcaatattttaaacacggcattctgataatatgcttttaatttatataggtattttcttgcatgtttatgctattaggccattaattttgcatacataaaaattttgagagattcaaagataaaaatgcaacctgttccctaccccacccagcctggatatggatacatatggctcatatattgtttatatattataaatattgaatgcattcactcaggaaatgcaaatgtttaaaactatatcaagtccattctgattatcctcttatttccaatttttcttttattaagaagcctccatagaagaaaaggaatgcttaataggtttgtggatctcagcaaaattctagggcataataaagtatttgggatatagaggattataaaaaatgtggaatatttcttatttgggaaaagataaagctagaaactatgtttagaaagtttgtaactccttgaactaacaaaagtcacaatgagtcatttttttccttcataggaaggaaatccacatgcatttcaagcaattctaacttgatgaagagaatccattcagatataaagtaatatcaatggaacaagttttagcaaacctccaaaatataattttataattttaatatagggacatggaaataaaagttcaaaatgcattgaagaagaaaaatgaataatgaaagattctctaaatttatattctcagatccctttcttacatatagctatttttgacaatctctgtttttagtttttctggtgatataagttgtatgttttcgtatttcttaatatgtcacctctaagaaaaatccattgtttctccacaatgtgagttaagaattacttttctttccttgttccacttcctactccttaagagtttattttctttttataaatttagttagtaaaagttcagctttatttcagtctccaactattttaaactactatctttcaactacacacaatgaatgacgaagttagcaaccattaactttttttgtgggggagatggagtcttgctctgtcgcctaggctggagtgcagtggcacgatctcggctcactgcaacctctgcattccaggttcaagagaatctcctgtctcagcctcccgagtaactgggattacaggcctctgcctctacatatagttaatttttgtatttttggtagagatgaggtttcaatatgttggcaaggctggtctcgaactcctgacctcaagtgatctgcctgccttggtctcccaaagtgttgggatcacaggcgtgagccactgtgccaggccagcaaccattagcttttgtccagtttcctccatcttcccaaattctatctgatatgctagtactttaataatttcagttattaaaatgtatattagttagaattacctttaattttttactatagattcattctgaaagttgatttcaatgaatagactttataatattatgattatttaactactattgactacatattctggttggatttgtgcataaaaatataatttcttacatttaaaataactaagagtatattggaatgtttacatcaccaagaaatagtaaatgcttgagtggatagatattctatttaccttgatataatcactcattgtatgcctgtaccaaaatatctcttgtaccccataaatgtatacacctactatgtacccacaaaagttaatatgcatataattctttacctctagcaaaattttgctccctgaagtggtatatgcacacatgaagagcaataggattctactcttaaatgtaatgtcttttttagaatcaagtcatatttttgtttgttttatttcaacaaagacttcttaatgttctatttttacaagaatttcaaactgcctttatttttattatttttatcaaaaaatgccttttgttgtataactaatgtactccagctctgttatcacattatgtcttgaatgttccggtatgtaatgatattgtgctaggtcccttggccacctattattctgaaatttctttttgttgtattcctatctgatgtgcaatgtttcttgaattgcagtttatgctcagccaattattctgtcttgaaactgtctttcattttgctctagcgaaagtgtcttccaatcatttaaaggaaaatgcatgaaggtacattttctgaattcttacatgtctgaagtgtctttattttgctttcatattagattggtaataccaatggccagacgattgaatattcagaatcattttctgcaaatagaagacattttaccattgtctttcagaattcatagttgctaatatgaacaaatgctgacattttgcaggtaggggagaagaaagttcatgtgtttctaggctcttcttttgatttttgttctgaaatttaaccaaaattatgtaaatacgtgaaattgcttttgccctttgtggtgtatttaattctgaagactctgatctttagtagccatagaacagttcatgttatctctttaattcttccctctcctctcttaactcctctttttctggaaaatacaaatatggatattgactcttaagtttgttcaggctgccataacatatcaaaatatcataaactgggtagcttataaacaactgaaacttttttttctcacagttctggagactggaaagtccaagattagggtgctggcagatttgatgcctggtgagggccaatgtcatatttatagatggtgctatcttctctctgacctcacgtggtggaagaggcagatctggtgcctgggaaagccaatgtcatatttatagatggtgctatcttttctctgtcctcacgtggtggaaggggcagatctgatgcctggtgaggccaatgtcatatttatagatggtgctattttctctctgtactcatgtggtggaagggacagatttgatgcctggtgagggccgatttcatatttatagatggtgctatcttttctctgtcctcacgtggtggaaggggctagctagctctctgaagtctcttataaggtcactaataccattcatgagggctctgccctcatctaaacaccgcctaaaggcctcacttcctaacaccatcacgctgggcgttaggatttcaacataggaatttggcatggcgggggaacacagacatttcaaccatagcagtgaccttctgtattcatcttctatgtctctattttgttttccttttgtgttttatttttttagtttttcatctgaattggggagatagcttcatttttttactttcaacacttaacattaattttggttttatattcataattatagttttactttctgtgaactcttaatatctgattgcttcttttaaatgacagatttttttttcacatatgccatatatcttctggaatctttctgagaaagccaattataatttgttcttgaacttttgagtttttgtttcctcccttatcagtatgtgtattagtcagcttgggctgtcataacaatatactatagactaggtggctttaataacagacattaattttctcatagttctggaggctgaaagtcctaaatcagagtcccagcatggctagcttctagtcagaactctctttctggcttgcagattactgccttctttctgggctctcacatggcagacagagagaaagaagtatttcttcctcttcttaaaaggccaccaatcctattggttcaggaccccatccttatgaactcatttaaccttaattacctcataaaagccctatctccagaaacagtcacattgtcaggtagagtttcaacatgtgaattttggaggaacacaattcagtccatagcagtatatggtctttgtttttctcgtttctcttgttattgttttgttcatcttcctcagtgcttattgtttgcacatatttattaacgaaggactaaacatattaatgtacatggcttcttttggttttctctgctatcacatttctacaccctgaatgagtgtgctgattgcaggtgccatatatgtggaaaaacatggagtatggaaaaccagcttcttcttctgctccccctacctgcccattggaaagggaaaggaggaaagggagctttgtgagtaaaaagaagataacatctacctacattaagcattctcttgtgtggatgtgatctatgacttcctcgggttaggttaatctatttttgccattttatcttccttcactgcatttctcttgatgtaggtcttttgctcttgctgatatttcaatgattgactgaggatagaagaaaggagccaaaggcagtatgtgtgcccactctattatgttgaactagtaatttaaaaaaaacgagtatgtctgggaggctaaggcaggtggatctcttgaggtcaggaatttgagaccagcctagccaacatggtgacaccccatctctgctaaaaatataaaaataagccaggtgtggtggcaggtgcctgtaatcccagctactcgagaggctgaggcaggagaatcacttgaacctgggaggcggaggttgcagtgagccaagattgcaccactgcactccagtctgggggacagagtgggactctgtcttaaaaaaaaaaaaaaaaaagagtatgtcattaactttttaagtcataaaaatctgtgaagaaacaatatatgggtgaaatattttaaatgaaattacttgtaaattactgtggtgacaacttgtagtacatgccttgtagcacataaacaattagtgaaatagttgttgatgtaaaaaccaccaccgcctcctaacatttattgaacatgtctcatgtgtcaagcactgttttgagtacttaacgttcattaactttgttaatatgcacaagaatcctgtgagttttataccactattaactctattgactacatgttgtagattaggaaactgaacgtaaaacaattaacagacttgcccaaggtgaaacagctactaaatgacaagagccaagattaaattctgtagtctggctcctgagcctgcacatttaattacatcacattgaaaatattataatcacaaaaatgaattttatctgtaaaaattgaaaaacttactggttgttttatagtcactattattaaaatatttattttaaacaaattcagtagtaattttcttgagaagagttactcaaataagatgtgtcagtgttactttctataataagaacattaggcctagctctacccccagcactaccgccaactagttctattaatttgtttaccttctcttctcttcagttttcttttctgttccatgttcatttcattccacaaggaatatatattgactactacattacaggctctattataagagcattggagacattaatgaacagaagaaagagatactttcttcagggttcttatattccagagggagacatagtccagaagtaaatacaagctcaatatagacttttgcttccagcaatgaaaacagcttatttctaagcaattcttccattgagaactggaaacctaagcaaaacataaaatatcatttgttataaagcatgcgagagctactcaagtgagatttacagacatcaaaatctggaaagaatggaaacacctaaatagatgatcttgccagctgaagctgcttttccccttagtgtttttaattccaaagcatctattgaaaggctgggtggctgagcaggaagtggaagctgagaggttgagaacacaccaggattgtcaggaagcgaaacttagaaataaggcctgccaagagacaaactccctggctttcagttgagatgctgaagggctaggagttaagaatcaactagtaatagcccaggcctcagaaggatggaagaccagttttgaataaggtaggccttttaaatactttgtcccatagcccagatgaatgccagaagcaaaagaggacatactgatgattcaaagcaatgataacgattgttgaagacattttggtagaatagaaggcaagggaggaaaataccagtcctgctaagggttgaatgattatgaggttcatactgggttggaaaaggagtaaaagcaggagaggattcattagcccaggagaatgggaatagcttttaaactagaggtcatggtgactggatacagaaagttgtgatcaaaaagctagtttttccagctgaacagttcaaaaattgataatgataaacttcagagtatggcaaagtcaatgggttgctggagtgaaggaggaggtaattaaacaagaagaaactaagaaattgtgtggttaggtcgttggaggaattatccaaattggatagtgaaattgcaaacgatgctagcaggagtaaaaattgagggaagtgcaaagcctcttagaatcagaagtatttaaaacgttatattattagtatttatttaaggagattttaacttcaggcaaaacattcagagggaaaaaataaaaaccatttatcccttgtctaagggtcaatttgtttctctcacccccttcaatttttttattctttaatccttcatttaagaaaaaaatacaatttgaggaaaaaggatcttttaattactttaaaaatccagccaagtattgagagtcgacaaccttaaatttcatagctattattttattataagtaaattgctatgcttcacagtaatttctgaccatggaataatgacctaagctcactgtgcaacatctggtataccctatgttgactaaaaatcaattagaatttttaattatttttgcaacatctgcataacaatctaattcaaagccaaattaaatggtccttctggtgatggtgtataatgacacattcataacttaagaaaactgccctttcccagagcataagacttgaaaatattcagctcgcctttcctgatttagttgccagattatattgatatagttaatggtacacactgttatattttaatagattgtgacaccaaatataagaatcactttttaaattttctgaacacatcttttgactctagcacttaattttcttatcaaactatttttcatagttagccaacagttttaaataatcctcatataattaactgctgataatataatgttcatccttctggcttatcttgagctgttgccagtgctgtttaaatcttctcatgaggagagtcagatgcaaacagaaatataatagagtgaccagaaactccagagacaaagttggatgctcatttctaatcaacacagattcttttttttttttttttttttgacttatccctgaaattttattattaaaattacttgtttgacattgtttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaacttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatcgttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtctcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatgtgacttcctcttttcctaattgaataccctttatttccttctcctgcctgattgccctggccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttccgaaggaatggtaccagttcctccatgtacctctggtagaattcggctgtgaatccatctggtcctggactctttttggttggtaaactattgattattgtcacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtctctatttgattcttctctctttttttctttattagtcttgctagcggtctatcaattttgttgatcctttcaaaaaaccagctcctggattcattgattttttgaagggtttttttgtgtctctatttccttcagttctgctctgattttagttatttcttgccttctgctagcttttgaatgtgtttgctcttgcttttctagttcttttaattgtaatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaagtcactgaggacttgctttatgaatctgggtgctcctgtattgggtgcataaatatttaggatagttagctcctcttgttgaattgatccctttaccattatgtaatggccttctttgtctcttttgatctttgttggtttcaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcttttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacatagatttggtcttttcacatagtcccatagttcttggaggctttgctcatttctttttattcttttttctctaaacttcccttctcgcttcatttcattcatttcatcttccattgctgataccctttcttccagttgatcacatcggctcctgaggcttctgcattcttcacgtagttctcgagccttggttttcagctccatcagctcctttaagcacttctctggattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggagtaccctgccgtgtgaggtgtcagtatgcccctgctggggggtgcctcccagttaggctgcttgggggtcaggagtcagggacccacttgaggaggcagtcggcgggttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctctacccagttcgagcttcctggctgctttgtttacctaagcaagcctgggcaatggcgggcgcccctcccccagcctcgctgctgccttgcagtttgatctcagactgctgtgctagcaatcagtgagactccgtgggcgtaggaccctccgagccaggtgtgggatgtaatctcatggttcgccgctttttaagccggtctgaaaagcgcaatattcgggtgggagtgacccgattttccaggtgcgtccatcacccctttctttgactcggaaagggaactccctgacccctcgcgcttcccaggtgaggcaatgcctcgccctgctttggctcacgcacggtgcgcgcacccactggcctgcgcccactgtctggcactccctagtgagatgaacccggtacctcagatggaaatgcagaaatcaccgtcttctgcgtcggtcacgctgggagctgtagaccggagctgttcctattcggccatcttggctcctccccttctctaatcaacacagattctaatcacctcagatttcagtttttaatccttgattaattctaattacctagaacaatcatttttatttctctgtgataatttttgacatctctctgttcttcaacaggatgctgttatttaaaaagaaaacaaaaataaaactttcaccaaaattgcattaatctgtacatgatgggtacatgtgattgatctctgttgtttgcattctacatataattgcattttggtaaacagtagctacttttcaatgctaaaagctcagccattaattttctgcagtatagaattctcttgaaatatttcactgtttctcactgctctaattgctttaggaatttcctttaatacatattttgtatatatttttatacgtattttaagtttttctaggtaaatgtaagtccatgatttcttctactatttttggagtttggaattatcttaattttgtcataaatttctgtgaatatttgttttgctggtacaaacaaagatttgataattttctaagcactcccagaagctttgaataaataattttggtaaccacatgatgatatttatgaaatacataaagctcttaaagtttagggcaacctaaaccagtgtgaatcagactttaatgtgcatacttgtcccctggggatcttgtgaaaaaatcagattcagatttagtatgaaggaggtaaggtctgagattatattaatacatttctaataagttgtcaggtgatgcctaagctgctagtacccagactataatttgagaaaaaaagaaataaataactttatgttttgatatgtttatttttatccagtaaaactgtattttagcaagtttattaattttctctacttgtaggttatatgctatcactctgtcctttcaccatagtactttgtagaaaaactgtctaatcttgtttatccagtttttcatcagccctgctgggactatatacaatcaaatttttgccccattactttccatgactgttttcttgatgttctatgtgaacttattcatctccaaatcatggctatttatgctgactggttataggaaattaaggagtagaggacaaagccaaattttaaggagacaaggagcactctacatcagagtaattgtggtaagaaaatctgtggtactagagttgttgacatttaaggagctaaacatggtgttgggcagggaggaaaatcccatgtgccaagaaggatattgtgaaatgagcaccttctgttacacatgaacatgttctcatgctgctagataatgttaaaccatactaattgagttcatgttaatccctcacccttactcactgtagttgtaactccttacgatcaccagatatatatcatatatatgatatatgatatatatatgatatatgatatatatatgatatatgatatatgatatatatatatatgagctatacctggtcatggtcatctttatttttctcttagtcaattgtgaactaggggataaggtgcaatgtgcagcatgggacagtatctatttaacagctctttataaacacacatctgtgtgtgtgtataaattgtttatatattatacacacatacaaccataataatggtttacaccagtttctgcagtttgccttcccatttgatcaccgaggacaatgtatggtcaatttctatccataaccattatccgttattttccctttcgtctacttcttatttgtcctgaaatctttctgcattgcacctaactggtgaaaagctttttcttgcttctcccacagactaaaactctatgaaacattattcatcaacacaatgctactagtatctctaaagtctttagttatgaattcttatctgtaaagtgagtgaggagatgagactagctgaatatctgataagagtatttactcctcaggaaaccgagtattcatacttatattcagagttgaatgcattagtttaaataacaagatattacttgcgaattttcattttcttgaaacaacccacagcaatactttatccttttataggattttgttttgttttggcataattatgttgatactttgaaagtaaccttaaaagcaataataaaattaaagggtatttattgatttcatttacatttttcttgacttttttattcatttgagatctattgtcttatccccatattaattaatcaaatgttaagtcttatattgggaattattgattatagcttcaaaaggaggtttgtttataatgattttgtgtatcccttttccccagtgacttccactgtaagttcaggttgtttaataaagacattgaatattattgatctatgaaatgtcatgccaatttctaattgcttgatttcagtgtaattccatattatatttttattcattcaattgttcattgaattagttgttcagcaattcatatcaacattatgtattatttccactagtcaatacaatgcaatggatatagctcaattgtaggattattatcacagaaatgtatccattttaccaatctctgttattttgtgtctcacaaatcattcttgcattgtaaaatggaatttctgataataagtatatgccacaaatctgtaagattacttaattgattcctatgtttttcatactgcattttaagtttcttttgctttttgtttggaaatccatttgctcaaagttaaaaaaagcaacacaagattgtcctgaatggtattgcctaggttgtcttccaggtttttatagttttaggttttacagttaagtctttaatccatcatgagttaatttttgcatatgatataatgaaggggtcctgtttcagtcttctgcatatggctagccagatattccagcaccatttattgaatagcgagtccattccccattgcttgtttttgtcaggtttgtcaaaaatcagatagttgtaggtgtgtggtcttatttctgggttctctattctgttccatttgtctgtgtgcctgtttttgtaccagtaccatgctgttttggttactgtagccctgtagtgtagtttgaagtcaggtagcgtgatgcctccagctttgttctttttgctttggattcagccattgaggaagacagtgtggcaactccttaaagacctaaggacagaaataacatttgacccagcaatcccattactggatatatacccaaaggaatataaatcattctgttatgaagttgtatgcacgcatatgttcattgcagcactattcacaacagcaaagacatggaatcaacccaaatttccatcaatgatagactggataaagaaaatgtggtacatatacaccatgggatactatggagccataaaaaagaatgagatcatgtcctttgcaggaagatggatggagctggaggccattatccttagcaaactaacacatgaacagaaaaccaaatagtgcttgttctcacttaatgggagaactaaatgataagtgggaactaaatgataagaacacatagacacatagaggggaacaaaacacactggggccttttggagggtggagggtgggaggaaggagaggatcaggagaaataacaaatgggtatgaggcttaatacgtgggtggcaaaataatctgtacaacaatccccattacacaagtttacataggttacataggtaaacttgtgtactgagggtttgttgtacatatttctttgctacccatgtattaagtgtcatgattatttcaggacacttgtacccctgaccttaaaatataagttaaaaacaacccacaaaatttcatttttctctttctgtctcttgtataaatacataattagttcaattaataaagggtacattttaatagaggaatcaacattatatactctttatgaaagaaaaagggaattaaatttaaaaagaaaatattctgtggcaacataatcctagataaccagaagtacatccttggtctaaatagctctgcctgacttgaacattattatctacttcctgtatcatcttacccttgagttcaaattggaccttgtttggcagatgcttatttttctcacaccacaacttacattcccttttgggatctgtgcaatttgtacttgatagctgctcttgctcaggtaaggctttatgatatttttccagtcccgtttcctaatcctcttccctccgtttcctgataagcccatctcaactgtttatttctgctcaaatacattaactattccaaagtctgtactggggcttctaaaaaatagaggtagacttataggaggatccaatcctgacacttaagataattctggtagtgacaataattatgtttttgctcctttatgttactctgatattagtcattaaaatatttaccaagcatactttatctttattttattcaaggtaaggcaagaaacagtaactcattcaaagttgctcggttatttgagaatgcaacatgttgcagaaatgaagtccagctgggcattctggagacaaatgctgagacttctgagatattgaaaaccattagggaaagaaattatgactcttgtcctcttgctctgttcctggggtcaccatcgctctgcctcatactgccttttatgtttgctctatccagcctcctctcaggaggaacttcctctgcttgcattcgatttttgctctgcaataactaaaactcttaaggaacctgattatcataacataactctgtataatcaaatgtccacctctgttccaatacattgtagcagaaggaggaaatgtgtatgttttaaaacatcaaaaaaaaattagtgaaaaagaggctgattgcagacaagtacccgaaacatgaccactgtaatctgccattttaatctatgtcttaataataaagtgatacatcagtcatgttttctttattgacaagaacataggatctcaaagatcttgatataatttcaatattgatgatttaagttgtttcagacaggacagcaattgccagtgaaaagcaaacaacaataagttgtttaaagtgtgagaaaactactttgtaaattaatgtcaactgaaaaaagctaagatgctaaggtgtgtattctttgaaattatattggttgtacaaaaaataaactttgtattaaggctattttaatattttcttatattttccacattattgtaaaagttgaatattagagattattaaatgatgtaagcatctcgtgaacaatatttagtaaatccttattttatgaactacaaataaaatctaggacttaagacatgggttgtttaaattgaaaatgctacttgaatgaaatcagaatgactcaaggcatcgcttctacactttttggctaaaatcaagtgtaaaatgactcagggatagagtcaaggttgcaagagttttcctacattaatatggagacagatgaaaaagacaactattttttttctgcttatattgttgtaaagattttaagttttgaaaaaatattaaggtaacaaatatcagctttgttttttccttgtaaattttttttttacataggtgaccagagtttcatgccattccttttgtaagaactgttaatatagctaaggaaaaattataacagtttctcaagtaacttcttgtgtgttttatcataaaaacccatttaagtgtttctcagcataaggcaattttaagaacttgcattgttttaagataatacagtagccgaatcagtgttatattgtgtaaattttagagtatttttatcttcaagttatttttaatatatgtattgaattttaggtatttaacattgtactttcttctacaatatccctgtagatcattttcatttgagcacactttgagtttgtttattgtataaattcatctctttataacttttgtaatgtaataagggattctttggtattaagagaaactctggatctgagcagggctgatgtggaaaatggggcttgattccaaagggtgatggcagctatttcactgctctctctacagaagggcagttgcccagatagggtgtgtgtcttcaggtctcagcagcttggtagcaagaaactttctctcctgttttataacaatagttacttctaatatatactttgatattggtcttattaaaactcttttaaaaagaaatgtacctaataattgacaattctcattaattttcatttgatctaaaataagtgcactctccttgatattttatgctggcaaaacaaaataggttgtagataggatccattaaaaatgatctcttcatacatatatctaaataaagaaggagtaattctcatttgtgtttcatttatgatttatctttagtgttcttttttgtataatcaatttcgatgtccctttacattgatttgacttaaaagtctataattgtatgtgcaacttttcaataacatgtttattttgttagccaaagcaataaagattagagatgaggtaatccctcccaattctcccctggtattcctcaccaacaattttgtatcatgatctaatattaatcaagatgacattgtgatcaacaatcatatcaaaataaaaagcacagttgtgctgctgatagtgattatacataaataaatatcaggagattaacattgtttatctaaatactgatggggttcaaaacatactataccccaaatatggcaccttgccatttgagaaaacagtagaagtaggaaggtcactctcaccttccccccaacttcgttccccctgaagcaagctttaaaatctagctgacctttccctgaagtaggtcctaagacccttattccagaggtgcttaccctatacccagagaggaatatccttatccctgaaatgcaggagacaaagaagaatctacacaaacaggcctatggcattcccccattagtttattaccattagatcatgaccccttgtccatcatacttctccacaaatacccacttattcatcaaactaagaataatatacagattattttatatctttggatcttcatttctgaagccttctgtgtcatgtaaaacttaaatttgtatgcttttatcttgataatttgtcttttgttataggtgcctcaaccatgaatctacctatgagcaaataaaagataatactttttctcctcacaataccattaaatattgtattacataattctatgggaaagtatatctaagatttgtttgcagctggtgttggtagattatttcccaaaagattgtcatgattcacaaccccaacaacaatggatacagtgctatctttttaatccttgcctgagtgcatgttgtttttctttataacttttctctactcagaagaataaaaaagtcatctcattgttgtcttaacttgtctcttactaacagtgagatagattatctttagatgagtatatggatgatatataatttctgttctgtgaaaatcttattcatattccttacaattttttatttatcattttaatacaaatttataggtacttcttgtcagacatttatttacatgccagaagttttgcacatgtatctcccagcctatcattgttttgtgtgtgtgtgtgtttttttactatttagaaattagacttttgtaattaagtaagcctatattttgtttatggatttgttcctgttttgcttaataagatcccttctaattcaagtttacttttttgaagttttttacattgaaatgtaaaatagtacccagtcttacaagttaaaacccagagacacagagagtttaataatttgttgggtaactctatagctctttttagttactagtaactatgctataatgatcataactattaataatatctggcatctcttctgaacatctgctattaggtactggcaaccttttatactctatttcttttttgagacagagtcttgctctgttgcaccacctggagtacagtggtacaatcatggttcattgtagcctcaagctcctgggctcaagtgattctccaccttagcctcccaagtagctggaaccacagttatgtaccaccatagttagctaattttaaaattttttttgtagagacagggtcttgctatatttctcaggctggtcttgaactgggttcaaccagtcctcccatctcagcctcctaaaatgctaggattatatttatggccactgctcccagccctctatttaaaggccctaaatgttcttcagaaaaccacccttgatagccatgaattgttgctctcactctcaggtccaagctgattttgactggattaagctagtctccacatctcattcccagtacaattagagccagtggatctctagggaaattgagatgaaggtagctaaaaaggagcctttcactattcctcttgatttggtgatgttaagctgcaacacttagaatgtctgccactgtatgcctatgattatggaagccagctgaagatagctaatacccagaagaagcatggcccaaacagagatgctgtgatttataagatgtgaatcaagggtgctttgcttgatgccttgcttcaaaggcaacttgccctttcatttaaaagagccacaagatttccttttttgcagtaagccattttcagatggttcctctttccttctccctgtacatcatagagagtcatcagagacattggttaattatgaaatgcaaactatggaatggaggaagaatctcatccttaaatgtcctgatgcaatctcaagtcaacttaacctaaattatattattatatttaatttacaatataaacacttaccttttactcttggagagtaaaaggagagaataggtacaatgaagaatctacatgtggtaactttgatactatccaaaactttttctaagccttttaactttgtagtgtaagtaatatgacatttttttccctatactgtgtccttcctaagttattttgtaacatcatcatggatcttacttttatgcataaccttttagtttttaacagccaggtgtggtaaggaataaaagttatttttaacattgacctcaggttctttcttatacaaaagcattctgtaattggaaggtagctgagtagacagctttagccatgaaacatgaggccttgaggtcatgggctgaaagagatagttgaactctgtggcatcagaagttatagtgattagagattggggcaagaacgaagatagaaatagaaaatgagggactttaaaaagaggagtttttgatattcagtttaagttattttttgtgctagagaaatatttttagaaagggcactctgtgcgtaggatggcatgttgttcaatgtattgaagcaaatttagctgcagtaggtcacaggtgattcctgataatgcttgaaaattacttttttcagtggaagagaaggaacttaggttactgtctttggtccagtctgcttgcattttggtaggagagaatgctattctgcaataaatagaatgttcatttttatttggaagttatctttttaggcaccagtgactaattatataatcaacagaacctcattttctgaagcagtactgtgcatgttatttcactaaattttttaaaaggtgataatacaaccataacacaaatgtaaaaatgaaagaggcacattaaggtttattgaatgctatgtcattttttatttaaaggtaagttaacagctatattcattttagcaaattaggccattgtttcttttttctattttgcttcaggtatgactactgtatatgccacataaagtagagcatcttaaaagaaaaagtatatatagtatattgatgtataaattaaattgactgctctatttcagataatttttgccaataatgcattttccatggaaaaaacaggctcctttccaaatggaatgaaacacatatcaacttgccagtgcatgaacagtctgtacctagtttggaaaattataagtaacgctggatccaaaacaaaagtatatgatataatgtttaatattttctcaattttttgacattggttggcaattttcctttaaatagtcattgttactgttcttggagaaaacatcagttgtggtaaagcacttttccaaattttgttaactagcttgaccttctttagaaatgacagaaggtagaagatgatactgcatttttccactcacatgtgtgtataatgcttcatatactgctaaatctttatagaagactaaacataaagagattgtgttagaggcaaataacagagtagatattgacatttgggggggtggtaactgagttagaaaaacaccattttgtctgaggtttcagtaactaactgtttaaacatcttctcagctgccttttgtaaagaaaaaaagcaatagtttttcctatgattttttctcccatatttgatcttcattatgatatcttgactactttttaaaataatataattgacaatgaaagacaattttgttggaaaatctggatttctatgatttcttttaaaacaatttgagattgtagtacctgtgaagattgatgttaaaaataattttatgtttcaaaaggtagcaataaattacgaacaacgtgagtgcagtttctttcacctaccatttggctcattaaagaaaaaaagtacctgacattcagtcattttatgaaaaatcatggactaacctttgtagaaatgtaaactttaacaagattatagtatctttgaaactaggagttatgtgacaaccaagttctgatgtccttataagcactctactggatgaccccctaacatgtagtattggccaaatttgtttacaatgtgtttattttgcatttcttcattggatttttttttatactagtccaactagcatgcctggtggtgtgttggaggaagcatggctaaatgtactcttatcgtttttaaaatgtcttgaatgaggcccagcatttgaagccaacttttgggaaatgcagttgggttactgacattggagccttacaactgcagtggaaatatatgatgacttgaaaagaaaatgggaaaacaatggtgacatttagaagaaaattaagtttggggttcagtgttgcttaggaaagtattgttctaatatatagtaaaaatgggagagatcaaagaatctcagtgaaaaaaaatcatagaattttgtgctcactatttgattgaggtagtattttctattcaagaaaatgtgtcagaaactagatagggaaagaaaaagaaataaaggaaaggaaaaaggaaggaaagaaggaaggagggaaggaaggaaggaaggatgaacggacagacggacggatggacgggaggaagtgagggaaactagacagagttatagggcaggctctcgacttttggaaaagggaacttaaccatttctaaaactcattcatcaatattgttcactgatgtcttcactttaaaaatttattggtggctaggaaatatattgtaatagtagtgagtccaactagcatgcctggtggtgtgttggaggaagcatggctaaaatgtactcttatcgtttttaaaatgtcttgaatgaggcccagcaaggtggctcacgccagtaatcctagcactttgggagggtgaggtgggtagatcacctgaggttaggagttcaagatcagcctggccaacatggcgaaaccccatctctactaaaaatacaaaagttagccaggcatggtggcatacacctgtaatcccagctgctcaggaggctgaggaaggagaattgcttgaacctgggaggtagaggttgtagtgagctgagatcgtgccactgtactccagcctgcacaatgagagtgagactccatctcaaaaaaaaaaaaaaagtcttgaatatttaacaataccttttgaaggatccttaaaatagatttcctgacttttacatatgaatgatgaaagatttttttttttttgaaatggagtctcactctattgcccaggttggagtgcagtggtgcgatcttggctcactggaacctctgcctcctaggttcaagcaattcttgtgcctcagcctcctgagtatctgggactacaggtacgtgccaccatgcctggctaatttttatattcttagtagagatggggtttcaccatgttgaccaggctggtctcaagctcctgacctcaggtgatctgctcaccatggcctcccaaagttctgggattatgatgtaagtaaccagcctggcagaaagattttttagaagtataaaggctttgttttaagacaaccaaagatgatcatacgtctcttgctaaacatattaatttcatccatgcatctcatagcaagcattttttttgcatttaaattcactcactctaaaatatatcaaagttcttattcttggagaggtgaaatataagcactgtcaaatcaataaattaatttgtaaacacttatatttgcataagttaacctcaacaaatcatttttgaaagtgacagaattgtcagaattggtttgatttatgactcttgcccatgataaggaaatagtaccaaaaagattaaaagggactgcttttgaaacatttattaccctcctccttctttttttttccaaatgaaagcatttaatctaatcatctccataacatatgatgtatacagtggtgatgaatatactgacgtataccatgcattcagattcctatttttagagattacataagaaagaagtagtacattcaacttaaattcttcttagccataacaattattatttgaaatcttacccctagaatagttttcggtggaaaactggctatatgaaataaaacattaccttttcaatcatttctatgatgagccagtatcttagttcattcaggtggctataacagaataccataaactgggtagcttataagcaacagaaatttgtttctcacagttctaaaggattggaccatgagcaaggtgttgacacattccatgtctagtgaggcccacctgctttctgtttgatagatagtgccttttggcacggtagaagggaacaagacagctatctagcactaatcccattcatgacctaatgaccacccaaaggcaccacctcctaacactatcaccttaagagttaggatttcaaaatacagattttggggaggacccaagcattcagaccacagcgtttcaccccgacactctcaaattcatgttcttcttacatgcaaaatacatttgttctactccaacagccccaaaaatcttaactcatttcagaatctaccttaaagtccaagttcaatgtctcatctaaacatgatctaaatcagatatgggtgagactcaaggtacaattcattctgaggcaaatttctctccacctgtgaatctgtgaaatcagacctgttgtgtgtttacaaattacaatgatggggtagacacgtaacattagcattctagaagggagaaacattgaagaagaactggggcaataggatccaagtaagtccagaataataaagcttgagaataatctttgacttgaggatctgccctctgggccctctggggtcatagccctgcccacatggctttgggaagccccacccttgtagtgtcttcagtgtctctgtgcctgagcctccttgccatgctattgtgattgtctgtgatggcccccacctctgcagcagctctgtgcctgggtcttagcgctcatggcttttctgggcttgaatcttgcgctggtgatgatcagtagtctccgagcagccctgtccttatagttccatggagcatttccctagtggaatgtctctgtggagactctgacaatgaggcaattttctttctgggccctacatttctccagggagtccttctaaatctagatagaagcagccacattcccacaactttgctgggtacagtgcatgctgtacctgggtcagctggagccatcctaggtcagatgagctggtacttgggtcagctggagccatacctgggtcagccatacctgggtcagccccatacctgggtcaattgaggagtacagcaacagagtgcaggaagcagagcccatgatctgaggtggtgctgggcagccctggcccctcctttgaagttgttctgccctaagacccagtactctggccctgtgataggaggggcagctcctgatgatctttgaaatgccttaggggccattctttcattgtcctgatgaatagcacctgactattcataccaatttctttatcaaatagtcacttggccacaccttagtattctttccagaacacactttcttattccttttaatatggataggctgagaattttccaatttttaaagtgttgctttccttcagattaaaatattttaaattctctctttttactgtaagcaaaaataaatcatatttttttcaaatgtagttcactcacaagttctaccttccacaaaatactgggactcaaagacaattcggccaagttgtatgccactttataacacttttaggaggacacaaatattcgaattagcgtacccattatatgattaaaactaaaattctctttgggtcatatgccccttagaaatctttaaagaaatatatggatgaaaagtttagaatgattgatcaagaggaacctagattacaataagataaactcatactatttcactaattatactgtaacatgtatttttcataatggtttgttattcaatcacaaaataatctttttagtatggttcctatataaaatgaaatgtaacatttatcctgtgatatttaaaattgtcacctgagtagtatgtgaaagggatttttttctttaagcaatatattaagcatcaaagacacatgcataatttgaaatagtttcagttcatttcctcctttttatcttttctaacagagcatttatatgttgttcattactaatcattcaagaagaaaacattctcatattcttatattaacaggaaattgaatatggaccattacaatgagggtctatagtaatttaatatgacaaagaccgttagaaagcttcaaaattatttttaaggaaaacactaaccacctcatttatttgtgattttttttttttttgtaagggaatccaaaagtacaatatagtgatattgtgataagactccctatccatggccgggcgcggtggctcacgcctgtaatcccagcactttgggaggccgaggcgggtggatcacgaggtcaggagatcgagaccatcctggctaacaaggtgaaaccccgtctctactaaaaatacaaaaaatcagccgggcgcggtggcgggcgcctgtagtcccagctactcgggaggctgaggcaggagaatggcgtgaacccgggaagcagagcttgcagtgagccgagattgcgccactgcagtccgcagtccggcctgggcgacagagcgagactccgtctcaaaaaaaaaaaaaaaaaaaaaaaaaaaaaaaaaaagactccctatccattttgagaaactacaattgagtagcaaggtgtcagaaagtacaatcagttcttatatcaagattcttacatggtagaattgctggtttagaaaaatcagttcaaatttaaacgataatctgatcaactccttcttggaaaaataaaccttattattcataactttttaaaatttatattagtcaatcattatttattaggttttacaaaaaacataagcaaaaagtatagtaaactgttgattacattttacaatactctcttgtgaacaaagaagaaataataatatagaatgcttacatgcttatgttcatgtatgaagtttcctcagttgtgttgggctaatgtaaattgcccaaacttcttctaaatggcagaaaattagatcacaatgtggatgaacaaacagaaatatctctacatcattactttatataaccagaagtataagcatatattcccgtttgaagtattttgttaacaattaactttgctaaatatttgtaggtattttattgataaatggaaagtgctaatttttcaaatcaattagaatatttcaataaacaataaaagttgatttctaatttctcccaatattacacctggtaaattgctccagattttataatacaaattggagcagatgggactgtgagagtggctctgactgtggcaaatcaattttctttaaacatttcctgtgccagggtagggcccactcccatcatgtcttccctagagaacgccaccgcagcttcacccttccttaaaaataattttgggctgggcgtgatggctcacacctgtaatcccggcactttgggaggctgaagcaggtggatcacctgaggtcaggagttcaagaccaggctggacaacatggtgaaatcccgtctgtactaaaaatataaaaattagctgagcatagtggtgcacacctgtaatcccacctattcgggtggctgaggctggggaattgcttctacttgggtggcagaggtttcagtgagccgagatcgcgccattgcactccagcccgggcaacagaacgaaactccatctcaaaaaaaaaaaaaaaatcctttgaacactggggactctgtgtgcttttctgagtttacattttgtcatctaacctcaggaataataatattccctcccattcttcttcagtttgcataattatgactgtattaatgtttctatcctaattctcaaccaacttggcagtcaaaaaatatatattaaaaagctcagagcgtttgctatgaaaatcaggctagaaaatggccaaattcctataaaagctgtaacacctaaattctaactgtttttacacgtaattgcacttgtttaaaattttaggttcagtgggtacacatgtatgtttgttacatgggtatattgcataatgctgaggtttgggcttctaatgctctcattgcccaagtagtgaatatagtacatgatagatagtttttcaaccctttccctccattcaccctccccatttttggaatccccaatgtttgcatctgacaaaggactgatatccagagtctataaagaacttcaacaaaacaacaagaaaaaaaaaaaaacaaataaccccattaaaaagtgggcaaaggacataaacagacatttctcaaaagaagatgtataaccagccaaggaacttatgaaacactagcatcatcactagcatcatcagaaagatgctaatcagagtcacaatgagatgccatctcatacaagttaagatggctattattaaaaagtcagaaaataacagatgttgctaaggttgtggagaaaatggaacgcttatgtgctgttggtgggaatgcaaattagttcagcccctgtgaaagcagtttggagatttctcaaagtactaaaattagaattactgttcaacccagtaatcctattagtggatattcaactaaaggaaaataaatcattttaccaaaaagacacctacactcatatgtttatcacagcactattcacaatagcaaatacatggaatcaactcagctactcatcagtgatggattggttaaagaaaatatgttatctatacaccatagaatattacacagccataaaagagaacaaaacctttacagcaacatggatgcagctggaggccactatcctaagcaaattaacatagtaacagaaaaccaaataccacacattatcacttataagtggaaaccattgggtacacatgaacataattgtacatttttgtacatttttattctatattcttgccatctttatcttctaggttataggaagcattatgatctgtcacttaagctatattagattttggagtatgtgttttaaagtaattcaatttcctgtatatgtcaagggaagatcacctaattctgacccttaaaaagccctgttttgaaaaattttaatagtcattcacacttctagaaacacttcttcacaaactctagtttctttgttcttgctaacatcaattagtagtaagaattatataatattttatcaatgtattctaagagaagacaatgcctccaagatagtaaagacatgtggatcaaaattaggggtaaaattccaatatgtattataaattttaataactatttgaaatcattttatgtttatcatgtcatttaaaaatactaccagtgtttataaaattattcagtgatattaaagaatgataaggcaggcattaatcaggatcatcatgataggtatagaaaccactgcaatgaggttttgtggtggggagagagattgggctcgactccaaatataacaaggaaaaatgataatttatagccaaggaacagtgtgtgtggcaaggggtcagcggatggaaaattgctaagaagaaacatgaggagtaaggaggaattctggctaaactgacataaaaggattcttgctgaagacaggccaggagatcagacaacacctgtgggatggggtatggtggaggatgaggaacccgattagattttgagagtgaccagatactagcatgaagcagtattcttgctagaattaaacaatgcagaaataaacatggaagctcaaaagtcaaagcctggttgagcaaagagttcagaggaggctgagtaggttcagtcgggagagaatattgtcatcatgtttaaaattcattgctctgtatatctcaattatgtttgaaattttattcatatttttaaaagtaatgcaaagaaacagctttcaccattacaaaatttggctttcagcatataaaaaacaaaagaagacctctaataccagcagaactataacagaaaaacagctttactctgaatattaaagtgcaattataaaaatttaaaaacaatcacatgcacacacataatgataaagtagatctacctgctttactcgtgtaaaataaatatctttatgtctcagattgaatcgctctagtgtttattatatctgtcttgtattttagatttttattaggaaaaattaaataaagggtttgtaagtctacatactaatattctgaagtatttgcttaaaaaagaaatactttataaaagctttatagttagtaaatcaaactattggttgaaaagtgcaagtatttttaaaactaaatatatatgtttacaatcctgccctactgcctgatatttaatatctaaaaaacatcccgcaatcttaacaatctagtaatagactagatgactccttagtcccttttagcagttccttggggacctgtgggaagtctctcttcacaggaacatcttcatttgaagataagagctgttatccatgtgtgctctccatgaagggaggaggttcagagtttgaatggtgctaatgaagttccttgctgtgcaacacagagcacatgcaatttgacgttgatgcaaatgaccctaaatggtgtgatcacttcgtcagactgaatatactgttcctatagcaggtggctattctgcactggcagaaaccgttttaacactttcttcccatttgaacgcagctcttctaacagacaagtataacatattgtaatgtattttaatgatttaaaaacttatattaatctccactttagtaaataccacccccaccccaccaacaccaccatgttttcctgaaatttctatattcttgcttttatctgattagggaaaaactcaatccgtatgtatatatatatttttacttgtagagaaacacctaatatactgatttctcattcaaagattagccaatgtcttttcctggaagctgcctgagaagtaagaaaaaccgaggtgatacattggagttctatttcaatatgcttcttgatattttcctgtgtggcttctaatacccctgtcagattgaacagtgcatttttctgtaagtccatgctctttcctggaacctgactagatcctgcatgctaagattctgtatagaccttgatcaaattcatggacttatcatcacaattttgatttggaaaatgcttttatccttctctttttagtttccatcccatcatctatgtctcatttctgcttatgagctcttaatattacttgccttataagttaaaagtatacctttttaggtgctttcatttgcaaaattttagatatatttaattttgaaattcaaataatgtggtttgtattatttatatttgtatgtttcctgaagatttctgtcaatgttgtaagtcatctggtttgccagtttgattgctaatatttttctctgaaattcttgagaattattccttctcttttctaggtcatcatcctctttcctatttaataatggttaactggagaatcaaagtagatttctcataccccatcatccccaccacatcttttttttttttttttttttttttttttttttttttttttttttttgggacggagtctggctctgtcgcccaggctggagtgcagtgtagagatctcggctcactgcaagctccgcctccccggttcccgctattctcctgcctcagcctccagagtagctgggagtacaggcgcccaccaccacgcccggctaatttttttctatttttagtagaggcgggttttcaccacgttagccaggatggtctcgatatcctgacctcctgatcggcctgcctcggcctcccaaagtgctgggattacaggcgtgagccaccgcgcccggccatccctgccacatcttattaaacttcaactctttagctttgagtcacacatatttttcaatgcatcacattctttccatctctactggcactgatgtaggtcagaccctcatcatacctagcacagattttaggagtcttttatctccttgtcttcaactcttcgcttcctcttcaatctaacctttgttttccacccagtggtagctctttcaaagaaattttcttctaaataaaacctctcagagatacccatgacctacagatttagtttcaaatttttcagcatggtagataaggtcctctgtgacgttaagttgggctaacataatagctcctctttatactttaagtttcattgcaagcctcatgaagagtacttggagttcttccttatgactgttgtttcatgcatttgtgatttttgcggggagaatgggggtgtgctcactcttttttctctttctatacctggcaagcctctgttcatcttttaaatctcaaatatcattgccccctgaaaatttcccatttctctttgggtttcactaagtgattactcctgtgggttcccagtaaatgttatcgcaattcatcatttacgtttctggctgcctcagttcttgaagcagggacttggctgatgtataaccaggacgtgataagggatagacacacaggagacaattaacagatgtttgcgaactgacacaaactttttcattctttttaaatccttcgtcttgaacatatgttcttttaaaatgtattctccaatgtttcaaagtacatttttttgtgtgtctgaatagaattaggattataatgattttggaattaacttacttttgcattgtccatatccttatctgtctgtctgtctgcctgcctgtctatttatgtatctacattagctcaaggttttatatttattttagagggcttccttgaccttctgtaattaatgttttacacattatgaatgtaaccgtagcattcaataggtatactagataagctttctcaaggagaaaaaaataatattcaaattttaaatgataatttagaagcatgatataatttaacttttgaagtatgcaaatgataggctgctattccatcaaaataaaaataacacattcaaaagaattcacattctaacctatgaacttttccttttatttcaatgtaactctcatgcaattaattaaaactcagtggggtattgtggtgaaaattttaatatcatgcagttactttcattaataatatcatttctttggctaagtagaataacaattgagtttatccagctggaaaaagttagacaaagacacataggcaggtaactattgtctattaggtaagaagaaatgcagcttttcttttaacatatatcaaacgacatattctgcattttctaggattcctttaaactgttttatgtggtaactgtcagaagtttagataatttaggtagttatggagttaatagttttagaatatttctgttacaaaacataaatatctttgcgtaccacctataatgtcataaaaccctagactagaaatatctgtttggagacattaaataaattaaattgctaccttaagtaatatggtggattttaagttccaaacaagtcaacaaaaattagaattaaaacattctgaggttttttttactttatactttggaaatattaatcatgtagtctttgtatgtaaatgacagaaatcactatcatgaaaattagatagcagtttttttattaaaatagagtatttattctgcaagttattgcattcattatccaacagtatattaaaatgtactttgatcaccattgtatacttcatcaatgtgcttttgtgcttcattaattagtaactgactgaaagttaatgttcatcctgtgtcagtctgctctagatacatcattttgctattcaaggccaaatcacaaaatgattataaattaccagcagcatttatttgttttacttctcattatgacaaattcaaagatcaaactgatagcatatcacatacatagaataatacattttaatttaataagcaataggccaggcacatttctctatggggaataataaatgaattgattgaaagcagaaggaggttgtaagctttttgataatggtgcagagcttttacatgttgatttgaactttgaaaaaatatgtaatatccttgtctttctcatgaaatatgatgtattttagattttggtttcttgagggtactttaagggttatcttttcttgaaataacatttatttaggcctttagttacacagatttgcattgttggtagtcttcattcagatcacactaattttatttcaaaccatactcacttttgattatgaaacataaaggttgaaatccttcaaatctgaggcatctctctgacctaaatttcagatgacatttaagaatatgattaaacaaattttcaaataaaaacagctggagtgcaacagttttcgtacttttagatactttattttgccactggggaaattatagtaaattaagattaaggattctaagtgaaactctataatcctagtgggttgtttggtattggaaggtaaggaaaagattgttgaaagtcaaagacaaagattgagctctcagatcagtatacaccaattgtagagacaatgtagctggctatccaagttaatggcattagacctctgaaattaaacacgttgccttcagtatgaatctgtagtcaccaagcaaacttctgattatttgaccccctcctagtttttttttcttgcaaggagaaaatatagggtcagttatacaaacagctataattacttttctctttataaaaagggtggaggttacaaaagcattttgcggagacttatgaaataaaatggtgagaatgcaagtgaaaaagacattacaagacaccaaagactggctttttaaacaggcacaatctgaaataaaattgatatgagaatatgcctcagcagaagtgaccttgtcacaaagttttccaacagagctttgcaattcagtagaggtgactcactgaagaagatgcctaaatctaatttatttttaataaaatttattcattcattcacatgttgattggtaattcaacacatatttactacatttttattcaaagtattttgctggtcactggagctacagtattagccatacattccagaactttcttctcaagttgcttatagtcttcctacagcattgtagaatatagtcaatatatatttttatgacttctttccatccttaatttaccttaagtcctcgttcttgccaaccacagttctacaaacaacaacatttcaaaataatttatttaacagttatcataaatataatgaatcatatgtgcttaaataaaacacacatccagtaatttctaaattctagaaatttactgaaacaagattttaattcaaaacttcatcttgctatattataatttctttttttgctcaagttaatttacataagtgtcacttttggccaatgaaatatagtagctaaagtctatgcgccttgtttctccaaaatctttacaaatgccgctatttcatttaagaaaaaaaaattttgttacatattttgcaaaaagcttgaaggaaataaaaactttaaatcttttgcccccccaaaaacttctctgacatattttaagatggctattcagagggcctgcaaacagaagtatgcaaagctatattttatgggggagatttgcatctgtcgagaaaatctgccttgatgcagccaggctttctctgaggctctccctttttcaattttggaaagattaactgagaatctggcacatttaaaagtctgaaacatttaccatttattctctctgagggctgctatctttgaggtttcatctacataaaaagaccacctttgctagccaggcttcctctctcttcctcccataacctgtcttaccatcatcatctgtttttggccatgctctgagccccaattatttctgtaatctcaagatgttatataaacttctgtaccccattaagtggttggagtaattattctgtggttctcccctgtacacattaataaatttgtataccatttcttctattaatctgcctttgtcagtttacttttcagagaaccttcagagggtgaaggggaagttctcccttggcctctataggttccatcatagtttccaaataccaaaattaataatgatattttacctatacagtgagtagttttaagatgccttttgaggtatcaaattaatatttattattaatgtgtcaagcaatgtgttatttgtcacagaggcaagattgccagatgccagcttcattagagtgtaaaatttagggtactaaacattgatgatcactgggaagaattccagatgattgaagactgtgaagccaattgagttttgagcattaaatgaagtgttattaagaatgatctgacctcctctcatgaattgtttcttatgttttctctgttgtctctattgtaatttttgttcagtggaaattaaagtcactcaaggtctcaaattaaataataaaattgaaattgcacatattttctccttttgtggggaaagaggtactgagacaggaataatacatggtggttgcaggagaacagaaaattccaggcagcagtttcacatgacatattttggtaatgggtcctagagatgaaacataactaattttagtatgtttcatcatgttacataggcttcagtgggaaaacaaactctgtggacaacctagttacttattgcctttgaatatgaaatatttgactcagaaagttgacctttaaaaagtattagctttatatcatctaaattgagcaaatgtgtataggaaaggttatgtctcctcatggtcattctttatattattaaattttaatgatatgtttatttgttctcttaggagaaatagtcacaactaaaatattctttccagaatttaaagacttgaaaaacaaatatagttttaaaactcagtttacttgtaataatctaaaaacacaaatagcctaatgattacagagtgaagaagaaggacaattcttaaggcagtatttctggagggttatctgagaattatatgctgcttcttgcttgctttcttgatacgaactacaaattacttacaattccaaactattcccaagctcaactgacataaactacagttgtcccttgaaaaaacatggcattaaactgcgcaggtccacttatacttggaccttcttccacctctgccagccctgggacaacatggccagtatcctcctcttcctcggcctactcaacatggtgatgacaaggatgaagacctttatgataatccactgccacttaatggatagtaaatgtaatctctcttctgatttttagaataacattttcttttctatagagcttactttattgtaagaatacagtatataatacacgtaacatacaaaatatgtgttaaccgacttgttgatgttatcagtaaggcttcttgtccgcaagaaggctattagtagtttgttgttggttttttgttttgttttgttttgtttttgagatggagtcttgctctgtcacccatactagagtgcagtggcacaatatcggctcactgcaacttctgcctcctgggttcaagcaattctcctgcctcagcatcccgagtagctgggtttacaggtgcctgccaccatgaccggctaatttttgtatttttagtagagacggggtttcaccatcttggtcaggctgacctcccgatccacccgccttggcctctcacagtgctgggattacaggcatgagccgctgcgcctggcctattagtagttgtgttttatgagtcaaaggttgtatgcagattttctgctgtgtaggaattggcacttctaatccccatattgttccagggtcaactgtattggtttaaagttcatacttaaaatttttttctctttatattttttaatttaatttggctttatataaaatattgaaataactgaataattgttttagactcttagccaatcccctttctccaactctccatttcaagcatcctccaactctccatttcaagaaacctaacacatacgttatgcatctcagatttgcaacattatattctttcttcctgaggagaggatagaattttgaggattttccaagtcttcagccatggattctctgcatcatcttttatttattcccttttcctaagtggttcaaaatcatcaattttagaattaattttgcctcattgatatgaaggttttggattccatatatttgcttaacaaatgttcactgagctcttctatgttcctagtattgtggtaggtgctgaatctgcctcacctggctaaatgaaagtatagtatagataaggtgttcttccaaagctttatatctttcagttaccaactttctccatccaatttatgctgtaattgtttgtgacaatgtgggaaataggaatgatgatgtattagtttgtagaagtgtgaattgtctggagagaaatttggccgtacttagtgacattaagcatgcatattccttggactccaattattgaatttttacccgagagaaattttagcagaagtttaaagacactctctgtccttttccttttctcgctatgtgttgtagaggcaaaggaaaaaacttttaccttcactctctgaaggttcacttaaaagttaattgataaaaggcaaattagtatgagaaatgacatacaaatttattagcgtgcagggaggaaaaatcacagagccattactccaccacacaatgaggtacagatttttatatatcctttgtcttaggggaaagtgagatggggaagtgtggatgattttaagcaaggagagtaaatgattgtagggaaatgcaatgggcttggagaacataaaatggcctgggacaaagtctgttgggcctgcagaagaggcaatggttttgaaaaaagtttgtccaggtatgttgacagatttcagtctttcttcctgtcatatgagttcagttaatgaaaactcagggaagggaccagaggtaattgttttcttctttggtggatctgaactttaaccagaaaagggaatttcagagaccaacttcatccagtgttttggaagagatggaggggagagagaccttgaggcttctttttcagttcatcatgttaaaatgccatattttggagtatcagtttctgagccctaacattgtgtacatgcatgtatatgtgtgtttacgtgttcatcataaatttagaggctaaatacaactttaaggtgaaacgctagggtgtatgcctatgatgaattactatggagcaattagaaatagatatctacaaaccaacatgaatggttcccattaacacagttttaagtaaaaaagtatgatcaactcaccttaaatctgaaatgaataaagtcaggtgctgcataaaaatatttaggtcaacaatcagctgtacaaatgtatatgacagtggtcccataatattgcaacatcatattttactgtaccttttctatgtttaaatgtttagatacataaatacttaccattgtgttacaattgcctatagcattcagtacagtaacatgctatacaggtttgcagtctgggaacaataggctataccatataccatcagtcctcaacctttttggcactggggactagttttgtggaagacaatttttccatgaaccagggtcagggtgggggatggtttctggatgaaactgttctacctgaagtcatcaggcattggttagagtctcataagaggcacacaagctagattcctcgcatgtgcagttcacaaaaaggtttgcacacctgtgagaatctaatgccactactgatctgacaggaagcggagctcaggcagtaatgctcacccttgcctgccacttacctcagcccagtttctaacaggccacggaccagcaccggtctgtggactggggttgggacccctgccataggtgtgtaataggctgtatcatctggctttgtgtttggtacactctatgatgtctgcacaatgacaaaatcacctaataatacattttgtagaacaaatccccattaagtgacccagatctataatttaaaataacagtgggaaaccaaactagtataataaactcatttccaggccgggcacagtggggctctcgcctgtaatcccagcccgttgggaggctgaggcgggcagatcacgaggtcaagagatcaagaccatcctggccaacatggtggaaccccgtctctacaaaaactacaaaaaaattagccgggcgtggtggtgcacgcctgtaatcccagctactcgggaggctgagacaggagactctcttgaacctggaaggcagaggttgcagtgagccaagatcgtgccactgtgctccagcctggcaacagagcgagactccgtctcacaaaacaaaaaagcaacaacaacaacaaaaagaaacttgtttcccacccaaaagctggcagaaaataatttttaataatttcctgcatattatttatctgttttttgttttgaatgttgtatatttttctcaaatgattaccaatttcttagttttatatattgaactctttattgaataaaatctttgatctcattttatttatttttcccacttgggtaattgattaagaatgtattctctgctaggttacaataatattctcctgcacatccttttaactttatggctttatatattgcattcaggtgtttaattcacttacagtgcatatttgcaattggtgctagttggttcagcttttttcgcaataacaaataacttcaaaagctcatagacttaaaacagcaaaaatatatttctcattcatttgcgtgaaaagtgcaggtcaacactcatgggctctgccatcatgttttcatgttgtaactagactgaagaggcagaggcagcctctatcttagaaatataacagctgttttatcaaaatctgtccacctctagtctttaaacttcataaggtaagggacagagtctgtattttctactttctgtgaaacccttgtttatatctttcgctcatttttctatgtattgcttctgttttatcacaaatttgaaaggaaattttaaaaatgtttctatgccaatcttctgatgcttatacgcattttccgtatcttgccaactgtggctggttttctcactttgattatgccatgttttgatgaaaagttgtttatatttaaatggagttgagtttattaattattttcttcatagttataatttttgtctcactgagggaattcacgctattcaaaaataacaaaaattatctaatattcactaaaagagatttaaaactttgctttttacacttagatcttatatccacatagaaccatttattatttagctgttttaatttgttttgggaatatttgtgtggggaatgagatagaaatcgaataaactatttaaaagactaaatggatgagatctattcataaaatgattcagtgctatcttatgatgtatagaataaaatccaaactctttttctttcctacaagcgctgaatcctctggcctaccattcacactccagttcattccattaattcccttgcttattttgtcactatctgtggctttaattcagtttttcaagtattaaccactttcttttctctttccgtattatccatctcttacccaaagacttcctggttttttttttttttttgagatagagtctcactaagttggccaggctgaagagcaatggcacgatcttggctcactgtatcctctgcctcctgagtagctgggattacaggcatgcaccaccacacctggctaatttttgtatttttagtagagacagggtttcaccatgttggccaggctggtcttgaactcctgacctcaggtgatctgcccgcctcggcctcccaaagtgctgggattacaggcatgagccaccgtgccctgcctgacttcctgtttatttttgtgtgtcagtttaaatgctgtgtttttagggaggccttttctgcgccatctatttaaattgtcatttcccttcaatttctgaagctagttctgttttttacagaactcttatttttttcctttattttttgttcatttcattattactgatttctcttcattgtactcaagcttcatgaggcagaaaccatatacatgtatattttttacttttgctccttgaagcccatcaaattcctggcatttataggtgctgaacaaatgaacaattgaattatgtgtcctcatttccttcttactttcatctaattaatcatcatattgcctaggttcagtatcttccatattctcacattagtccatttttgttaaaaacttatgggcactgtcttattatataaatctatgctatttcttattgctactgccatattatagatctacattatttattaaattgtaagctgtttttttctcttttacctttcccttctacagttctatttctacacaatagatcttcctaattttctaactgcatggcttttctggttataattctttaactcttcttcatttgcttcaagaaaaaaacctaaatttgtaatatgtacacaatattctgttgattcaacattctattccagctaccttctcatttcttccactttttactgcataattttgtaaacgtttttgtaaatatttattttatttatattatatataaaatatttatattaaatacaaaactttatgttttgtataaataaacattgagttctattatctttttcgcatcaccaaatctcttttcctttctctctgtgtgtgcatatatgtgtatatatagtttttattgattgattgatttgtggaatatttcatgtatacatgaaaatgtaaagaataataagatgaacttcttgtacccatcaagaattagtgacttgtagccaatcacactttatatatgtccacccaactatctcaaaatactggataattttgaagcaaaatcagacactttatttcatctataaatactttggaatgcattttttttttttttttgagatggagtctcgcactgtcacccaggctggagtgcagtggtgcgatctcagctcactgcaggctctgccttctgggttcacaccattctctggcctcagcctgtctgtaatctcagcactttgggaggccaaagtggaaggatcccttgaggccaggagtttgacaccagtctgagcaatatagcaagaccccatctttacaaaaatatattttttttttgagacagagtttcactcttgttccctgggctagtgtgcaatggcccggtctcggctcactgcaacctccacctcctgggttcaagcgattctcctgcctcagcttgcagagtagctgggactacaggcgcctgccaccacacctggctaattttttatgtttttagcagagatggggtttcactgtgttagccaggatggtctgcatctcctgacttcgtgatcggcctgcctcggcctcccaaagtgctgggattacaggtgtgagccaccgcacccagcctggaatgcatttctgaaagagaacttttagggcataatttacatatacatagtaaagtacacaaatcttaagcagcttgatgcatttttacatatgtatacaattatataaacaacttacatcaggatatataatagaccatttacaccatactgcaatttttttcatggttctttccagatggcatcctctatgggtaaccactattctaacttcaatgaacattggttaattttgcctttattaagactttattaaccttagaggaatgtaatctaatggcatctctatggtgtctggtttcttccattaacataatattgctgagatgtatccaagtagtgggtgttagtgatttattcctttttggtgttgagtagcattccattatatacatatgccacaattatggtgaaaggcatttatattcttcctaatgtttgctttttatgaataaagctgatgtgcacattcgtgtatgagtcttttggtggatgtatgctcaacaaagtggggacatgttcaggcatattatatattacaaaaccattttccaaaatggttgaaaaattcacgctcccacaagcaatggatcaaagttctagctgattcacattttcgacaacattattagtcctctcaattatagctattttactgatttatattgatatctcattgtgttttgattgaaacttttctaataaattgtttgaccatgatacatatgcttctctgacattacttctggatttgtgctaattacaaataatgtggcatgcacattcttgtacatctttttacttggtgcagttaccaaatatccacctgatcctagtgattaatttgcagctatgcctactacagatcataatttctattcttatctttagcctggattttattatctacacttggccctaagactctctactttagcttgctgatttcagcagatttctgtgtctctcaatctgtatttagcaatgaacctttccctaattctagcatcatccataccttcggcaaaatgcaaagcttcatctgcactacagtcctaccatctcaccatcttggcatcagaaacaatggcgaataatctacagaatattatgagaatcattgggtaaaaataaaaggatggagaaggttttaatagagaaggcaaaatattatcatggaagaaaacagcagagacacgtaatagagtagaaatcagctggagaagtttatattgcatgtgttgagctcatcagaaagatgatatgtttggtagatgaaagaagagactagttggtaaaatgtcttgaaaattgatcagtttcgttttgatttaatagcaaatagtaatcagccatgaaagttctcaaattcagtttcttccatgaacatattttacatgatagtttttcttatttcacaaaagcataatcaattattaaaatttaaatgtaactatgaatacatactgtagtaaaatatttctttccttgtataaagcaaatcaataatttttagaattaaatattttctattgcacctttcttaaaaaaagaagtcttgatccatattttctcagtgcctaagtaatatattaggtgtgtgaattaactttctagattaatattggtagatgctctgtacctcctcctgtgaaatttatgaagattaagtccattcactcacagcacctgtgttagtaagaacattttaaaattttctcatgcactgtttaatttaatgatttactttttataaaggagagtgctagtaggtattattgtcattttatatctgatgaagaaattactgaaattaacttagccattgaggacaaggcttagatgcacaccggaatctactgattcaaaacccatacctctgtctaatgtgagttatctgccctcttcactgcatgatttccactcatgtgcattctaaaatacatctaagatacaattgggattctatctaggagggtttcattttatttttcctgcagattgcagggaatacttgttttcttctctggagaaagttgataatttgtcaggtgcaactgcctccgattttaggaagtcatttaagtaatttcccttccattaaggctaataagaaccttccctacttgtttaattttgtgctttctggacttcaatccatttacaatactttagaaagtactaaatttaactgtgatcctttatagtgtgaagtataattttttttataatgttatctattaagaattcttgagacaacaggttcaaatctatgcccatcaactctttctggttttgttttttctgagtgtgtgtgtgcgtgttaggaggggagcagggaggtggtgttcacaaccatgatagatattatactttccattttttattctattattattatactttaagttttagggtacatgtgcacaacgtgcaggtttgttacatatgtatacatgtgccatgttggtgtgctgcacccattaactcgtcatttagcattaggtatatctcctaatgctatcgctccctcctccccccaccccacaacagtccccggtgtgtgatgttcccttcctgtgtccatgtgttctcattgttcaattcccacctatgagtgagaacatgcggtgtttggttttttgtccttgtgatagttttctgagaatgatggtttccagcttcatccatgtccctacaaaggacatgaactcatcattttttatggctgcatagtattccatggtgtatatatgccacattttcttaatccagtctatcattgttggacatttgggttggttccaagtctttgctattgtgaatagtgccacaagaaacattcgtgtgtatgtgtctttatagcagcatgatttataatcctttgggtatatacccagtaatgggatgggaggtggagtctcgctctgtccccccaggctggagtgcagcagtcgggatctcggctcactgccaactccgcctcctgcgttcacgccattctcctgcctcagcctcccgagtagctggggactacaggctcccaccacacccagctaatttttttgcattttcagtagagacgggtttcaccgtgttagccgggatggtctcgatctcctgaccttgtgatctgcccgcctcggcctcccaaagtactgggattacaggcgtgagccatcgcacccagctgggtattgtactttcaaagagaaaagcaataaaaataaaagaaaaataaaagcagacgatcttttaaaagatctctataaaaattacataagtcattttgcagaaattattgtaaaactggttattcatctcagagacttgacttcaaaacaaaaatgaagagcctgaacattatccactgaatttttccattctgaaaattaaagccagaaaaatcccagatcactggaagcctttttgcagctatcagcttgattctatgttctaaattactggaacagtgatttatagtgactatttctaaccatttcacttacttttggctaaattgtctttgctttagagcaatggtaacctctttgactgtacatctaaaattctgttttaagtatatcccaattcttctgtgcctctgttgccatctcagttttccaagcttttgttttctctccctgttttcctcttcgtggtcttttaaatttattttgaatgctatatcttctggatgctaagttggttttcttacataccacagtgactagccagtcaccctcttgcactcatgaacagcaatctattgagttccatgtatcactaaacatctttcctagtgctgtttcaatcatattcatgttatattgctttctattatataggagctgtcccctctgggcattttctgcccatctcccccactatttccttttcactccaaactgccactttatatgtctctcatcattaaatgtgtagattgatcttactttctttcagaatttcttgactcagcaaattgagttttgatctttaattcagcttttaatgatggtagtgatggtggtgttctggtgatgtgtatgcaggtgtattttattcatagcttcttcaggttttaattctctaaacaaaatcccctctgcctattcataatccagccaatgtaatccccaggggcacagagaaagcagccttcaattagggattagtcaggccaggtcatggttggctaaggctcctggctgagcctcctactagatcccgctgtcactctcctactgttgtaattatggccacttttatttaaatacccctgccattttatttcaaagttattggctgattttttattttccctttcttccctatattaataatatttttaaatattttactgttaagtattgagggaaatcaaagtatttcactgcaaaatatacttctttgacaaattttgagaagtttgttaagaggacctgcaaacagaagtagccctgcaaagctgtccttttgcagggagatttgcatctgtagagaaaatctggcttgatgtagccaggttttctctaaggtcttcccttttcttaatgtaggaaagattgactgaaagtttaacacttttgaaaatctgaaagaaacacttaccatctattctctccgagggctgctttctgtgagatttcgtctacataaccagaccacttttgctggccagacctcctgttctccccatcccataacctttttatcaccataacctgttttgccatggtccaagcttttttctgtaaccttgctacaggaaaagggtcccaatccagaccccaaaagagagttcttggatcttgcgcaagaaagaattcagcgcaagtctgcagtgcaaagcaaaagcatgtttattaaaaaagtaaagtggtgaaagtacagattctccatagacaaagtaggacattcctgaaagtaagaggaagaacgcgtctaccctaggtacaatgcttgtatatatataggattaaaaaaaggtcatgaggagatgtgctctgttacaaggttttgtggtgaagaattagttttcttaattactatattttgcaagaatcaatattattatctttaaagtaaaattaggaatctctttgttctcaagatatcgggatatctggacactcccaagtctgggtctattcagtaaacattatcaatcggtttccttaaccataaacatctagaggccaggaacacctttcttccagggaatgcagcccagcaagtcccagcctcattgtcctagctcccactcaagatggagtcactctggttcgaacgtctctgacaacctcatgatgatagatacatttctgtaccccactaggggttgggggtagtcatgctgtggttctccctcatgtgttgtccctcccaccttaataaatttgtgtgccatttctcccattaatttccttttgtaacttgatttttcagtgacccttcagagggcaaaggggaagttttcccttggctcctatggcatgttttttgtttaaaataaaagtcaaaaacattgattaagttgacagtccattggtaagcatgtattaatagcatgtttttttctatgtgattttatatttaggaatctggatgaataccatactatttgaaaaaataaatttaatggttaccaaattgaagaataaagaaggttaaatcttggtaagctatattagatatactgtaggggatttcaatccatttttatgggtttgtttggtttaaatggagtgtttagttaataatactttgaatcgtgccttctattttatttactcacagatagctacaccattaaatgctctatttttaggagatttgctatttagactagtaataaaatgtccagggtaaatggagttttccactaggaaacatatttttatccacttatacatatcaagttattagctaataagctaataataggtgataacatattgaagaatgtaaatgagaaacactaggtttcattttggagaagtaaagacatctcttgtttcatattgttttacaattgaaaccacagatttatttacttaaaaaaaattaatagccattttccctatggcgcttcacagaaagttacccatttgtaacacttctttcagaatgttctccacaatcaatattttttatgggtggaactatgaaaaccaagaatcaatagttgattataataataatgacattagtaataaaagttgcaatgctttatgtaaatacagtgacttttttattgatctcaaaactgcttgtgtgtgtaattataatattggctgattcattcatattaaatacctatagcaaaaatagaatgagggcttgaagtcattggcgaatatttccatatgaaatgttatgtctcttatctttagtttagatatggatatttatgtttaattttttttgaattagcaaacatgtagtaaaactaacaggtgttcaaataacattcagaggggaaatgtcactattaatatgttttacacataaaatacaaatatctacatgtttaagtgccctaggataagttattataatttttcttttttctctctcagaattatatcttctttaaattattgatttccaaatatttctcttgagccaagacaccacgctgaattccacctgcctactttgtgtcatcacttagatatctaatagatattttaaacttaacatgtgcagatataaccttctgaacctgtttcttttttgcctcagtaaatgacaactccattttcccagttaacttggttcaaaaatcataaaatcaaccaccaattgatcacaacctgttacagatttctttgttccttcttcgcgctcactgctccacttgactagccttgaaaaataaaaattaaaataattttttttgagacgcagtttcgctcttgttgcccaggctggatggagtgccaaggccccgtttcagctcactgcaacctctgcctcccaggttcaagcgattctcctgccttagcctcccgagtagctgggattacaggtgcctgccaccacgcctggctaatttttgtatttttagtagagatgtgttggtcaggctggtctcgaactcctgacctccggcaatccgctcgccttgacctcccaaagtgctgggattacaggcgtgaaccaccgtgcccggcccgaataattttttaaaatgatggaatcattattggattttatttttctccaataccaaatattctaatatttagggaaacctattgggtttcttcagagtgtatgcagtatctgaccacttctcaccattttcatttttaaccacttatagtccaagctattattccatatcacctagattattacagtgatctccaaactggtttgcctgcttatccctgtgttccccttcacccccagccaaatctattctcaatacaaaagccagagtaattctattaaaatatatggagatcattgtactccttggctcacaaaactcattggctctttatttaacttaaaataaaagctgaagtccttctaattaccaacaagaccttacatgacttggagccctgttgctctctgaccttatctcctaatgctctgcctccttgctcactccaccccttactggtttccttgacttgattttaatagactaggtaattccattctcagggcctttgcacttgccattcctgccacctggaataatcttccctcaaatatctataggcattttttcctcacctgcttaagttcttgttcatatgttagtttcttagtgagctctttcctatctaaatattgtaaacatctctgacacctcctatctacattttgtgcttttttctccttagcacatattttttagttaggtttattgttctctgcctcttctctagaatgcatttttttctgtgaaggcagaacttttttctttttcttttcattactgtagctccagttcttgatgcataatagatgctaagcagtatcttgtgaatgcatggatggttcttcctattcctctccctataggaataaaaaatttggaagtaggcgagagaacactgcttagtgaatataaactaagaatggaagtacttatctcaaaggtttcaaatagaaactgatgttatgatgaatcattctttcaatctctttgtcacacagtgtggtcagggagcaagagctcctctaggtttgggaacaggatagcaatccactctaaaatcccatcctcctgttgtgttgggagaacattttgaattgagggtatggtaaaatactgtttcccaaacaacttactcattgaaacattgttggctggggtgtgtgtatgtaagggagagtagaacattctggaattatatgaaactaagtctgttttgctaaaacaaaatgaaagttctcagcattcactaggatttttaacgtcctgcaagtgattgattaagcttttccaacaactgatttttgtaacaaatttcatttaaagggatacaaatggcataataagatacatgatatatctttttattttcctgtattactttgtatctctcagtgctacccagaagacagtcactgatggtaatcaacaggcttctgtcactctgagagatagaaagagtggatgcaatttactttaaattctttttaaaccaacccttgatgcctggcttattgcagatacctggcccttttggctatcagtccttcagaggcatcagagaataaatacccatcacaacagctcctggtgttgtcctgggatagtggatgccgctttcttgaaaactgggtattccatctgttgataaggttgaccacaaatgttagcaatagtcccacataggtcattataatatttgtatcttaagtgtgattaatcttcttctttcagtttatctgtgaaactctcttatgcttttataagatattaatgggacattagtataatcttaaattaagattggttaatactgcactgttggtacataatttatgcttttagcaaagatggcttgtgatgtaaatattgcttaaaaacatcaatacaggacttcctggaagttccataacattttacccaatgatggggtagaggttaaaaggagtaatcaatgatttctttgatttttctcactgctgaggactatcctaagtgctttatatacatttacattaattcttaaaacaatctctcaagattggtattattagaaccactttattgataactaatctgagagtctcagagtggttaagttgatttacccaaggtcaagttgacagacggttaatctgcaaatacttactgaacatatactatgggtacagttattctactgagatgatacagacaacaaacagagttgcaatcctcatgtcttgccagatgataaaaacccacctacaggagtaccaaaattgttattatgaattaataatgtattcgtattcttgagattttgctcattgtagctgtcatttaaaacaaactttaggctgggtacggtggctcacgcctgtaatcccagcactgggaggctgaggcgggcagatcacctgaggccaggaattcgagaccagcctggccaagatggtgagaccctgtctctactaaaaatgcaaaaattacctgggtgggatggcatgcacctgaaatcccagctactcgggaggctgaggcaggaaaatcgcttgaacctgagaggcggaggttgcagcgagctgagatcatgccactgcactccagcataggcgacaaagcaagactatctaaaaaaatgaacaaacaaaaacaattaaaaaaaacccaaaaaactttattttgcaagtgtagacatgacaatgtattaacttaaattaacctgataactttagccaaatgtttattgtgttgtgttatttaacgttagataatattagtttgttttgtgtaaatagctgcaattacacattaaacaagaatgcaggaccagcctataactgtagctaatagcatatatatattatgttatagggtttacaaaatgattgttactttttgcagtatcacaataatcctatgaaattagtccattttgggggtgggggcaaggggagggatagcattaggacaaatacctaatgtatgcgaggcttaaaacatagatgatgggttgatgggtacagcaaaccaccatggcacatgtatacctacgtaacaaacctgcatgttctgcacatgtatcccagaacttaaagtatgataataataacaaaagaaattaatccattttaccgattaggaaactggagatcaacttggttaacaaatgctcaaagccatgtaccattaagtggaagagggggattcaaacccaagccctctgtgccatttttctagctcttttcaagataacaatggaagatgtgaactcactttctgatgttctatgattgaaaagaaacatgcttccacaaattgttctaattttactgcataattgagcagattatactataaattaatgtgttggcacagttaactatttcttgtttacttttctttccctaaggagtctgctactctgcaggaggccttttaaacagaaacatcccattaactttcttaacacagaggcgagaaaacaaacaacaacaagcatagctacaatcgctgttattaggcaccctgaaaagatgtaaccctgagcattggatagcagtaaatcatagaaggggggtgtcaggatggggaagccagaaagtctagcttactttttctcaaaatatgatctgctttagaatcctgagggagttgattaaacatgcagattcctgatctctggcccaaactactgaatctcagtctaacggcagagttcctaatgggcctgttttcataaagattcctggatgatggtttttgtttttcactcttgtacattaaatattaggactttgagaatctagttcattctgagtcatatgcttcagttaaggtactctgtctgcatagggtactctggctaatttaaacaaacaggaatttactaagagcacccaaaagttactgagacaagaagcagtattgggaataggaaggaatggagttaccttggggtctaggaagcaagaaccacaacatgaaaaatctgttcaggctattgtagctcagtctggatggatgctcgccgtttgtagtgtctttgtttgcatgcacaggtcatgtgttggtcccgtgtgtaatgggtaggtgggcccctgcagatgaaactggattgaatagggaaaagataagtccaaaaaggaaagggaaagaagggaaattaatactgagtagtccaaacatagcttttctacagtacaaaataatctagtttcactattgattgaagctaattgctattcctaagtaccctcctaataagacctagtctggaagggcccttcactcataaaaacaatgaggcatttaaatgctgatgatgggcctggcaccatagcttatgtctgtaatctcagcactttgggaggccgaagtggagaagtggaaggatcccttgaggccaggagtttgacacttgttccctaggctaatatgcaatggcctggtctcagctcactgcaacctctgcctcctgggttaaagcgatttttctgcctcagcctcccgactggctgggattacaggcgcccaccaccatgttcagctagtttttgtatttttagtagaggccaggtttcaccatgttggtcaggctggtgttgaactcctgacctcaggcaatctgcccaccttggcctacaaagtgctgagattacaggcgtgagccactatgcccggcccaaaataattttttttttaaaaatgagcaaggcatagtggcatgtgcctgtagtcctagctactggggaggctgagtcaggaggatcccatgggcctaggagtttgaggctgcagtgagccatgatcaggccactgcactccaggcaggatgacagtgcaagatactatctcaaaaaaataaaatgaataagtaaatgcctcttatgaaccctattgacatcaagtaggaatgagcactagagctttaagaggcctcagctcagcctatccagccctttggtggtgctgtgtgtctacaaaactttcctttgtacacagctactttttcccctacactcacctcaaaagggcttgtcaaggttgaggttgtagcccctagttattgaattgtttaattcaataacttgttttgtgaaaacgtagcagagataaataactttttctatgtaatagaacccacttaggatagttagctgattaaagtttatcatataactatagtgtccataccattaggtttccattgtctgcccttggccttaacatttcctcaacatagaacactcctccaaatcatatttctgactctttctcagcatttgtatttccgctcaaatggcattttctcaaagggaaatctttatgaacttcctcacaatgcccctgccttctactctatcctcactgcctgatcactccctagtctattatgatatttttccttcatagcagtcattatctgattaataagcatttttacttgtttaagattagtctctttatgctgcctcccaacatacaaacagtccccccaaactgtaaagtatctgctttcctcaacaggttatgaataagattgccatttatttaaagtaggacttgaatagatatttgttacttaaatccaaagctatcataatgccaatctctttaacaggggcacagaaggcccttcctttccattctatctttaaacacattatcatttatcctatgccttaaacagaatcgtgtttatagtttgctgaatatgctatatgctctttcatttttcatgaggatttctgttttttttttttctttgcatgcacagaatttaaaaaaaatttaaaaaaaggaaaagtcacaaggtggattaggttgctagaccttaaaacactccatgatttctttgtcttagtcatttcctttttttaattgctaaattttctttccagattccctgcttttcttttagtaagagtttaactgtaccttatacaaatcagtaattattctcttaataactagttatactacagggttagatagttggctcattcattaacaaagttaaacattttattttaaaacaagttttattttgtaaatataaccatttagcaataacttaaatttaagtttaagccataaatggaaaaattactacaacggtaaagcaacatgtaagtcagtctcaagagtgtttaaattttatgcaatgattaggaaggatgataggtatcagatctgaaactttataaactgtggacccttccctctcagcctatacaaaaatcaactcaaaatggattaaacacttaaatataggatctgaaactgtggaactactagaggaaagcataggggaaatggttcaggacagtcaacaaaaccaaaaatagacaatgaggttacataaaactgaaaagcttctgcacagcaaaggaaacaataagcaaggtgaatagacagcctgtagaataagagagaatatttgcaaattattcatctgaaaaggggctaatatccagactatataaggaattcaaacaagtcaacagcaaaacaacccccaaattattcaactaaaaaacgggcaaagcgtatgaatagacattcctcaaaagaagatattcagataaccaataatataaaatgatcaacatcactaatcatccagaaaatgcaaatcaaaaccacagtgagatatcatctcactccagttagaatagctaatataaaaaaagacaaaaaataataaatactagaaaagatgtggagaagaggcaactcttgtacaaggttgatgaaaatgtaaattagtgcagttattatggaagtcagtatggaacttcctcaaaaaactaacaataaaactcccatatgatccagcaatcctaccactggatatttatccaaaggaaaggaagtcggtatatttaacaggcatctgcacccccatgtttattgcagcactattcacagtagccaagatatggaatcaacctaaatgtccatcaacggatgaatggataaataaaatgtggtacatatacacaatggagtactatccagacataaaaaagaatggaattctgacatttaaggcaacaaggatgaaccggaagacattatgctaagtaaagtaaggcacagaaagataaaataccacatgttctcactcaggtgggagctaaaaaaaaagtgagctcttagaagaataaagtagaattatggttattagaggctgagaagtttagggaagagggaaagaaaaaaaggttggtccatgggtacaaaattatagcttgataggaggaataagttctagtgttcacagcattgcagagtaaatgtagttaacaataatttattgagtttttttttttttttttttttttttttttgagacggagtctcactctgtcacccaggctggagtgcagtggcacgatctccgctcactgcaagctctgcctcccaagttcacgccattctcctgcctcagactcctgagtagctgggactacaggcacccgccaccacgcccggctaattttttgtatttttagtagagatagggtttcaccgtgttagccaggatggtctcgatctcttgacctcgtgatccacctgtctcagcctcctaaagtgctgggattacaggcatgagccactgcgcctggctgtattgtgtattttcaaaaagctagaagagatgattttgaatgttcccaacataaaggtttgataaatgtttgaggttatggatatgctaattactctgatttgatcattacacattgtatatatatactgaaatatcactctgtaaccataaatacatacaatgattctatataaagataaaatgaaaagtaatgtttatgcttttattgtcaaatgtaattatatatatttaatttttgcttatgataagactattagagtctgcagataaatttaagtgcttaagaaattgaaacacatcagagttttacattgaaatgtgtggatctttcttcaagagtctcaagctcatgcttaactggacaattgaaaaatatcactctttactgatttatatcaagttttatttgtactaaaaactagttttagtacttacctttaattttctagtactaaaactaaaaactagttttagtacttacctttaattttctaaggaaagctagtaagatgctttggctaactttattgaagaataacttggtatgaaattatgatttgtgatagaaaaaagaacttagattttattatttattttcaaaaatcaaattaatgaaatatttagattgatcttttttgttagtcaataaattctgactgtggttgatcatggttttccagggcagacactatattaattttagtgtcatttgaaagaaaaatatgttacaactgagaatatactcatgaaaagataagtaacaatttaaacaatacacatcacaaataaagcagaacctattttttggaaagacttgctgtattattaaaagaggctactattggtttgattagtgtgacaaacttcatgatggagtgggaatttttaatggtcatggaaaattatttaatttcaggaggcgaaatattgatggatgagacattcaacaaagggttgatagagggagataggaaaggaaatagaaatgtacctggagacagatattgtcaatatgaccagggagaattaattgtgtatggaacagtgagatacatttgaaaatgtggtataggatagattatacagaattctgaggagtttaatactgcatttgtatccattagcaatggtgagctgtttaaaagaagtttttgaatctttagaatatttatttgaaaggtttgatatatttgttttccaagtgtgatctaaagatagatcacataataaaattgtctagagagttgctaaaaatgcatcaagctcccaaaccctaaccttctgatgtagtatgtttgggtgggaaccaggactacattttttagcaagatctcttattatttatcacttcacaataagtcttagaaccattggaggaggaactatagcctgtggagctcccttctctaaggttgctggagcccagtctctcatgcctctctcagcttattttcaaatataaaccatctcaaacattgtgactcaacaatacacctgaacaattaaagatgagtgcattttttttcctatgctaaacctcaaatgagtgaaatggaccacccaatagtcccatagctagctttttaaaatttttattttataaacatagaaattgactcttacggtcttaaagtttcaaagttatatttgttttatctgagttccttcctgaggaaaggaccttcaggcctctcaaaaaacgtgtcaaagaactgaaactcatcagatcaccatgtccagacaatgaaatactgaaccccctcattcatcatgattactttcttgccgctccctagttcctgttttcttacacattgtttcatttctttcctgctgtataaactcctagttttagtgtgtcaaggagatggatttgagaatgagctcccatggcctctgctgcagcacccaattaaaacctccttccttgacaatactcattgtcttagtggttggctttctgtgcggtgagcagcaggacctagaccaaacccttggtgtttcagtaacatgatcagaaattgtgatttgcttccaacctgtgttcaaagccaaggctctcagagaacatcattggtcacctttattagactgtcaccatattaagtaggactcttctgattgcatgatataaaatccagagactatgcaaacttagcaatatattttatagaagaataactttttggtagaaaaaattaggagtgccacttgggccttgttttgttttgtgtgtgtgtctgtgtatttttaaagtataagtctaaagtgacattcagaagagaaatgtaactctatacctttcattattgatgcatcgatttgaataatttgtgtaagttcttgggttaggcacacatggagtgtgtgtgaagagtaacgaagccttccatttgttcttcacaaatttttaaatgtgtctcctttattctttccattttgaaaaattaaatcattctcacgcctccatttgctaggtgtagatattcatatttggaaatctttgtatcctctgattgatgggtataagtctgtcatggaggttgccatgtaaagctaaatgcagaatttgttttctctatgaattgattgctcatgtaaaatcactttttactgctgctggtatttaacacataaatctatcatttactttttttttaagtgaaggagctactggtttatcatgtgtaggaaactttttttcactatgtcatcactaaatcgaaggtaaaattatgtttttttcctgaactatgaattctatgctttccttgaaatagataaaatagataaacaagtaaggtattagaggagtctggaaaatattcattagtatccacctttaggtttacctgaagtagtcaggattttctttttagtattccatttttatatgaagtaccattttatatcaacttcttttgttccattgtcagaatctaaagaaatattatctttctacctggcatttaaactggttctctatttttaatggatgatgtgcattgatttgaaataccttgataaataattatttaaatggatgaagagacaaattgttccagtaataaatatttaacctaggagtaggttaggcactttaaaaagctgtagtaatacatgcaaggcattttggttaatattcaaaaactgacctctgaaaataataaaaaatgtgttaattataatccaagacataccagagtaaacaccaatgaatcctcctttattttaccttgtctctcaatattctaattctgtaacaataaatatactcttaaaggtgaattttagacattatcaatttatctattagaaaattatatgatgctaattccatcatgatacatatttaacaatgtaataaattaattaagttaaacacaatttattagattaattacatggggcttaattagtaattaaataaactacactataacatatttacaccaatttatggaaaatgcttttctctttatctttattttttaattcctgacaacctggtagaagttaaactacagaaaaaacatctgcattctagattttgattattagtattctaaattacaaatgcttgtacttgaacaaattatattatggtaatttttttcctttaaagggagaatatcaatggttgaagatcaggctatttatcatcatctttgaaaaagcaaagtaacaatacagcccatttaggagacacattaatctcccatgtgactccagaagcaaacagaattttaaaaagcatcttcagaaattatttggaatatacttctgttctctaagaatatatctctaactttcttttaacaatttaagacataaaggcaacactagatactgatgcttcaggaagtgtcacagtagaaaagttttaacagagtttatagccctggggccttggaaggaaaagctaaaaactataagtagggtagtagtgaattacaatgataaaaactaaatgtcttccttttgcacattaagttatgttaaaacactgactggtaagttacagagctgcggtttgaacctacatttgtctgaaccaagtttccacacttttgaccacaataccttgatgcagtgattaagaaggtattttgttgaagcagataataggaattcatacacttcctctgtacttgctgaatgcatgatcttggacaagatacttaaggcctttgtctcaggtttttgttttttttgagatggagtcttgatctgttgcccaggctggagtgcaatggcgtgatctcagctcactgcaacctctgcctcccaagttcaagcgattctactgcctcagcctctcaagtagctgggattacaggcacctgccaccatgcccagctaatttttgtatttttagtagaggcggggtttcaccatgttggccagtctggtctcaaactcctgacccctcaggtcatctgcttacctcggcctcccaaagtgctggaatttcaggcttgagccaccacacccggcctcagttttttaattctaaatggagtgataatactataaaagtacttacttcatgtattagtccgttctcacaaagctataaagacatacctgagattgggtaattgacaaagaaaagatgtttaatcagctcacagttctgtgagctatacaggcttctgcttctgaagaggcctcaggaaacttacaatcatggcagaaggggaaggggaagtaagcacatcttcacatgagagcaaagtgggaggtgctacaatggataccccattctccatgatatgcttgtttcacattgcatgcctgtatcaaaacacctcgtgtaccccccgtaaatatatataccgactatgtacccacaacaatttaaaaaaataaaataaaatgacttctccccatctgtagattatctttaatttctttaaggtttattttacaggtcaaattccaacataaccatatttatcaatcttctattttatacttagtttttttatgtcttatttaagaaatcctacctttcccaagactttcacctttaatatttgactaaaagtctttttgttgttgttactgttcttttttttgtttgtttttgtttttgtttttgttttagacagagtcttgctctgttgcccaggctggagtgcagtggcacaatctgggctcactgcaacctccacctcctaggtgagttcgagtgattctcctgcctcagcctccggagtagctggaattacaggcgcccaccaccacacccagctaatttttttgtattttcaatagagacggggtttcatcaggtgagccaggctggtctcaaactcctgacctcaggttatccacccgcctcggtctcccaaagtgctgagattacaggcatgagccaccacacccggcctctactaaaaatcttaagttttgttattgacatttcattcctaggatcttctggagtttgtccttttatatggagtgagaagaggtcaaatttcatattttgttgttatcattgttcatatggaacattttgtgagtctctgtgaggcagaagttccatacaaaaaagtgtgtttggaagtaaaaagaaaaatcagaaaccagaagattctgaaaatgaaagattatcatgataaggaatcatattagcagtccagcatattaaatggaaggaatgtctgaaagcaccaagcaaagataacaagagatggacatcaaggaaaagatatgagttccaagagttaaaccatgaaaaacaaaactgtaaatacccggatttttaggggaaaaaaatagctgcagtaaaggcagtaatgaaacaataaagaaaatttcatttgcttaaaaaaatggagtctcaacactgaaagattcagcaatgaaagtataataatgaaaaatatatataacattagtttaacagttgaactcaacatctgtttacaaatttaaatttagacagtcttgctctagaatcactgctgtgtgaatctgtatgatttgacaattacaagtttgcatgacacactagatattattactatcgggctcaatttttttttttttttttttttttttgaagatggagtctctttgttgcccaggctggagtgcagtcatgtcatcttggctctgtgcaacctccgcctcctgagttcaagcaattctgctgcctcagcctcctgagtagctgtgactacaggtgcatgccaccacacctggctactttttgtaattttaatagagacggtgtttcaccatgttggccaggctggtctcgaactcctgacctcaggtgatcctcccaccttggcttcccaaagtgctggtattacaggcatgagacactgagcccaccctgaattttttctttttagaccaaagtactatagacaaaagcacacaaaagtcacactgatctctgtattccaactcctatctttggcatttcctatgaagttacagcgagactattttactcagcaaactatgtaccatgcaccatctgtggatggcagtggggaaaaagataacacaggaactcataatttaatacagtgtcagtacagtattatgagacaagataggatagaagcgggatcctcactattgaagagtctgcaagtgctataagatcctgcatggcagagagcgttcctcacgtggttagggagagaattacagtggagcaaaagaggcaataaattacaatcagcctatgtgactcagtgtcttcaaagttaataattgctaagaatctgaaatctaaaacaaatactgattattattaaactacagtgtaacacatactttcttcttggctatcaggtctttcttctttcaatacctggaggaaaaatactcaccatttaagccacttgcggaaagcccctttttgctttctaaaatttgcttcacaaaatgtatcattttctccttcctgtattcaaagcagttttagtcctattttagcaatttcaatgtgcattattttagttgtctgtctcctttaccacactatgaactcctgaagcatgatgtcaatatatttcttgtgtctaaaaagaaaaggaactcaacaattgactgttgaaagaatgagaatgaataaattgacaaataaatgaatgaactgaatgatcagcttgagaactcaaacatacaaaccaaaacagtatgccaatgggtattcatattttaaataacttaagcctcaaaaattgcatctcttgtgtttacattgaagtcaaggtctttggtccagctatcataccacaaaatagcgtgagtgcttcgcagcatcactgttactattctttcctccagttctccaatcccatcatccaaagtagtatttctctttctttcaatatagaaatgtcactattgaaaacctatcacatgttttattctattcaaagagaaagtaagacatgagccttagcattgcctcacccatattctcatgccctgcattgttaaagaagccactcagcagagctgtgctcttttaacactagcttgaaatttcatctctcagtgttgtcacagccaaatttttacaaatttgtgaatatccagttagagttcaattgtgagatcaacctttctcagcaactagatttccagccttttcttatgaggtcaggaaattcttgagtgttttccaagatgcacatgtttccagtttcacaaatagtaccaagacctaaatgaagctcctgattcctcccaggagtctagtaaagcacaaagcaaattctatccatttatggcccttctgtgcactaaaattacagctggtcctttgcaatttttatgtagagggaatttagtctctttattatctttgtacttgaaattatgaagagtcttattcaaagcaccgtacagtttcaaccaaagaacaggtatgtgccagatttaaaaatttggacaagaaattattaagtgactaatgtctgatcatagaacattgcacaatggacccgtttattttacatatcatcacaacttggattcgcacaacttgtgttttgcttgtaacttctatttcttgacttgattgctttgaaaagtttgcattctttaactagccttaattatttgtgtgtatgtgacatcacttttctctaaatggtcaaagttactttgaattttgttaatatccacttttaaatcaatgccaattgtcaaaatattaaatatataatttatctcaccaataaggaaactgaaattacctaaccaaggtactcattttatttaccattaattccctttattcagtcagtttgtgtctgttaagcgtgttgtttgtattaagcactatggtagatgctaaaaatgaagatatatatagcactgaacctaccctcaaaatacctaagaaaaagagcaaaagaaaaatcaaggtgaatggcctattacaatacagtgttttaagagctctgacagaggtaaggcaacaactttttcagaggaagaaactcataagcaaaggactggagaaaaagtagaaaggaattattaaaacatcaacgaagttaaaagactataggttttggagtcagaaacccagacttgtaacacaaacttacttagtatgtgactatttttgacttgtcccttcaacagcctcatcaataagagcaataaagtggtcagaatgacagccccaggaatcactgtagccatttcttcttagccattgcaaccaaggactacacgtgttaccaacccacagttctagctgaagcacctagccaactaactagcaacatttagggaattaaaatgtgaataatagtgaaattcaatatatattccgtcagtctcttgtgtatgatcccaaaagaaagacacaaaattgactttatgttcttcagaatccaacacaaggagagaatcctgattggtggcataatttagagcctgttacatataaacaaatcaattgctgcgaagagtcaaatctatttcccatcctgaggaatgagtacaatttgcactcatgcttcctcatggaatgatgtggcagtcctgggtcagcttgccttcagatctattcctcatgcctcttttgctctgctcaatgcttcagggtgctgatatgaaagctacttttttccagggttccctaatagttgacttctggctgggtataggcaatgggaagtgctgattgaattattggaagggagtagccaggctatttctccttcagcctcgctgtctaatgtaaagtctctagaagctgctgtgtctccttcctgggtctggctctcactctcagtgcacaggcacagcctcctttttccagggacctctgaccctctggcttcagaaactccatcttcttatattttccctccagcctaggcgtgttaactagtctgtcactattttctcatttgcttcattgtctcatttgacttctcaatgttcccatcatccatataaccattgccctgcattaaattccctctattttggcaacttaaagatgtttctggctgggcacagtggctcacacctgtaatcccagcactttgggaggctgaggtgggtggatcacatcaggtcaggagttggagaccagcctagcgaacatggtgaaacctcacctctactaaaagcacaaaaattagctgggcatggtggcagatgcctgcaatccgagctactcgggaggctgaggcaggagaatcgcttgaacctgggaggcagaggttgcagtgagccgagattgcaccactgcactccggcctgggtgacagagcaagactccatctcaaaaaaaaaaaaaaagatgtttctgtcttcacagatgaactgatattgagggcataagtttcatcatcaattatatcatgtctataataaaaatggtaagtttgtaagttatatttcttctaacatttatcagtgtgggctgggatataatgtaaaaacacagttcaaaaaaagtaattctacaattttaagagtagcaaaatgatgaatgcaaaatacccagctcattgatggctgattaatgaatgagaataaaactgagaatatatagaaacatagatagaagtaaaagtgatttagagacctccaaaacatatttttccccaactatcaagttttatataagtagtaaggtagtaagggcagagagtacttgtttctgactagtacctggaagaacaattaagagcactaccatactcctcaaaattcagctgagttggagataagataggcaacggtctacctgggacataaataaacaaatgttaatatagtttaggaataaatgatatcagaggaaaataatacataacaacatggtagtgacttgagatggggttgttgtggtggtggcacaatataaacactgaataatcagggaaggttactcttaggaggtgccctggaggaaagacctaaacgatctgatggtgccgaccttaatgaaaatccagggaaaacactaccggcaaaactacagcaaatgacaaggcccaaagtagaacaaatttggcatgacttgtttctgaatcagaaacttatacttgctagtttctcaggtgtcaaaaagtacaaaaaagagaagtacccccccaaaaaaagaccaatttgaaaatgtttttaagtggcaataaattcatttcaaaacaaacaaacaaacaaaccatggactatgtagttgtgaacagtgtaaactcccagaaaacactcggtggtaaacatatgttagtctaacttgctaaattagttgagcatgtattatgttccattgaccattctgagtactttaaatgtattaattcgtttaattcttatcacattatgaagtgatatggtttggctctgtgtccccacccaaatatcatgttgaattgtaattcccaatgttggaggtagagtctcgtgggaagtgattgaatcatgggggtgaaattcccccttgctgttctcatgatggagttctcatgagatctagttttttgaaagtttgtaggacttccataacttgaggtcttagatttaagtatttaatccattttgatttgatttttgtatatggtgaaagataggggactagtttgattcttctgcttacggatatctggttttcccagcaccatttattgaggagactttcttttccccagggtatgttcttggcacctttgtcaaaatcgacttcactataggtgtgtagatttgtttctaggttttctattttgttctatgggcctatgtgtgtggttttatgccagtatcatgctgtttggttacagtagctctgtagtatcatttgatgacaggtaatgtgattcctccagttttgttctttttgtttggaatagctttggctattctgagtcttttatggtgccatataaatattaggattttttttctatttctgtgaagaatgtaattggtattttcgtagggattgcattgaatctgtagattgttttactagaattgacattttaaaaatactgattcttctaatctatcaacatggaatatttttctattttttgttgtccttttcaatttgtttcatcagttttttacagttttcattatagggatcttttacttctttggttatcctaggtatttaattttatgtgtggctacagtgaatgggattcctttttaaattttttttcacattcttcactgttggcatataaaaatgctattgatatttgtctgttgattttgtatcctgtaactttactgaatttatcagttctaatagttttcttgtggaatctttaggtttttccaaacatcagatcatatcatctgaaaacaaggataatttgacttcttcctttccaacttggatgacctttatatctttcttttgtctgattgctctagctaggacttccactatcatgttgaataacaaggatgacagtgggcatacttgttgtgctctagatcttagaggaaaagctttcagttttctcctattcagtatgatactggctgtaagactgtcatatatggcttttattatgttgaggtatattccttctatctccagtttttttagtgtttttattatgaaggaatgttgaattttatcaaatacttttacagcatcaattgaaatgatcatatggtttttatccttcattcttttgatatgatgtattacattgattgattggcgtaagttaaaccatccttgcattctagggataaatcccacttggtcatgatgaataatcttcttaatgtattgttgaattcagtttgctattactttgttcaggctgtttgcatcaatattcatcagagatattcacctgtagttttcttctatttgttgtatctttgtctggttttggcatcaggctaatactggccttgtagaaggagtttggaagtactcccacctttgttttttagaatattttgagtaggattggtattagttcttctttgaatgtttggtagaattcagcagtgaagccatcaggtcctggacttttcttcactgagagactttttattatggcttcaatcttgttacttgttattggtcagttcaggttttggatttcttcctggttcattcctggtaggttgtacgtatttaggaatttgaccatttcttccagattttccaatatgttggcatatagttgctcacacgagccactaatgatcttttgaatttctgcagtatcagttgtaatgtttcctttttcatttctctttcaaaaatttctctttttaatttctagtttcataccattgtggtcagagaagatgcttgatattatttcaattttttgaacgttttaagacttgttttatgctctaatatatagtctatcattgagaatgatccatttgctgagtaaaataatatgtattctgtagctcttagatgaaatgttttgtaaatatctatgagatccatttggtctatagtgctgattaagtctgatgtttctttattgatatagtgccagtaagatctgtccaatgctgaaagtggggtgttgatatctccagctattattgtattgggactatctctctctttagctctaataatagttcctttatatatttgggtgctccactgttgggtgcatatatatttaacattgttatattatcttgctgaattaacccctttataattatatgatgactttatttgtctcttcttatagtttttgtcttgaaatctattttgtctgatagaagtatcacagctgctgctcttttttggcttccatcagcatggaatatctttttttatccctttattttcagtttatgtgtgtctttgtaggttaagtgtgtttcttaggaatagatccattaagattttgttttgtcatccattcagccagtctatgtcttttcattggtgagtttagtgcatttacattcaatgttattattgataagtaaggaattacttctgccattttgttatttgtttttgggttgttttgtggtcttctcttctttctttctttcctgtcttcttatagtgaaggtgattttccctggagatatgattattttcttgctttatattttttgtgtgtccattgtatattttttggttaccctgaggcttgcaaatactatcttataacccattattttaacctgataaaatcactgtttgcataaacaaacaaacaaaatgaacactaataaaaactatatgcattaactttgtctccctcactttttaactttttattgtttctatttatatcttattgtactgattatgtcttgacaagttgtggtagttactattttttattggttcattgtttaatctttctacttaggattaaagaagttcacatgccacagttacagtgttataatactgtgtgttttcctgtgtacttactattaccagtgagtttcatacattcatgtgattatttattgcttgttggtgtccctttcttactgcttgaagcactccctttagcattactttttatttatttgtttattatttcgatagttttaggggaacaggtattatttggttacatggataagttctttagtggtgatttttgaaattttggtgcacctataacccgagcagtgtacactgtacccaagatgtagacttttatctgtcatccctctcccaaccttcctcccgaaccctcaaagtccactatatcattcttatgcctttacatcttcataccttacctcccacttataagtgagaatgtaagaggcttggttttccgctcctgagtaacttcacttggaataatggtctccaactccatccaaattgctgtgaatgccattatttcactcatatatatatatattccatggtacatatatatatactccacattttctttatcctcttgttgatttatgtgcattgggctggtttcatatttctttttctttctttttttttttttgagacagagtctcgctttgttgcccaggctggggtgcagtgatgggatctcgactcactgcaagctccacctcccagttcatgccattctcctgcctcagcctcctgagtagctgggaatacaggtgcccgccaccatgcctggctaatttttttgtatttgtaatagagatggggtttcaccatgctagccaggatggtctcgatctcctgaccttgtgatctgcctgccttaggctcccaaagtgctcggattacaggcgtgagccaccatgcccagccctggtttcatatttttgcaatcgtgaattgtgctgctgtaagcatgtgcaagtgtctttttcatttaatgacttcttttcctctaggtagatactcagtagtgggattgctggatcaaattatagatttacttttagttttttcaggaatctccatactgttttccatactggttgtactggttcacattcccaccagcagtgtaaaagtgttcacttttcacaacacccatgccaacatctattatattttgttttttaataatggccattctttcagcagtagggtggtattgcattgcggttttgatttgcattttcctgatgattagtgatgttaagaatttttttataattgtgattatgaaaaaaattagtgactgaagcactcccttgtttcttgaccatttgtatatcttcttttgagaattttatattcatgtcctttccctactttttgatgggattagtttttcatgctgatttgtttgagttccttgtagattctgaatattattcctttgtcagatgtatagtttgcaaaaattttcttccactctgtgggttgtctgctggctctgctgattatttcttgctgtgcagaagcattttagtttaattaagtaccgtctatttgtctttccttttgttgcatttgcttttgggtacttggtcatgaactcttagcctaagccaatgtctaaaagagtttttccaatgttgtcttctgaaatttttatggtttctggtcttatatttaagtctttgattcatcttgagttgattttttgtataaggtgagagatgaggatctagttttattcttctacatgtggcttgccaattttcccagtaccatttgttgaatagggtgtattttccccgctttatatttttgtttgctttgtcaaagatcagttggctgtaagtatttgggtttatttgggggttctttattctgttccattggtctgtgtgcctatttttatgccagtaccttgctgttttcatgactatagccttgtagtatagtttgaagttgggtaatattatgcccccagatttgtgctttttgattagtcttgttttgatcatgtgtgtgcactcatttttggttccatgtgaattttaggattattttttctagttctgtaaagaatgatgttggtattttgatgggaattgcattgaatttgtagattgcttttggcagtatggtcatatttacaatattgattctacctgtccatgagcatgggatgtgtatccatttgtttgtttcatctatgatttctttcagcagtgttttgtagttctccttgtacagatctttcacctccttggttaggtggattcctaagctttttgtttgttttgcagctattgtaaaaggggttcagttcttgatttgattctcagcttggtcactgttcgtgtataacaatgctactgatttgtgtacattgattttatatcttaaaactttacagaattcatttatcatatcttggagctttttggatgagtgtttaggggtttctaggtgtatgaacctaaattggcaaaaagtgacaatttgacttcctttttatcaatttggttgccctttatttctttcttctgtctcattgctctagccaggacttccagtactatgttgaatagagatggtgaaagtgggcatccttgtcatgttccagttctcagggggaatgctttcaacatttccttgttcaatataatgttggctgtgggtttgtcatagatgacttttattaccttaagttatgtcccttctatgctgattttgctgagggtttaaatcataaaggcatgctggattttgtcgaatgctttttctgtatctattgagataatcatgtgatttttgttttaaattctgtttatatgacatgtcacatttattgacttgcatattttgaaccattcctgcatccctgtaagaaacccacttgatctttttgatatgctgttagattcagctagttagtattttgtcgaggatttttgcatctatgtttatcaggcatattggtctgtagttttctttctttgttatgtccttttcttgttttggtgttagggtgatactggcttcatagaatgatttagggaggattttctctttctgtatcttttggagtagcttcagtaggattggtaccaattcttctttgaatgtcggatagaattcagttgtgcattcatctggtcctggacttttgttgttgttggcaattttttaattatcatttcaatctgctgcttgttattggtctgttgagagtttccttttttttcctagtttaatctaggagggttgtatttttccaggaattatccatcttctctgggttttctagtttgtgcatttaaatgtattcatagtagccttgaatgaccttttgtatttctgtttttgagatgaagtctcactctgttgcccaggctggagtgtagtggctaatctcggctcacggcaagctctgactcccgggttcatgccattctcctggctcagcctcctgagtagctgggactacaggcacctgccaccacgcccagctaattttttgtattttttagtagagacggggtttcactgtgttagccaggatggtctcgatttcctgacctcgtgatccgcccgtcttggcctcccagagtgctgggattacaggcgtgagccatcgtgcccggctgatcttttgtatttctattgtattggttatagtatctcccatttcatttctgattgagcttctttggatcgtctatcttcctttctttattaatctcactaatagtctatcaattgtgtttatcttttcaataaactagctttttgtttcatttatcttttgcattttgtttgtttcaatttcttttagttctgctctgatctcgcttatgtcttttcttctgctgggtttgggtttggtttgttcttgtttctctaattctttgaggtgtaaccttagattatctattcatgctctttcaaactttttgatgtaggcatttaatgctactaactattttcttagcagggattttgctgtttcccagaggttgtgtcatgtttgataggttgtatcattcagttcaaatcaatttttaatttccatcttgatttcattgttgacccaaagaccattcaggagcagattatttaatttttatgtattttcatgattttgagggttccttttggagttgatttccaattttgtcccattgtggtctgagagagtacttgatataattttattttcttaaatttattgagacttgttttgtggcctatgatatgtcctatcttggagaatgttccttgtgcttatgaatagaatgtatattctacagttgctaggtagaatgttctgtaggtatttgttaagcccatttgttctagggtatagtttaagtctgttgtttatttgttaactttctgtcttgatgacctgtctagcgctgtctgtggaatattgaagttcctcaatattattgtgttatctatctcatttcttaggtctagtagtaactattttataaatttgggagctccaatgttaggtgcatatatatttaggattgtgatattttcctgttgcatttatctctttatcatttttatataatgttcctctttgtcttttttaactgctgtcactttaaagtctgttttgtctaagaatagttgactccttcttgcttttggtgtccattgcatacaatatctttcttccatcttttcaccttaagtttatatgagtccttatgtgttagatgagtcttttgaagacagaggatacttgattggtgaattctgtccattctgccattctgtagcttttaagtggagcatttagaccatttacattcaaagttagtattgagatatgaggtactattctattcaccatgccatttgttgcctgaataccttgggatttttgtattgtgttgttgttttataggtcctatgagatttatgctttaaagagattctattttggtatattttgaggatttgtttcaagatttagagctccttttagcagttcttgtagtgctggcttcgtagtgctgaattctctcagcatttgtttgtgtgaaaaagactttatctccccttcgtttatgaaacttagttttgctggcaaaaaaatcttagctgataattgtttttttaaggaggctaaagataggatcccatccctgctagcttacagggtttctgctgagaaatctgctgtaaatctgatacattttcctttgtagattatttgatgattttacctcatagctctttagattctttcctttgtcttgactttaagtaacctgataagtatgtgcctaagctataatctttttgcaatgaatttcctgggtgttctttgagcttcttgtacttggatgtctatatttctagctaggccagggatgttttccttgattattccctcaaataagttttccaaacttttagatttctcttcttcctcaggaacatcaattattcttaagtttgttcaataatcccaaacttcttggagaatttgttcattttcttaaattctttttttctttatctgtgttggattgggttaatttgaaagccttgtctttgagctctgaaggtcttccttttactttttctagtttattgttgaaattttccagggtattttgtatttatctaagtgtgtctttcatttccagaagttgtgattcttttttatttatgatgtctattctctggagatttttttcatccatattctgtttttaagttttggttgttttaatttaagtttgttttctcctttctttggtgcctccttgagtagcttaataattgaccttctgaattctttttctgacaattcagatatttcttcttggtttggatccattgctagtgaactagtgtgatcttctggaggtgttatagaaccttgttttttaatattaccagaattgtttttctggttccttctcatttgggtagactatgtcagtggaaagatctggagcacaggagctgctgttcagattatttttttctcattgggtgctcccttgatgtggtgttctcccccttttcctagggatgcagcttcctgagagctggactgccgtgattgttatttgtcttctgggtctagccacccagtggggctacagggctctggtctgatactggggagtgtctgctaagagttctgtgatgtgatctgtcttcagatctcccagctgtaagtaccagaacctgctctcatggaggtagcaggagagcgaatttgaggctgtgagagtccttggttgtagttgtttagtccactgtcttttttgaatgctgggtatgctagcagtaaagttgtcatatggacagactcaggacttctggttagcaagggtgttaaagttagtagaattagctgttattttctccttccttggagcagggttgttctgttatgacttgctgtaatggcttgagttggttggccttcatccatgaggtaatgctttcaagagatcaccagctgcagtagtatagaggggatacaccttgccctgaggccaccaggataagtatttgggtttctctggtaatggatagggctatagagcttccaagagtttgtgtcttttgtgttcagctaccagggtttgtagagacaaaccatcaggtcggggcagggttaagtgggtctgacctcagactctccttgggtggggcttgctgcaaccactgtggggaatgtgggggttgttctcaagccaatggagttacgttctgaagggaattaaggctgcctctgatgtgtcatacaggttgtcagggaagtggaggaaagctggcagtgacaggcctcacccagctcccaggaagccagcaaggccagtctcacttctgctgtgctctgtcaacaacaaacagtgccaagtttatatccaggcctccggcacacagggctacaagactccctgctgagaaagaaagcagggcttttaggctttgcccttccctgtctgccacagcttctgtgcttatgtctgcactttgcatttgctccccagactctgcccaggaaaattcactctctcttgaatttactacaaagtttagtggaagccttcttctccctgtggcccttccctgattccactggctgcgttccccaaaggcccctgtgaaattaaagtcagaaatggcttccttggggttccctgaagattgggcatgcctacaaggctcttcccattgctcattctacttttgtattttacttggctctctaattttgtttcagctcttggtaagggtaaattattctcttgtgatccttattttcattttcctgagtgtattagtccattgtcacactgctataaagatactacctgagactgggtaatttataaacaaagaaggtttaattgcctcacagttccacatggctggggaggcctcaggaaatttacaatcatggtggaaagggaagcaagaactttcctcacaaggcagcaggagatagtgtgaacatgtgaaggaggaattgtcacatacttgcaaaaccatcagatgtcatgataagtcactcactatcatgagaacagcatggggaaaccatccacttgatccaatcacctccttcttttgacacatggggattacaggtccctccttgaggattacaattcaagatgagatttgggtggggacacagagccaaaccatattactcagtgaggatgtgtgtttgggggcagactttccacctctcgcactttgggaacgcacaatgtttcagctgtttcatggaggttgcagcagcaagccacttcttccaaagggtttgtgaattattttggttttcctgttgtgttccctgcagtggttcttggagcaaaagttcacaatgtgaatctccacatgctagttctgtccatctgagtgggagctacaagttagtcttgtctcctatcggcaagttttttcatcaccaacttcctttagtatttcttataggacaggtgtgatggttaatactgagtgtcagcttgattgcattgaaggatacaaaatattgatcctgggtgtgtctgtgagggtgttaccaaaggagataaacatttgagtcagtgggttgggaaaggcagacccactcttaatctgagtgggcaccatctaatcagctgccagcatggctagaatataagcaggcagaaaaatgtgaaaagagagactggtctaccccggctaaaatggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaaaaaaaaaaaaaaaaaaagagagactggtctaacctcccagcctacatctcttttccatgctggatgctttctgccctcaaacatcgaactccacgttcttcagttttggaactcagactggctttccttgctcctcagcctgcagatggcttattgtgggaccttgtgatcatgtgagttaatacttaataaactcccctttatatgtatgtgtgtgtgtatgtgtgtgtgtgtatatatatatatatatccattagttttgtcccgctagagaactctggctaatacaacaggtctgatattgatgaaatgcctcagctttttgtctggggaagtctttatttctctatgtttaaagagtattttcactggatatgctattctagggtaaaacttgtttttgtttgtttgtttgtttgtttttattcagcactctaaatatgtcatggcactccctcctggcctataaaggtttccactgaaaagtttgctgccagatgtattggatcttaattttatatatatatatatatatatatatatatatatatatatatatatatatatatatatatatattttatctcttgctgctgttatgatcctttctttatctttcatctttgggagtttgattattaaatgacttgaggtattctttgtattaaatctgcttggtgttctacaaccttcttgtacttggatatcggtatttttctctatgtatagaaagttctccgttattatcccattgaataaactttctacccctatctctttttctacttcctctttatggccaataactcttagatttgccctttggaggctattttctagatcctgtaggcgcccttcattattttttattcttttatcttttgtgtcttacgattgtgtgttttcaaatagcctgtcttcaagctcactacttctttttttttttttttttttttttttttttgagacgcagtttcagtctttgttgtcaaggctggagtgcagtggtgcaatcttggctcactgcaacctccacctccccagttcaagcaattctccagtctcagcctcctgagaagctgggattacaggcgcacaccaccatgcctggctaatttttgtatttttagtagagatggagtttcaccatgttggccaggctggtcttgaactcctaacctcaggtgatccaccctcctcagcctcccaaaatgctgggattacaggcatgagacaccacgcccggcccaagctcacgaattctttcttctgcttgataaattctgttatgaaagggctctgatgcacccttcagtatgctaattgcatttttcagctatagaatttgtgctcaattctttttaattatttcaatctctttgttaaatttatctgacagaattctgaattccttctctgtgttgtcttgaatttctttgtgtttcttcagcacagctattttgaattctctgtctgaaatgtcacatttctctgtttttccaggattggttcctggtgacttatttagtttatttggtgaggtcatgttttcctggatagtgttgatgctagtagacattcttcagtgtctgggcattaaagatttaggtatttattttagtcctcactgtctgggcttagttgtagacatccttcttgggaaagctttccagatacttggaaggattgggtattgtgatctaagctgtatctactttagggggctccccaaacccagtaatgctgtgtttcttacagacttgcagaggcacctccttcacagtcttggacaaggtccaggagaatcctctggattcccagggagacactcttgttctcttcccttcctttctctcagtcagtctctttctctctttctctctctctctgttctgaaccacctaaatctgtagttggagtaacataagcaccactgtggctgccaccactatgatggtactgggtcagacctaaagacagcacagtgctgcatctcacccaaggcctgctgtaactacttcctggccactgcttatgttcactcaaggccttgtggctctacactcagcagggggcaaaaccagccaggcctgtgtccttttcttcagggtggcgatgtccctcaggccctgggtggttccaaaggcactgtccaggagtctgggactagagtcaaaaaccttagacgtctgcctggtattgtattcggctgagctagctctcaaatcacttgatgcagttcttcccacttttctcttccctttccaaaggcagaggagcctcactcctgcagccacaaccaccgcaggccatgaggagtactgccagactacaagccaatgtttccttaaggcccaagggctcttaaggcagctgtggtgaatgaggaactggactggaactcagcttttagggcagtgggctcccttctggcccagggcaggtccagaaacatcatccaagagtcaggtcctggaattagggaccccaagagtctgcttggtgctctgccttcctgtggctgtgctggtacctgaggccagcaagtctcagtgtctcacccaaagcccttgatgcagtacctgggtatcgctgctggttattcagggactaaggaatcttagttagcaggtgatgaatgctgtcaggactgagtcccttccttcaaggcagtgggttcttttctggcccagggtgtttgtctaaaaatgtcatttgatagctagggcctgtaacagggacctcaggactctgttgccctatcctattgtgtctgacctggtatccaagaggcaaggcaaagtcctctcccttcttctctctcctcttctcaagcaaaatggaggggtctcttggagctggaagctctgcaacttggggattaggggaggggtgatgccagctctcccttggctgtcccagctggtgtctcagtagtcacgtggcccccccagtcaactgtctgtgagcctagttcagcattaagtgtcacctaagatttgtagtccttatgacccagactgcctttcaaatttacctggagacaagagcgctgtagccatctgtgctgaggtttgaaggcactcaagttctgatggctgtgatccaggattctcctcaggctggggctggtttaaaggttccctcagtgggccagtgtcagttgagtttggttcagttttcttttctgttctaacaggacaccactgagtttagtgcctcacaattgctgtgctctccccactactctgcctagagatgctctgggcacccctccaaacctgccccaggtcagggaggggtggcatcatgattcaaaactgtttttcctatcccttcagtgcctctttcgacgatacaaagttacaaccaggtactatgagtgctcacctgatttctggttcttgtgaaggtgtttcttcagtgtagatagctgttaacttggtgtccttatgggggcggggttgggggatgatggagtcttctattccaccattttgctctgcctcttctctagaaggcatttttattatatacaatgaagaaagtattatcaacaatatataaataaatgctaagtcaattaaaaagcaccagcaatttcatagataaatggccacaaatcatgattagcactttacagaacaggaattatatattgctagtaaacatatatgaagacatattttggacttaatagtgattagagaattacatatcataccatggtgagttctcttttaaattcatttgattggaaaaataaaataaaaaggtcattatatcaagtgattaaaaagacgtgagtcctctgagtcttttatatatcatttctttaaacataagttgataccaatgctttggaaagcagttagatattattgtgtataattttgtatactgtgtgatgaagtaattttggctgtagatccaggggataatctctcctgtgtactctggaaacagcaggttcacagcagctctcttcacaatagcacatctgtagaatcaaatcaaatgcttccacattagtcaagtggctgaatatcatgtaatatgctgttataaatccacaaaatgaatataccacaatgacacacaacagcatgcatgaatcttagcaatataaacataaatacttagcaatttaaacataaaacaattaaaatgaaattaaaaattttggaaagaaacatagatgagtaaaaagaatatgaaaagaaaagaaatggaatagcaaacaggcttcagaagggttgttctcttgggagagggaacagaggaaatgaggtgaaggaagagaaaataaatacatattaatgattggtgagattctactctttgtattgtgtggtgggccctcagttgcttattacactactcaagagggatgactgcataaataaaaacagacagccatgcatgaatcagttatgacagtatcatgcatatacgtacagttgagcaattctatacaccagggttggaaccaaaaattgccatctacctacttcacaacagtaatctactgccattattccagagccagttctgagtcttctgcttctttcacctttcttttgagcttcattaggagcatgctattattttattttgctcattctttaagactcaggtcccgctgctggcatacagtgattcacagagtaggggatggtgtgtttcctctgctccattcggtctttgttttcacaacaggcagattagaagtttcttattgaagccccagaaggaaaccatctctgctcgcccatctttttgtagtctcccagcctcagtcatgcagagaaacttgaagcttctcttcaagctctgaaggtcagccagaccagaaactaatgtgacatagagtctcttttccaatctctgtaggtcaggctcttgccaggatctgtctcagcctaatctaaaccatggaccctatatcaccaggccccaggcactgtcttctctgaagggtgcaagacatacctcaaatattttttattcttcaggactaaacgagacttgaaggctcagttgcctccttcaattcattggctcccttacgtccacagcagcttcttggctcataggaggtagatgtgttaggtttgatagcaaagtgtagccaggatgtttaaaatttgctattttcccagaaatgtctactctcttaaatattcttttaattttaataaagttttcatttttataggattatccgctcaaaattataagaactttgtatttatctattcattaaccccctttataatcatttcttttccttcatttgcaagacgtaaccattttttatattttactttgcaaagtaaaggaaagatgaaactctaggaatagcaagcaaagttttaacatttacagatggcagagcaggtttgagaataatctaactttgggaatgactacaaagggtgttaattaagtagcaggtgttttatcacctatgtctattcaaaaaaaaatgtagcacagatgtagaaagcttaagtacatctatagtttgtataacaaaactctatattcattgggttccatctgccacactaacctcaaaccacacttagtgccaaccaattaacaccttgattaagctatagaccacctgcagcttcagcaatgtaatgaattcactgacttttatacaaattcattgtaaaacctagactgaaactgcatagcaaaaagagaaaaaatgataaatgattcatgcatcagccttggtgtaggcacacacagacacacacacacacacacacacacatttactaaggcatgcacatcaattgtctcatctctgctgctctcttcattttttaaattttctttaacaaaggagacttggctaaaggcatttcaggcttataaacccacaaactataagcagaaaagaatatcatatcctcctccatcaactcaaattttaaaaattccaggaaagtactccaatttgcttaactcaggtcacatgctagttctgaataggattgggcattctggttgacacagtttaaattggttgcctaatcctgtggccacaatgaaaggatatggctgacagaccctaccataaccatgcggcaaaagcaggtgaccaaaatatatttagtctgaaaaaaaataatctaaatgaataatgtaagataattgatacatgtatgtgttgttagaagtatattaaattctctgtcttcactttttttggtgaaatcttcattgctcacttatgaattatggaacagcttttctttccatactgagaaaaaaatagttacttcctatcagagaaaactaagagataagttaaaataatttaaagaagaaaagagacattttgaataatgaattttgtgacacctgacctactaacagttggcaggattgattagagaggagagagctggaaaaaatagtagacttttatgatcatctttatgtaatgttgtaaatggaggaaagttaaactggaaagataggtctgtgtttctggagaaaggttatacaatgaggaggtagctgggtgatgactgttctactcacgctgtcgcaatgtttgcagtagttatgaattatttttttctcaacttatcatggcagaatgccacttataatttaaaaaaataacccagaatccaggaaagatgaaaaacagcaacaacagtataaactagggtaaaaatatattttatttagcacagctcattttgttttactttattttgtttatttatttattttgagacaggatctcactgtcatccaggcggtagtgcagtggcctgatcactgctcactgcagcctcaaccttctgagctcaattgatactcctacctcagcctcctgagtagctgggaccacaggtacacaccaccatggtgggctaatttaaaataaaatattttttgtaaagaaaggttcttgtttggttgcccaggctggtcacgaactcctgcctcagcctctgaaacatgagccactgtgtccggagcacagctcattttattaagaagctcattgcagagctagttatccaaaactatgagaagagattcatccagttattcaggatttagcatcagggtgtattctaaataaaggggctcagaggctgtcatgactttaagtgtcatcattccataccaatcctttttatgaaaaggaagaaaaagaagttctcgaattttatttgttctcaaggagaactctcaaggagaagaatggcagtttttagtttacattattatattcatatggctgatgttttacttctgccctcaaaatcctctctgaaaaaatatcttttgtagcctaccctaattggaaatatacagagaaggaaattctgggaatcacagttcaatctgatccagtggacacattatagtcactacagttcatgcattttgaacctgaaagctccacacttctttttaagccatatgtaatctacaagtaaacaaagccatactcctgcctcatatgaaaatatgacatatctctcctgccttataactgaacatagacttagtcttcattctaacggttacaaagtcccatttcaaaaagcagttttcttctttcatctgattcacactccttctttaatatcctataacttacttagtgagatatgcactgatagctactattaatgcattgtgtgtttggcgataggggaataggaaggggaaaaacaatacttgttatatgtgtgtgcatgtatttgtgtgtgtgttcatataactaaggaagaaaaaactattgtagtcttaatttctgcaatcagtcatgtggttgcagcagatacttctatctgcccttttccactgcccattccattttctcagcagtggtcaactacctcaagtgagactattacaggttctacagacaagggaaagctagctttctcaggcaggaatggaaagaaaagtaggcttagtggaattcagggattcaatcttgtcatttcatctaaatttgcctatatgtccccatcctaattttcagggttccatttatttccaattaatgccccaaatttgagaaaaatgattctgtgagttaggaaattcaatttgtattgtaattcagccattatgattagattttgggtttggtttcagatctttcagacctgaggttataggagataaggatttattttagggaaggcttagaacttacccaggttcttactgagattcaatctgagaatttaaagccatgagattattttcctttgataactactaaatactgtatcaataagaagcagaatcactatgaacattatacacacacaaacacacacaacttgttacaaggatttgagtatatacaattatgtgagctggttgcaacagtctctgtaaatttgctgattttggatttgatactggtgcttgaagactctagggcaggatcagtcaggaaggaaaaagaaggatgtaaagtgggagagaggaaagccaagtttaaacccacaaatatgagctgaagcccctgaggacaaactggagcacatgttcattctacaacattggtgataggggttccctacaggagaaaccggtacttcctttttggcagtaagcagaaacctctcccaagagtttgggaagctgcaggaaggtccatgggtagcctagccactgcaccatggtaatcagttgagcaagcagatgagtgacatgtattaacaacaaaagctctcttgactgtctcaatctctttccaaacataagaaaccatatgactactgcttggcttcttccctctaaattgcacacgaaaatgtctctgtggttcactctaatctgaaatatcaagggaaggaatttctggaaatgtaatttagtctaggcaagtctacacattactaagccaccacatggtatctttaggttgtttcgatattgtttgggtattgtgtgtatacaattgattaatatttctaagttttgttttataaattgactttcattgagatctatttcttgtaaattcaatcatgtggaaaatacaaatagtaaatcaaatataattttatataggtttgagaaatttctgcatttctattggcagtaataccccagactactctctgattagtcttacgtgcatgtaatgtactttttggtctttgacattccaaggcagctcagtttaatgattttgtcccccttatttcattagtactcatattttatagtaattaaaagcacaggctctggatatagcctaaaatcaaatgtcagcatcaccacttattagctgtgaccccaggtatactacttaactgctctttgcctagttttttcttgtgtaaaatagtctaggattaaattagctgatatttataaagtgttcagaatagtgcttgtctcattatgttctgtattttccccatatggtatatactaggggagggattaggctttttgttgaattttttcttgtttttttaatgaatattcaccaataatcattcacccaaaattgtcacaaacactcatgttggccatatggatcaagctctcctaaaatgtggtaatcatgtataattttttgaacatgctttaatacacacacatacacatacatgcacaactatttccagaattattgtgtctttttttatatttccagcagcaaggtataagaaatccagtttctctgcatcccttgcgagcatttcatattgtctatattgtattattttatctgttctaacaggtagtgatatattgtcatggttataatttgcattttcgtaaagctaattatatcagacatttttttcatgtgtttatttgtctgttaatgtcttttgtattattatgaattggctttctttaccattgaatttttcaggattctttaaatattctagatacaagttctttgtgagatatatggtttacaaatacacactctcaatctataggttgcctttttatcctctgaatatggtctttttaatcttgattaagtacagtttatctgtgttttacttttaccgatcatgattctgtgtcatgtctaaaaattctttgcctagctcttggtcccaaagattatctcccgtgtttcttctaaaagttttattgtgttgcattttacatttcaatctgttatacctgggccatcttttgacaacttctatggttcactgcccggcatcttctatctagttgttcatagtctcctatccttttataaagaaatgttagtggcatcactgggtcaaagaagtctttttttacagctccgggatatggataggtgtttcaaacaccattctaaatttctgattagcttcatgtgcaaacgactattctaagcaaatcttggataacctctacctttggttaacgatattttgaaatactgatgtaattattcttccttatcctaatagtaaaaaggatgaatgaacttttttcttcagtagtctcaatataagctgtgggactaatacttgtcataggccctttgaaatagcaaacacagtgactttcatactatttccacatccccctaagctcttgagctcacatttgcatttctcttcccacttttcccttctatatacagatagtaaatacctttgaagatatcattcaagtgagataatttgttgcaatttttcaatgtttcattctagtttatacaggtcaatgcctttgctatgattttaaggcttaagcaaaaccttggtgttttatgaatttctacttattgagcaaaacctatatttgagaaaacaatgtgtatagtggcaaattgtaagaaaatatatccatctctcaaaattgtataaaagtatagtagctttgaattctaaaatagatccaattcctcaaattgactatcattatttttttcctttggaactataaacaatcaccatttctgattaatttctgtcatataaatcacaatccttgctttgtattattttacttgatatattctatatataaaacatacagttcacatatagttaccatttcttttccatacaacagctaaagatgtatttgactattgaaatgcttaagccttacttaaaaaattttacatttttataatactaatttttaatagcacttttgaagataatttgaaacaaaatttgagaataataaaatttgtcattttataaatatagaaattgatagactacagagttgatgattgcaggtttgtagtttaaattggaaagattttgtacaaatctctctgatagtcaatactaaatcagtaatggagtaataaaaacctcttaaattgctttaattcatatattcacttatctaaataccactggcctgtatcttaaattattgagaacacaactgaaactcagtatgtcaatacaaagggttctgaacatctaaataacaaatttcaaaacccatcaaataataattctcaagaaaatctttcaggtaactttcaattctaatggacgcttgaacatctattgtttttgtttgtttgtttgtttgtttgtttgttttaatgttagcatattagaagttgcaatgtggctgggtgcaagtggctcatgcctgcaatcccagcactttgggaggccagggcgggtggatcacaaggtcagaagatcgagaccaacctggctaacacggtgaaaccccgtctctactaaaaatacaaaaaaaaaaaaaaaaaaaaaaaaaaattagccgggtgtggtggtgggcgcctgtagtcccagctactcgggaggctgaggcaggagaatggcatgaacccaggaggcggagcttgaattgagccgagattgcgccactgcactccaccctgggtaacagagtgagactccatctcaaaaaaaaaaataaagaagaagtttcaatgtaaaggaaaaagaggctttaaaaacagcagttctcctacaactagaaatggcaccactatcaatattatattaaatgtcaatggagaaaaaaggaataatgccaatactatcaaaaataatttaaaaattttagcagttaagggatgtttaaacggtgaatgatactttgaaaggaccactgtagagtaaaatatttgatgttcatagtgattactctgagttattagaaaatatacatcgagcattacattctgattttaaaagggtagtgaaactactccatatgatactacaatggtgggtacatgtcatcataaatttgtccaaacccatagaatgcataacaccaagggtgaactctaatgtgaaagtgtgaactttgatgataatgatgtgttcatgtaggttcatcaattgtaacaaatgtaccattctggtgaccaatattgatgacgagggaggctgtgcgtatataggatcacgaggcatataggaagtctctgtaccttctgttccgtttttctgtgaacccagagctaatctgaaaattaatgtctatttttaaaaaactctttgagctggatattggagggaagaagaaaaataaaacgatttgtatggaaaccctgggctctggaccctagattatacatatctgaaaacaaaagagaactttagcttgttaggctgaaatatctgcattcaaaatactccactgttttacctagtgacaatggatgaaaaaaattgatttacatatgtataactaaaacacatgttggggtggtatggtatgctatgctgttggaagttaggataacggtaatccttgcaggggtagtaactgaataaggggcttctgggatgaagataatattgtttctttgatcctggggctggtcacataggtgtattcagttttgagatgagccttacctccaaatctgtccttgaataaatttcttgttggttccccttggttgatcaaatcctatcatctgctttataataatacaacttaatgattaaaattttaaatgtacctaatccctaatcaaatataagaaaaatgaatagaacttaattgcattgcagctaagttccaatttcataagtgaaaaggaaattgttttcgtttattttagctttatattaaaaaatacacgaacaattgtttggagactgttatggaatttcctagtcatttccatgaactatttctggtgggttttgaaactaaatgtagttacagggcaattgtttttgctgtgtaattctttatgtctaataattggtagtcttcattcaagataaaatgtcttagatattataaattttcttctctgcccgaatatgctgctatagactaaagtgagtatctttaggaaaatacatttgtttcaaaagtacatcctgctattatgcacaagtattaattgttttgatgtgtgcctttttttgtttttgggacggagtctcgctctgtcgcccaggcgacctcggctcactgcaagctctgtctcccaggttctcctgcctcagcctccggagtagctgggactgcaggcgcctgccaccacgcccagctaattttttgtatttttagtggagacggggtttcaccgtgttagccatgatggtctcgatctcctccgcccgcctcggcctcccaaagtgctgggattacaggcgtgagccaccgcacccggccgatgtgtgccatttttatcatgactagaatcactcatgggatagatttgcacatttttacctcaggggttgttgaagaagtcaggccatgtagtactcatgaggccttgtagtactcatgttaatttatgtcatgttcattttgtttcactggtaggcaaggaagaaacctaggccttcagatttttggttttgctcaactatcagaaaagcctacatgaattatgtagacactgatttggttgcagttcatttataacttatgagcaaattatatttctagtaagaaaagtattctataatttgaagaatctcaatattttatatgcttcaaaattgacagtttaatttcagggatttgtactttaaatatgtatattagaaagaactttgaatagttcatggagaatctctgaagtctcagaaagaatctgttccatatcaaagaaataagtggcagctacagtttaaaattaaacttaaataagaccttttctatgcctgtctgaacgtttcatttctttagatcttgatgttaatagaatgtaaatattctccaacttcattatttcactgaaatttccaagtattcaacatgataaaattctttctttttaagtctttaaaatattttggtgacctttgctggtcttttcatttttaccaaggcagagtttattaggtttatgttttctatttccatatcaagttttattcatgttaaaaacttaaaattaatggattatgtaaagtgataagtgcatcaatgaatatataactggctggattttaaacatacataaataagtatgttttaagtccttcaatgaaggcacttaatctatttctccctcatttcccttctgtaaaatggggatataataatatacttaaaaccttagcagagtgcttgacacataagaagcgctccttgagcattaactatattattattttacagtgatattgaatatttgatgctgtatatggtacttttaaaaaattgattgtctaataagcagaaaataaggctgtggtaaatcaaataaaggataaatgatttagaggctaatttgaagtaaagtataaagtatgctcttttaaatttttatgtttttatgaaagttttgggtgcttatagcaacttttgaattcctttcagcagtgtgttctttcttacacaatttcagagttttgaatctcttccttgggaaactttttacagaaaggaagataatcatcaaaaatttgtgattttaaatatcctcttaaaaccaaagttcccctttttaatggtttactgttacaacctattctctataaagagagaaaagatatagtccacatttatactagcttcttttaaaatattttagaagaaacagaagaatgattagtagaggttttcattttccattgataaaaaatcgagaatgagtctttctacctgtagtttttcctataattgttttttcaaatgcagtctactatgtgaattaactactcagaatccattctcaatccctttctcctttgtcttttattacttttcagaatgggaagcttaaatttttgatttcacaggcttctttgcctctagggttacttggttactcatgcaacacaattctgctatgaggaggtgtttccttccagaataaaaaggcctcaaaacaccaggagaaaatcctatgccttttctccttcctctgaattaaaatcttacaagcctactccagtctcatcttaagccctcctgttcttctctcactggctggtgtgctccactttttgcttaaaaacgtaccctgtgcccagaatactctcctcagcaatcctccccttctgctatcaacttcctcataatctagcccctctttccccaactcatccaactagatcaggcttcctctctcatgtattattcctgtgtagtccttatcacatttttatgtatatatgaaatatctggatacaagccacaagcagcagggacatctatcttctttatccctgtaccttaaggagcaagcatttaatgagccagttatcatggggcaagcactgttctaagcactttacatgctgtcactcatgctctgttcattacaatatcttattttataggtgaggcaactgaggtagtgaaaggtgaagtcgtgcatgggtagcagagctggatcaaatgtaaatagcttgccccagagtctttgcacttaaccataactgccaggaactatgtctctagagaggtgctggagtgaagagtttgaggcattttatttgaaaaacaacactaggccaggcactgtggctcacgcttgtaattccagcactttaggaggccaaggtgggcggatcacgaagtcaggagatgagaccatcctggccaacatggtgaaaccctgtctctactaaaaatgcaaaaattagctgggcgtgatggcttgtgcctgtattcccagctactcaggaggctgaggcaggagaattgcttgcacccgggaggcagaggttgcagtgagctgaggttgtgccacagcactcaagcctggcaacagagcgagactctgtctcaaaaaaaaacaaaaacacaacactaatagccactctgttgtgtaatgttctaaatgacatttagaaacctttgtgcattattgtgtattcttcaatagctcttatgtctaaccatccattgcttgcacaacttccttttgccacatttctttgttgtgttatatgtgaaagcagttgttctctagtattaaagtgcatgagcaacatggcagatacctttagaaagtgtacattctcagtgcttcctctaccagtattctgattccacagatattctaaggtaggggccaatcatcttaaaaaaaaaaaaaaagaaaagagaaagaatcccaatggactcacagagtgggtttgctgaaaatgaatattcccttaatgaatatgataaaaatgaaacagattttgttttaaaaaattgcaattataaagttaggatagttacatcattttttaaaatatagcatttttaaagtgtcccagaggctagaattattttttaatattagatttcctgtggatgatacaactacaagcagcactgtaaatataaaagatcaaagtgggctaagcaacatttctaggagatgattttcgactcacaaagcaacttcctggactttttaaacacatttaagcacagtaaacaatgctatctcaaaatgaggcaaattcaactttttctattccagtaaccatattaagtcagtattttttttccattttctaattactgcacttattttatcagtgtgttgttaattatatttaatcctatgaaagagcaaaattaaacaaaactaattgttccttgctatttacttatatatttatatacatctgtatatatgtttatgtgcaggtttatttttatcatattcattaagggaatattcattttcaacaaacccactctgtgagtccattgggattctttctcttttctttcttttttttaagatgactggcccctaccttagaatatctgtggaatcagaatactggtagaggaagcactgagaatgtacactttctaaaggtatctgccatgttgctcatgcactttaatactagagaacaactgctttcacatataacacagcaaagaaatatggcaaaaggaagttgtgcaagcaatggatagttagacataagagttattgaagaatacagaataatgcacaaaggtttctaaatgtcatttagaacattacacaacagagtggctattagtgttgttgttttttttttttttctgagacagagtctcactttgttgccaggcttgagtgccgtggcgcaatctcagctcactgcaacctctgcctcctgggtgcaagcaattctcctgcctcagtgtatacatatgtatgtatgtatgtacatatgtgtgtatgatgtaggtgttggggaaaagctgagtgttgggaaaaaagctgagtcagggcttgcatgtctgacataatgtaaaagagtcttggaacatgtctgggggccaggatttaaaaccccttgtagcctttggaacagcaagctctgtgccaaagggtagaaggctgccctgctgcaccataatctaagtccagggcataaaatccctcttggcttggatggaatccagggctcaggggataaaaccccttgtggcctctggaatgcatctagacttgctggctccttgcttcaagcactcccaggatcatagatcgattgcatcttaaactagaagaacatgttttccattatttcaagtagcagaacatgttccatatgcttcaaaagaaatgctaaaccattacagctgtcgatcatgtgcttgatatactgctttctttcaacccccacatcttcaccacctgcttctttgtttgatcaccaataagtagtgctggcttccagagctcagggcctttgcagtctccatactagcatcggccccctggtcccactttatgcactcttaacttgtcttgtctcattcctttgactctgccagatttcgtagcccccactgcctggtgttgggtctggtcactccaacatataggtagccttggtccatggtggtgctaggtctctggttggtgtttcaccatgtgtttgtgtaatattacataccaccacttttatcttaaatatatgtttggtgtgcatacagtttacctaagtatgaaaataaatgttggaaaatctttgtagaatatgcctccatagactttaaaaggaagtattcacagttgttagtaaacatatcctttggttcttaatgatattatagattgctttctcactgaatagaatttttgtttcagattggataaaaactgaaaagataaatatattctaataatgattaagatacaactattttaattaacattcacatttaatttgataatcagattgtattaaagtatttgtatttttctaatatgaatggaatgctaggtgtgtactcaccagacttctctattatacctcgattatactcaaacttaaatagattgatcaatatttaatgggcttcagcatgtgaaagtgggatattttgatttgtttcttttgattttaaaacactggattttgaagacttaatgccaaagtaggcttcaggttctactgctactttaatgtaaaaatttccttcatcactcattttgtcttttgtttaaaagtttgttttaaaaagcacagcattttaatgataatgttattgtttttccctgaaagataatttaattaaaatattcaaatattctttttgtcaaaaatgtgttacttatgttcaattatcagtgaatccagataataattcctgaattaccccaccttataattatccagaagaacctggtttctatagaagtatatataccatctttcctcctcaaagactgtgctgatgttctgctaacagaatgtttatgatacttatgtattattgtgagttatgtttccaggatttctaaaatatatttctatcttttccttagcagctattttcacctataatatacagtattgataaaccttattaaaaaccttctccaggccagatactaggctaggtgccaaggtttagttgtgaacaaatggtctatcaaccttatatagttgtggggaaaggtgaggggtgagggggaggggaaaggtttggaaagatagacatcattcattacaaggttaaatatggaactcagatctgaagtatgagtagcagacaacaatttgtaggaggtgggaggggtagcttaagacttctctaagtaaaaggattagcctatgcaagaactgaaagaattcatggaaagtgaacacagaatatccaaggaactaaaagaaggccagtgtggaaaaaacgaaaggcaatagggaaagttatgagagatgaagctagagtggttgccttaggccacgccatgtagttgcaaatatattatgtttaggattttgtgtgttatcccaagagtaaatgaaagccagtaaatgttagttgacagtacaattaaaatctttgcagtatctaataggaatataatatgacatatttagccatataccaatactaagtaaggaggcatcatttgaagtttgaagataatacttaggccaaatttgtcaataactgattttttttcattgcattcagtaataattttttctcttttcaagaagcttattatttagttgggaaagcaatacagaaataatttacttactaatagttaacaaaatataataaatattatagtgtcaaaaaattatgacagattatgagttgctgagatctctaaagagatcagattgtattaaagtatttgtatttgacaaatactttgcatttgacaaatgtttgtaaatgaaggacaaaaaaatacgattcaatattccaagaggttgtaataacctgtaatgtagataggttcaagaatgtataagacatatttcttgaattatgtaattagggcaccaataataggtcatgatggtaatttgggcttagatggacatcaatctgaaatctgagaattttcaggttaatttctgtacaggagctaatatatttgcccaaaaaattaactttagtgtgactgtatgatcagatctgttgagctgtgtaggaaacatctgccagttcacagaaggtgtttattttcatgatgaaataggaaaataaaaaattctatagtgagttcttaatcccttctgtacaccatgactatggttcctctaattttaatcaaatatggccttagatttttatgcatagactcaagtttagtttacaatactaaataaacattttgttaatgtgaaagcgttcaacaatatatgcatttaaaaaaataaacagtaagcagtgtttaaaaatagtaaacaaaaaagtaaattaaattgttgtattttgtatgtaacactagcaagtatgttttttaagtgagaaccatcaaggcagttcattattttaaaacaagtgaaatggttgctttcaaacacacttagaggattataatcactaaaacttttatggacagcaatttgataacgtatacataaaacatccatcctgtttgatgcaatagttacattctgacagtcttccacaagaaacattgaaacattttgataaggatttattgagaaaaatgcattttgaattatttttgcttcctatataagatgtaacagcaactaaatatctaaaaatacaaagttggttaagagaataatggctcatacatttgatgagctattatttaatacacaaaaagggtgcatacaaaaactttaatggaataagaaaagtttcatgatattatcttagtgggaaaaagtgggaaattaaattgtatctgtggtgtgcatgatgtattagttttccattgtcactgcaataaattagtataaacttagtttaaaacagcacaaatttattatcttacagttctggaagtcagtaaaatcagtctcagcgggctaaaattgaagtgttgtcagggctagtttcttctggagactctacaggagaattagattttttgcctttaagtttttagaagctgccttcattctttggcttatagtccctgtcatattgccttttctccctctgtttccactgtcacataggcttctctgtcactgacccgttggtatccactttataggagccttatgattacattgggcccaatcagataatccaggatttatcttcccgtcttgaaatcctttacttaacacatctgaaagtcacttgtgtcatgtaaggtaacattatttataggttcctggaattaggatgtgaacatcattttggggacattattttttctaccacacatggaataactatatttgttatttaaacaaggacactgttgaaaattaaagagggcgttattaataattatttcaggataacagaggtaaagaggagctcttcttagaaaatccagatagtaacctaagtacacggctagagtgataagaaatgacaagctctctgagtttaaacagatttcctttctttgaaagtgtcatgtttttgttatcttgaaaaactagttttttcctttttctttgtagttctggaatgtcaccattatgtgcctagtcgtggatcttttaactcactatactcaaggaagctcattatactcaaggattcttggattctcagactcaagagaaacactaagaaatttctattattactctgactttttcacctcaaatattttttctctttcctctttctgaaacttcatatatgtgtgtgtctgtatgcatgcatatatatacatatatacacacacatattcatatacatattgacccttctaagtgggttctcaatttctcttaaatttttgttgtattttctatctctttttgagattctgagatttagtacactttatgttcctatttactactatactcagcttaacttgcctgctttatggatctgtggactttgattttgaaacatctcacatgtttgcccagcatttcttctgctctggtttctctttcaatattttcccttgcacatttcagcttcataaaagttattagaatttctggttctctgatggtatctttttctgttcttagtgctgatatagattaattcatttttaaacatttctgcaataatttaaatgaaatttgaggagcacatgttatgtttatattagctttccaactgaagctaaattgtggctgcatattatttcactgtacaaaaaggttataattagcttacccaggtacttaatataagttgtttctactttaatagctattatgatattaagtattccatgctggataaacacacacacacatacacacacaaacacacgtgcacataaattagggaacatatctgtgattatttccctattaagggacaaggatatgttgaattgaggttttccttttccacaagaaagattgcaaatttcaaatttctactaattggtctgagattgttcagatggtagagtttcattatctgatagtcatgttctataaagtgaaggaatactgaaccattgcttctaggagaaatgaaggctcaaattcctgaagatctctggtcacatttcatcaaccaataaatacataaccttgttttatgtgtgtttatttttaaagatgccttatttcatattttttaaattaattaacattgaattcatggccaacatcactatcactcatgcctgaatgaagcctatctaacaaacatattttctctgtgaggtacatcacaatcttctcgagcttaggaacactagctagacttcctcactatgcttgggagctgaaatcaagccacttaaaatagagaaatcaccagcagaaagcaaaatgatgcaaaacacctggcactagaaagaccatgaaaaggacacttatttacaatgtgagagttgaaccatgaaggcagagaaggccttattggaccttagttagaaacatgtgggttgggcgtgaaagcactgtgagcattgatttggagattacaaaatattttagtgagtgggcaattcataaatgtaaaatcacaaataatgagaatagattgtgtttcctttctacatattccataacatctattaacaactttggaatacaaaaattaatccccccaaaattcgagtttttcttttttttgaactagactgctttatttcagggagctctcaagcttcttgttactttgttaactaatcattgaattttccctcttggtcaatcatacaaaatttagaattaatacaatactatcattccccccttttcaataaacttactgtgtaatcttcagcttggcatatattaactgggagcaaaattttgacactgcgaaagaaaagattcagtgatatcattagttatcccacctatatgcttagtcttataaaacctaggactgcatgtatcatgttgaaaagatacttcaacctttgcctaacaccagtgtcccaatcagggatctactttcatttttcatttactggaccattactaatgtccaattgacaagtttattaagctttgccctcacccactttgatctacaaacctgctcagttcagaggagagaatacaagacccactgctattcgttttacagaaattcaaatgttctttatttataaatataaaagagggtttgattcagtttccagaagaagagaagacttgaagagttacactgaggactacctgatggctctgtaggtggagaaggaaggccagtacaaaggaaagtgcaggagttcagattagaagagacacatccatggcttaagagagtagcaattctaaaacattctaaatattctaaaatattatagaatggaaatctggatacaatggtgactctacaaatggagcaccataaaccagttgtagaatgcatttctatgaagtccagaaatgtattgatactcacttcaagatctcttgcctgttagaatgaggatggtgattgaggaggtaatggagaaaaggttaaatcatctctccaagtcatattcttctttttgagcatctaatttagatttcttatagaaaaagtgttttaaaagaataaaacatagacatgaatctggataaataatattgtttgtatcagtcacggactggaaccatgagaacatatgacatgaactacatgttggtgttaaataaaataattaatgcaatgtaatataaaatagatcactaggaaattcaggaggggaaatttttgaagcagttccatagaaacagagctactctgggagtcaggagttctgggagatgcaaaatccaaagcgggttcttgcacccactctgggatattttggccagtcaggttcttggtgctttgggttcctcaattgtaagatgacagaggtaaactaagtgatctctaaaacagtcccaatatctactattcaacaagtcacagtaatagacagagaagtaggaaaattgtgttttaagttcctgtcttagatgctgtaaagaagaaagtgatacttctacaaagtcaaagagattgacgttggagagatcctcttctgatttagcaaggacatagttattgaccacattagatatcatctgattataattaagttatggaacatttaagtggggaagataaagagagaaataaacatatttatattccaaatatagcaataactaaaaaaatcggcaagtcatatctcacatacatagacatgagaagaaatgtggtcactggacattgccctttttctatttttacaaatgctttctttagttttttccagagggtggtgaggtacatagggtagagtacatagttaattttatataattataaacgagtgtatttgaataaaaattctactatttatttatttatttatttatttatttttgagacaaagtctcattctgttgcccaggctggagtgcatgatctcggctcactgcaacctccgcctcctgagttcgagcaattctcctgcctcagcctcttgaatagctgggattacaggcatgtgccaccacgcccagctaatttttgtatttttagtagaaacggtttcaccatgttggccaggctggtctcaaactcctgacctcaggtgatccacccacctcagccttgcaaagtgttgggattacaggcatgagctatcatgcctggccaaaattctattttttaaaaagtatatcttacctatgtttagataatttttctgatgagttagtactcatatgggtgcttttttttttttgaaatacatagactattggtcttagacataacaggacacacactaaattctattaaaacaattcagggactcacccatgcatacagcaattatgattgtgaacatccaagacaaattagtatggaatgtcttaattaaagctgggtaaagtaatttttttacagatagattgaattttattaaatatttagagtggtatattttcatttcactcttatgtaattaatatttagcacagttctttgggtatcaggttgcattatttatgcacattttttgagaaatataatagtgtttttttgttttgttttgttttgttttgtttgttttgcgatggagtcttgctctgtcacccagagtacaatggctggagtgcaatggtgcaatcttggctcactgcaacctccacctcccgggttcaagcgattctcctgcctgaacctcctgagtagctgggattacaggtgtgtgccaccacgcccagctaattttttgtatttttagtaaagacggggtttcactgtgttagccaggagggtctcggtctcctgacctcttgatctgcctgcctcggcctccctaagtgctgggattacaggcatgagccactgcgcccggcctgagaaatataatagtatttctaagaagtctctggaaaatagaccataattttttttattatattcaaaatgcaaattttgccttttgctaaccagataaaaatacttatgattttcgtatttgcttagttacaggtattaactgagcaaaattgttaaaatgtgtttgattttgtttggatagggatttgttttcatgttttcaaactaaagttgagaatcttttccagtggcattcttaactcatagatatgatgtgaaaattgtagttgccttaatcctgctcttgttgtctttaggaaaactgtgactcatatcagtagcttattaccaaagttacatggctattagagtttgagccttgggatagaagagtaaacattctgcttttgtcatgagatactgtttttttggctatagtattccctctaaggcagcctctaagaaaagcatcatttatcttagtttagctatgagaagtctacagaaatcctttcctcattttaaaaaaatgagttttcagaaatatccacaaatattcaatgaatagttaagcacaaaactgtgtaatgtttagtaacactcaacagatgttttgctaagccttttttaaaaattataaatcaataaatacataaagaaaaaacaccttgaaaatctttatatcctttaatggtaaaataggacagtatgaattctcatctagtcctatggttttcacattgggagtaaaagcgcttggatttaatgagaagtgttctgttggaatgaaagaaaactgaatttcttaactctaggcagtagcttattagcacagtattgttctctggtaaatacctttgcttccattttctcacctgcttccactcgtaaattctcacctcctgcaatagaaactttgcctcttagtgactttgtggttgaaactagagaaaagctgtttactcagcaacatctagtattttgctgcttcttcctgggtgattagatttagaaatcatgaaaatggaggcttttttcttctactttttgtttggcaagcatgttctaattctttttttttttttgagacaagagtttcgctctgtcacgcaggctggaatgcagtggcacgacctcacctcactgcaaactctgcctccggggttcacgcccttctgcctcagcctcccaagtagctgagactacaggtgcctgccaccatgcccagctaattttttttgtatttttagtagagatgggatttcaccatgttagccaggatggtctcgatctcctgaccttgtgatctgcctggctcagcctcccaaagtgctgggattacaggcgtgagccaccgcgccaggccaagcatgttctaattcttaaaattgatctgccaatgactgtggaaaaggtaatcacttatttcatacagcaataatttattattaatattttttaaaaatactaaaaattaacctcatatcacaaacttttttttctcataaactgttgtgtcactagtataatctagaatttaggaggggagttattttttaaagaaatcacttatttgtgattttttttttcctaaaaggatgatttaaaaattatcttttgacttttcaaaatcaaactttttctccttgagtttaaatatttattatgtttcaaatgtcttaggaaaaataaaagataattttttcatgtactgatagtatatacattaattttccagagctctgtctaactagtgctgattgatcaccagagcactaatttcttcacattatgcatgcaaatataaaactgctctcttgtctgtgttatttctggcttttaaatgtgtttacaatattttagaaagttgcttagtttttgaatttctcaaatgccgcatatatcagtaagcaaaataaaggccattaaaaaattacagcagaattaaaatttcaaggcagaagtatgtcactctcacacgataagccaaaagaggtcagacttgtctttctaattatttccagagacctgccctacaaatcaggaaccatcacatggatacataaaagtgtctttaattgtgaaagcaactatgcaaattattcattgctatcatccctgatcaattcccagattattttcaaactgagagacccaaaatgacataattttaagggagttacatggaatagtcactttgataattgtgtactcattttaacatactagaaaaatatgatatattaaaacaaagctttgactgatattgtttaggataaagctaaataaaatttataaataagtcgatttaaataaaacattaaggagaaaattggaccctattgtaggagcttgactatggcagccattctaagggtagcatgtgattgaggttcagtaaagtgaggtccaaagcagcccttttggctctgtaggtattatttgattgaaaggagtcaagatttctctaagaactctcagagtaaggagccttgttttggggaagatgtccatgagtggcatacatagcagaactgtgagcaagatggcacttcagagccactgctgtcaccatctctctccttgaatcttggtctttttctccctctggtgcttctgctgtctcccatctcctccataagatttcttcctctaccctccttccaacttcaactattgctctaaataacttaatgactatggtgtttccctatgtatgttcccaaaagttatttcccagaccttgctctctaaatttagatggtcttgagttaagcaccgcacctttggtataatcagttatggccagggtgctgcagggatgccagatctacttagagctgtgagcagggcacgttcattcagacagtctgtgagctgaagaagacagtttgatgtcatctccaggatatcattaatgtcacccaggaggaaattgaggcctaggaatgattatacagcaaatgaatacacattcaagactagagtccattgggttcattgctaatcaaatattatccccatttatctgaaaatatttattatgcatcatcagcacatgagatattatgaagtaactaaaagtgatttagccatagagtctttcccctttagaaaactaatataggaaatagatcccagcaatgtcgagaattattatggactgtggaaatgaataggtttagactactataaagttgtgaaacaatgaaggttcatttcctgaatctactgaatttctttgattttttttttttcatttccttttctgtctttcctttccaggggcctagtactatcatgacatgtcttgttctagaattctcttcttttcctcactcagtccctatcaagctagatatatttgctccccaaagaaaaaaatgtttctttcagctcttttttcttcttttcctttcctttccttcctcccttctttcctttctttcttccctatttctatccttcctttctctttctttccaacattgccaactgacaaacaacccttctcaggtaagattttttaaaaggaagaacctctggaactatatttatttttttgtgcgtcactgattacttttttgttccattgtttacatttcccgtcatcttactgactgcctactgctgttcttcaagagctctatatttgtacctctttgcttttctattttattgagtctattgtcatgtcatatatttttgcatcccttcttcttatattatcagtttctaatcatatttccaactgcttttataatatttatatgggtatcacattattgcctcatcttaatgctttgaaaattaaagcatcacattggccctgctctgcaatagggatattcctatcctaggaattagttctaaataactaattttcatcaatgatcagtttttttttgtttgtttgttttattttgtttgtttttttttttttttttgagacggagtcttgcactgttgcttaggctggagtgcagtggcacgatcttggctcactgcaagctccgcctcctgggttcacccattgtcctgcctcagccaatgatcaggtctttaacttgatctttagtcttctctttcttgaatttcaggatgttaccactttttgcctttattaataatgtgcgtgtggatattcaaaaatttttaaatctattttcctctatattcaaacccttcctttccttcaagaacccaaaacctaccacactcataaaattatcagactgccacagcatttggtaacctctataactgtatttttctgacaccacatgaattagcaatcattaggttaaagagatattttaagaataggaattaatatttctagaaataaaacatctaaaaaatggtttataaaaagtcacttttttaggctaatcaaacataatatagtcattataatgttactataggcagagaaacttacagggctgatgtacagtattaatttttaggttcattttaacatgcagttattgggtccagatattataatagagtggaaagattcaactgtctattaataaaagactagaagcaatcatggcacctccatacagtaggctgttttatagttttgaagaagcttggcatatgtcctgcaagaccattgagtcaagggaaaaagcacattgcagaagaggatacacaatctaatatatgcatacaacaaatgttcatacaaatatgtacacacattttatatttgtacagggtcagtgttgaaaatggtgcaacaaattgtccacactggcttctactaaggtaatgtaatagttactttatacattttattatattttgaaatttcccaataagcctaaattaatattataataaaacaaatgtattacaaacaacaaaaaaaaataaagaacattggaaaaataaatgctatcactttaacggacatactcattccatttctagttgtttaataattgtgaaagtgaaaaaagtctcatgttacagtacattcattctatatgaaatattaacaactttaatacttaatagttgcaagtgtcatttataaataaagttatatttttaaattatttcattattttggtgctgtttataaggcttcaaaagatactcatattacttgagaaatatatgttgtcttttcttctaggtgttataaactttaaacaaatttaatttgctgtgtattttagttgaatatggagaccgacctgctgaagtaaaaataatagtaaaagtaactctatatcattcaaaaatggcatgctgttataattttatagtttcatttataattttacagtttgtaatttcatccagttctctacgacaacatacttgattcttttgggattagactttggagcaataagatgtgattttttttcttaaagtcattgtaatctaaaattgtccaggtctcacaaatcttgctgctctttttttttttcattattttttattattatacttttaagttttagggtacatgtgcacaatgtgcaggttaggtacatatgtatacctgtgacatgctggtgcgctgcacccactaactcgtcatctagcattaggtatatctcccaatgctatccctccccctttcccccaccccacaacagtccccagagtgtgatgttcccctttctgtgtccatgtgttctcattgttcaattcccacctatgagtgagaatatgcagtgtttggttttttgtccttgcgatagtttactgagaatgatgatttccaatttcatccatgtccctacaaaggacgtgaactcatcattttttatggctgcatagtattccatggtgtatatgtgccacattttcttaatccagtctatcattgttggacatttgggttggttccaagtctttgctattgtgaatagtgccgcgataaacatacgtgtgcatgtgtctttatagcagcatgatttataatcctttgggtatatacccagtaatgggatggctgagtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaagtggtgtgagatgatatctcactgtggttttgatttgcatttctctgatggccagtgatggtgagcatgttttcatgcgtattttggctgcataaatgtcttcttttgagaagtgtctgttcatgtccttcgcccactttttgatgggcttgtttgctttttccttgtaaatttgtttgagttcattgtagattctggatattagccctttgtcagatgagtaggttgtgaaaattttctcccattttgtgggttgcctgttcactctgatggtagtttcttttgctgtgcagaagctctttagtttaattagataccatttgtcaattttggcttttgttgccgttgcttttggtgttttagacatgaagtccttgcccatgcctatgtcctgaatggtaatgcctaggttttcttctagggattttatggttttagggctaacatttaagtctttaatccatcttgaattgatttttgtataaggtgtaaggaagggatccagtttcagctttctacatatggccagccagttttcccagcactatttattaaatagggaatcctttccccaatacttgtttttctcaggtttgtcaaagatcagatagttgtagatttgtggcgttatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggtgatgcgggctcttttttggttccatatgaactttaaagtagttttttccaattctgtgaagaaagtcattggtagcttgatggggatggcattgaatctataaattaccttgggtagtatggccaatttcatgatattgattcttcctacccatgagcatggaatgttcttccatttgtttgtatcctcttttatttcactgagcagtggtttgtagttctccttgaagaggtccttcacgtcccttgtaagttggattcctaggtattttattctctttgaagcaattgtgaatgggagttcactcatgatttggctctctgtctgttattggtgtataagaatgcttgtgatttttgtacattgattttgtatcctgagactttgctaaagttgcttatcagcttaacgagattttgggatgagacaatggggttttctagatatacaatcatgttgtctgcaaacagggacaatttgacttcctcttttcctaattgaataccctttatttccttctcctgcctaattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgagatatgtcccattaatacctaatttgttgagagtttttagcatgaagggttgttgaattttgtcaaaggccttttctgcatctattgagataatcatgtggtttttgtctttgattctgcttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctgttgattattgccacatttcagctcctgttattggtctattcagagattcaacttcttcctggtttagtcttgggagagtgtatgtgtcgaggaaaggaacaaccggtaccagccgctgtaaaatcatgccaaaatgtagagaccatcgagactaggaagaaactgcatcaactaatgagcaaaataaccagctaacatcataatgacaggttcaaattcacacataacaatattaactttaaatgtaaatggactaaatgctccaattaaaagacacagactggtaaattggataaagagtcaagacccatcagtgtgttgtatttgggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgatctacaaagagaattagactcccacacattaataatgggagcctttgacaccccactgtcaacgttagacagatcaacgagacaaaaggtcaacaaggatacccaggaattgaactcagctctgcaccaagcggacctaatagacatctatagaagtctccaccccaaatcaacagaatatacatttttttcagaaccacaccacaccgattccaaaattgaccacatagttggaagtaaagctctcctcagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggtacataacgaaatgaaggcagaaataaagatgttctttgaaaccaaggagaacaaagacacaacataccagaatctctgggacacattcaaagcagtgtgtagagggaaatttatagcactaaatgcccacaagagaaagcaggaaagatgcaaaattgacaccctaacatcacaattaaaagaactagaaaagcaagagcaaacacattcaaaagccagcagacggcaagaaataactaaaatcagagcagaactgaaggaaatagagacacaaaaaacccttcaaaaaattaacgaatccaggagctggttttttgaaaggatcaacaaaatagatagaccactagcaagactaataaggaaaaaaagagagaagaatcaaatagacacaataaaaaatgataaaggggatatcaccaccgatcccacagaaatacaaactaccatcagagaatactacaaacacctctacacaaataaactagaaaatctagaagaaatggataaaatcttgctgctcttaaccactatcggtacaccttcagaatggccatgttttatgccggaaactgccttgtttactctgcaactcccttggtatttcactttcacccattatcagttctttcatgtttttctgtcctaccctcctactgcagaaagctcacttcctggcagtgcccagtcactgttcctagagcagccctagggattgctgttttctgctatctgtggaagcccaaggacagaaaggttgtacgcaggcagcacttcctttcagctttaccttaccagagacttgctgtttggaacacagaaatgggtgaggacactctactcttaccgttttgcccccatctcatcctggcaatgcttgtgttgtggttcctttacctataacttcctcctgtcaagacttgtaggaggtttaggagaggctgttctggggaatgtgcagtttgtgtctgttgctgcttccttttcttggttcctggttcccacctctcaggcatgcaccagacatcctccttagacttccttaacgaaggacaccttctctgcatgcaaatcagctcttaaaaatggatacctgggggtgaatcaatgtctaacctaattctaaatataaatttaagcttagcctgcaattctgtgacatgaaacagatttataagtttgcttaacattatctatacactatggtcatgtaaaattgctttgactggaaacctgagaaaaacatttttacttacaatttctttttaaaaatttgctttctttcagagtttgaattggtatttccaagaaccagataataattacaaatttctattcttttgcagttttgctcctttcccataattctggtactccagaaagtagaactaaccaaataaatgtgcaatttgatttaaaattgtaccactggtcctgacagtaagaacaattgtaattttgccttaacgtccttttttcacacttaccagatgccttgaaactgtaaatacattttaaaaacgtggagaaactttttttcccacttcctacttattttgttctaactgtatttcacaattccctgttgctccggtgatttatgtgtttgccattttgtctgtgatgaaaatatttgtaaagttaccttcagtaaaaagactatatccattaacttaagaatggcatgatactttaaatttttaaaatgaatttgataagggaattattttagaaaaataaagactttaagtttgatgttttggtttatttttcaataagatgacaaacgaagggtaaagtacatggaagactagatgagagggctatcacaggaagcacccatagactttagatacatatgcaaagggatttaataatctattcaccaatttggtgagggagggattcttgttttaggattatggggatagactaatacacaatattcacactagattgtacagatgaaattgatagcagattatcacatatacacactcctagcacagggaaagaggatacagcacaccaccgtgggccacatgaagttgcactcaaaagcagaaggaacaagtagaggctgtgggagagaggcttcatagtgtcaagagagcagggtgacacctgattcccatgggaggatgtggttggcttatttgaaaaattccaccactggcagaaaattgaaacctgctactcaggtatcagcaagaactccacctagtccctttgataaggagccttgtttggctgggggaccttatccacaggagcataatggagaagggagcttgtgcgtaagccatttgagtccttattggtttcaccagagggccttagttttggcattacaactcaaaatgactcctgtgttgtctttacttacgaggaacaaataccttctctagtagttaaaaaaaaaaaaaagatgttttattacaaaggcaaaaacaagggctcttatggatgtccaaggccctgcactatgggaagagttcaagaccctaaacctgtattctatgttctccaagagcagtcctctttctctcattcgtggatgatatgctcgaatatgtgtagagcatccttgcaagtagggagctacttacactttctcttcctaataattgtcaacaaaaagagtcaaactctgtaaaatattttaagagatttattctgaaccaaatatgaatgaccatggcccatgacacagcccttaggaggtcctgagaacatgtgctcaaggtggtcagggtgcagcttggttttatatatttttagggaggcatgagacatcagtcaaatacacttaagaaatacattggtttggttcagaaaggcaggacaactccaagttgggggtcttccaggctataggtaaatttagacattttctggtttacaattggctgagtttatctgaagaactaggatcaatggaaaggaatgtttaggttaagataaaggattgtggagaccaagttttatggtgcagaggaatctctcagatagctgacttcagagagagagagcaggttataaaatgtttcttatcagacctaaaagggtacctggctcttatttgattgtctcctggacctggaaagaaaggaaggaaaacaaaggggaaagaggattctctataggatgtggatttttcccacaggatactttgcagggcaatttcaaggtatggcaaggaaatatattttggggttaaatattttttccttgtcttgtaatgttatgccagagtcagactgaaaagtaagtcacaatatatagggtcaaataaaatccatctaatgcgaatttatggttgtcaggcatgactccctagaccacttaggtaggaatttgggtaagataaaaaatcagaacttagtcctcataatcttgtatgtttctcttgagagtcttgactttccagctacagtgcttgctaacaactctttctatgctttccagttccaattccaaagagatctgatgatctcttttgccattgttgcagagggattaacacatggccaggttatgaatgagctgcttctgagacaggcatccattcttattatactcagtggtagctaaaatagatgtggagacacataacaaaacatggctaaataaagaagcagaaattgagggcatgggtttcctcatcaaggaaagatgtgggaagcaagaccttctgaaatatgcatagcaaaataccccagagcctcaaaccagttctgcactgcatttttttctttcataaaataaaactttaattttttaactaccaagtcaaactagtgaatcagccttggcttttccctctttcttctttccactccccatctgtatttttgacaaactaaagatgtgaagttttctttcttaatatttctctcttcctttgaaatataaagacattacccagatccaggctcctttcccttcagcgtgaatctgttacagctgtcctctggcacctttagggatcctgtacctccagaatctctctttgtcagtccctgctgtacccagcccaaccaatcctaatgaaacaccagtttcaaataggcttatgtatctccctattcttccagaattgtcctcaaggcaataccttgaattgactcctatctttctatgtatctgccctatttcctgacaaaaggaggctaactttagggaattttacacctgcatagacaactggaattgcaggttaggatgagattaagatcaagattgttatatgttttgctgcatttgttgttttccaaaccagatcataaccccctggaggataggaattaagtcaggttctttttaccctagaacccattcaatcatatacactttgatgttgatttctttatactttgaaagcatttataggaagttatttgtgtaagagttaaagaagaaagaaacacaaaaagtggctcaacagtcaaagacaggtttattttggagaataaacctgagaggggcatctggccaattttggtcaggagcattctctcttacagactaagggtatttaagcgtttaggaagggagagcttatcacaagctcagaatgtttctgtgcacaggagagttttattgtggggtcggcatgtctctggacagagggtaggttatctcagggctggcatgtttctggttggagtggaggttatctcagggctggcatgtttctggttggatggagatttatctcagagctggaatgtttctggtcggaggtgtcacttgtagtttatggtcatgctgacattagtcattaggctaatggtttggggctggatttacgcggtttttaatcaaggggaacttaaaattgctgtgtttgtcctagatggtgatgatcctgctctgtcaatttgtattggttatttgattcaactgcttagaaaaaaataagtatggctattttgtcttatctgatgggattacatagtataaaaacagactggcttaagtatggcatctcaacatctcacagccacaaactggatattgcgtcctaataatgaattcacgttgatgatcttttcagtggtattgcaaaagaactcccttattgattaaacacagctcttgatttttctaagcatataagtaaaactcaaagaattaaaacaataaagttttcctgggagaggaaaatcaggaaatctgacataaaatgccagtttgccttaaattagtaattacttgtgtaaagtgtgcattaaaagatacatagcctgggcacagtgcctcacacctgtaattccagcactttgggaggttaagccgggcagatcacttgaggtcagaagttcaagagcagcctggccaacatggcaagaacccatctctacaaaaaatagaaaaattagctgagcatggtggcatgctcctttagtcccagcttctcaagaggctgaggcaggagaatggcttgaacacaggatgcagaggttgcagtgagccgagatcgcatcactgcattccagcctggatgatagagtgagactccatctccaaaaaaaaaaaagatacataaataccacttaactatgtgatttgttgaaattatgttctatgtatttacttttatcacattgaaatacattctgttcttatatattttttttcaagttaagggtgaatgccaaacatgcataaacctcacctatagagtctattgcctttcagccttgttatgccttaatactgattctgtatgcatatatacataatttggtagatatttagcaatgttacatttggaaaaactaggccagtgtactataatcagctttggaaaagttgttctcatttgcaatttttcttacaattgaacaaatgactgttaaatacttcatttttctaagtatatggattaaaatatagcttgtagaaatgtcagagtattctaacttgaaatgtaggaaagcgttttgtgtagttttgtaagttctttcttcaattttgtggattagtaagtacataaaaagaattcattctgactgtaggctgacaacattggattggcagctgaaaaaagttgtcagcattgcctgtcagattcaaacttagcagtgtacaaggtttataaaagcttgaagctatcctgtcaacactggcatttcattaaagattaattaacccgaatttgcttgctaataaagatcaaaatatcagtcatttctctcacaaaaaacgtgtgactaacttgtagcttatgccttgtgtatgtgcatattcatggttaagaaatgaagtactataggtcttttttaagtttatactaaaggcaatggtgtgcaaaggaaagtggaaggttttagttaaaattagatcagagcatacacatagctaaaactgacttcagtatttgctgcaaccaggaaaatagaggaaaatatctcttttctttgaagaccattccagaattgattttacacttcacttttctaatgttcacatattagaaaaaaagttaatcctatttaaaatgtgaaaatagatcacttcatatttccaactgactacaatataatacagtgaaaatgttgctaaagttctatataaactatatgtgttaaataagtaaatgaaattaccagaccctcatgacttttccgctcttatagcaataataaaaacatcatttaaagctgctgtgttacattaagtcattactgggcaacttatttaatgaaaaataagcttatccattatgtaacaaatgttttattggtaatgtattgtgttccctgaactctgcaatgtaatgaggataaatggtaagcaaaacagacacattatgtatcctcacggatttaacaatttattgggggaacaactatgggtttaagtcatactacaatgcaaaattgcagctctacatgtgctatgaaggagtggtttccaggaccataagagtctgtgataagggggtttacagaataaagcagatcaaggaagtcctctttaagaggttgccctggagtttagacctgaagaatttgtgaggaggtatcagttgaaagagtcagggaaagatctgcccagacagaagggctgaataaaagaccctttggcaagaaggagtgtaacaaacacagggactgttatgggttgcattatgtcacaccaaaaagatatgctgaagtcttaaccccaagtacctcagaatgtgactttatttggaaacaaggactttgcagattttacaaagttagaatgaggtcactggggtagaccccaatccaatatgacgcgtgttcttgtaagaaggagaaaggtgggcatggacatgcagaggaaagactatgtgaagagacacagagaataaggacatattcaagccagggaattcctgaggttaccagaagccaggaaagaggcctggaactgatccttccctagcaccttcagtgggagcatgactctgctaacaccttgagtttggccttctggcctccagaagtgtggcacaataaatttctgttgttatcagtcactcagtttgtaatactttgttacaacagccctaggaatgtaatacagggactgaaaacatatcagtgtagattgcaaaggaagaataagagcaacttgatctgaagagaggatagaacaataggcagggacaagacaataggtcctgaaggccatttttatgagtttcctttttattctaagagcaaaggatttaagaagtacaagaaaaagatgatagtagcttggacactagagtggtagtaatggttatagagagaaatcattggaaatagggaagtgaataaaaaattatgaataaaccacaaaaactcaggcttactcaaggacatcatttaagccattgtgtttgcttttgtcatcaatttttcaatctctattaaaaactggttttcgttaacagattgaggagtagttggcatgtaatataatgcatgtttaaaaagtgtgaaatttaataaattttgacatataattataaaggtatcataatcaagatagttaacatccaatcatctcatatccaataatccaataattaatgtctaaacccaaaattttcctagttcctctatgtgttactttatttatttatttattgagatggagtcttgctttgttgcctagcctagagtgcagtggtgcgatcttggctcacttcaacctctgcctccccggttcaagtgattctcctgcctcagcctcctgagcagctgggactataggtgcacaccaccatgcccagctaatttttgtatttttagtagagacggggtttcactatattggccaagctgatccaatctcctgactttgtgatccacccaccttggcctcccaaagtgctgggattacaggcatgagccaaagcgcccggctgttactttattttaatattcctttctctgaaatttatttttcttatattgtcatcccagttttttattattagcatgacgtattatttcccactattttaaaacttatttgtatctttgtattaaagggagttccctgcagacagcaaataattggattttactttcttgtttaatttgataatgtctgccatttaattggaatatttagttcacttacatttaatgtgactattggtatggttaggtattaatccaccttttttttttttttttttttttttttttttgagacagagtctcgctctgtcacccaggctggagtgtagtggtgccgtctcggctcactgcaacctccacctcctgggctcaagcgattctgcctcagcctcccaactagctgggacaacaggcgcgtgccaccacacctggctaagtttttgtatttttagcagaggtggggtttcactgttttagccagggtggtcttgatgtcctgacctcgtgatctgcccacctcggcctcccaaagtgctgggattacaggtgtgagccaccattcctggctaacccaccattttctacttgttttctatttgtttcctttgttctttgtaatttttcccttttttcctgctttctttaggattatttttattccattttatgtatattgttaccttattagtcataaccctttattttggtggttgtttcttgcttcaagtaatattaagttatgtacctcttcacatatagtatgaggaacttgtaagaaaatattactacttccaatttcttctcctggcctttctgttattattgtcatgcatattattgtatatatgttataaaagtcacagtacaagtcatttatcacttgaatgcatttaactattaaggaaaatatcttatgtatttacccaaaaaagttaattctacttgtgatcttcatttctttgagggaattttaatttttacatgattatcattttactaaattacttttttggacatttcttgtagtgtggggtttgctggtgaaaaattggttcattttctttgtctgaaagtacttattttagcattttttaaatgatattcttccaggttataaaattctagattggcgtcctattatttcttttagtatttaaaaatgttgctcaactgactgcttacttcattgttttctactagaaattggctgtcattttgatctttgtcttttgtaaaggcatatgtttttttgtctgacccctttcgagattttatcactgattctgagcaatttgaatataatgtatcttgacatagttttcttcatgtttcttgtggttgaagtttgatatgattctcggaactgagagtatatagttttcctcaaattgcaagattttggctactatttcttcataattttttgtccctttttatttctcctttcctttagagactcccattgacaaaaagattcaaactctgtaaaatatttgaagggatttattctgagccaaatataagtaaccatgacctgtgacatatccctcaggaggaactgaggacatgtgcctaaggtggtcagggtgcagcttggttttatacattttagggaggcatgagacatcaatcaaatacatttgagaaatacattggtttggtccagaaaggtggggcagtttgaacttggggggaggatttccaggctataggtggtaaatttaaacattttctagttgacaattggttgagtttgtctaaagaccttggatcaacagaaaggaaatgttcaggttaagataaagattgtggagaccaaggtattttgaattctcatagtggctgccattaaagacaatagatgacaaatgtttcctattcagacctttaaaaggtcctagactctcagttaatctcttcaggaatgggagggcctgggaaaacaaagatctagctatgttaatagagattctttacatatgcaaattttctcccacaaagtacagctttgcagggccatttcaaaatgtggcaaagaaacatgtttggattttcttctttgtcaggtaatgttacacataaaatatttggattttcttctttgtcatgtaatgttatgccagagtcagattggaaagtaagtcacgatatatagggttaaataaaacccatctaatgagaatttatggtttgtagggcatgactccccagatcccttagataggaatttgcatgagataaaaaaaatcaaagcttagtcttcaatcccattgcatttatattagttcactttaagtattccacagtttatggatgctctgttaatttttttttcagtttgtattgttttgaattctatgcctccaaattaatttttctcctgcaatctctaatctgcttccatctagtaaattatctcagatattatattaataattctatcaccagacattttatttgatcctttttaacttccctgtttcttcttaacctatttaatctttcctctcattttttgaacatatgaaatttgatgtaatgacttaaaatgttctctttttttgagccagagtctcactctgttgcccaggctggagtgcagtggctcgatcttggcccactgcaacctccaccaccctggttcaagcaattctcctgcctcagcctcctgagcagctgggatcacaggctcctgccacggtgcctggttagtgtttgtatttttagtagagtcagggtttcaccatcttggccaggctggtcttgaatgcctgacctcgtgatccacccacctcagccttgcaaagtgctggaattacaggcatgagccactgctcctggccttaaaatattcttgtctaattttatcatctgtgtcagttatggattggttttgattgacttttctcttcacatggttcagattttccaatttctttgtgtattgttaatttttgtttggatgccaaacaatgtgagttttactttttgggtactggatatttttattctatattctttagatttcttttgaaaagcagttaaatcacttagaagcagtttgatccttttggatcttgattttaaacttagaacagaatttagtgctggggctttttttttttttttttttttttttttggtctcacttcaaaagtgtgacctctctaagagcagtgcccaatagccatatgaattaataagattttttagtttgaaaacactcattattctcagccttactgagttctgaatatattgttctcactattcttttcaggtggctcttttcatatccttggttagtgtcctaacaaacatgtgctaattagtacccagctgaatattcgaggagaattgtttacagatgtctggaattttctctctgctgccctcttttctctttagtgtgcactttactatgctgctgtagagaggctatcctactccagaaagacttgtttataatttcttcacaccactcatttattcattttctcctttatacttcttccaatctggtttttacatcctctgaaattcttatcaagtcatcagaccatcattttgctaaatctagtgtttatttttggtataaatattctggcctccataatgtctgacctcatcttttattaatttctccttcaatccatcacattaaaaaaattcttcgatcacagtaggcatgattttgtcttagaacatttatactggctattttttctgcttgaaatgccctttcttcagatatttgcctcgttaacaaactcctctatttctagacttaactcttcgtcttagtcttagtccatttgtgctgctataacacagactgtggaattgataaaagacagatatttatttctaacagtctggaggctgggaagtccaaggtcaagtcaccagcagatttggctctccagcaagggctgcatcctccagagtgaaggaaactgtgtccttacactgcctccagaggcagaagggcaagagagagacactccctctatccactgctttgataaggatacctaatctcattcatgagtatgatggttaatattaggtgtcaacttgactggattgagggatgcctagatggctgatgaagcatgttaatagatgtgtctgtgagggacacatctatttgccagaggagactgatatttgagttagtagactgggagaggaaaattcatcctcaatgtgggtggcaccaaccatttgtctgccagtgcaggtagaacaaagcaggcagaagaagaggataggcagcttgttgagtctttttgctccttctcttcccatgttatgctggatgcttggcttcctctcctcgtgcccttggatattaactccaggttcttcagcctttggtctgtgaggcttgtaccagcaacctcccaggggctcttgggcctatggcctcagactgagggctgcactgttggcttccctgatattgaggcattcagatttaaactgagctatgctactggcttctctctttctctagcttgcatatagatagatacagatatagatatagatatatagatatatatatagatcctattggttctgtctctctgcagaaccctgactaatacagtgacggaggagccctgaaggcctaatcacctcttaaaggccccacctcttaatactatcacactggcaacatctgaattttggagagggcacattcaaaccatagcactcttcaataagcctaatcaccctacttaaaattccagcaacttcccaggatagccagtctctaaagataaccctcaataaaccttgtgtaaccctttcctcttgaatctgggctagccctgacttggagccaatagaatgcagcaggtgtgacaatctagatcttctgaggcagtcagaggacaacttgcaaattctgactgggtctgcttaaatgctagctgtcagggtgctcactctcagtacacatggagaggccacctttaggcaccttgatcaataacctcagctaagcctacatttgacaaccagtatcaactgctggccatgtgatggagctgtcttggacctctagcccagactaaagccctggctgatatctgtctgtaaacacatgagaaactgtaagtgagagccaactagatcagctaaaacacagtaatacaagttaataataaattgtttgaagccactaagctttgaagtggtttataggcaaggatagctagaaactctgtttgccctgcacttcaatttttaatctcttgctctttgtctttttccctcagcatttgttatcatttaacatactatatgatttgtgatttattatgtttattatttattttttgtcttgttgtccccaccagattgaaagctctaaaaggtggcaatcattgtttgttgtgctctctgatatatctcagttgtctagaacagcatggctaatacatagtggaatttcaataaatatttgtaaaagtaatgaagaaggcggtagtctatcctaaaaagttaaacaagactcattcaaaagatgatcacaaatttactcaaatgtggttcattcccaaagccaaaatgataaattaagatgtcaacaaatatctatggaacacaagctaaattacagacttgtaattattaatagcaaactggagagtaattattagaaaaaaatgaaatttgaaattactttcaaatattacaccattataagcctctgggtagtgattttagattaatataaaatttgatgaaaccaatcataatgaaaaagatacctaattattgtcactcaaaaataataatttaaacaaaatttaagggcatataaccacaatgttcaatacttggatttgttacagtaccttttttaagtgattacagggttaacataatttgagttgtgcatatttatttacattaatttcacttcacttaatggaatctgctggagattgacttgtgtttgtactaaaaatacataaaatatattaagaaaaagcagagagagagccactgatttattgtgtttggtgtccaagaacagctcaaactgctttctgtgaaagagttatgccttactgtttccttaaaaatgttttgtctgccgggcatggtggctcatgcttgtaaatcccagcactttgggaggctgaggtgggcagatcacaaggtcagcagatagagacaatcctgtctaacacggtgaaaccccgactctactaaaaatacaaaaaattagcccgccatggtggcgggtgcctgtagtcccagctatttgggaggatgaggcaggagaatgccgtgaacccgggaggcggagcttgcagtgagccgaggtcacgccactgcactccaccctgggtgaaagtgcgagactcggtctcgaaaaaaaaaaaaaaagaaaaaaaaagttttatcttgaaaactatatgtcagttcttagttgagttagtaatatgaggaatggctacaagtttttaaggaaaaaatacattttaagaatgttcactgaaaacccttttaaaacaacaggttctgaattttaaaaatattcagatagatttctttttgaacatataactggaatctttattacaaaagaatcatcaatgtttgacttctaattcatatgccaacatgcatttctaagcaaactataaccaagaaaaatgccaagcacactctgtaagcttagaatgcatgtgaatttcatattaattctttttgactcctcctgaacttgagcatcttacaggtctgattgggcaatttatcagttctcatgctcaatgaattcagtcgtagggcacatgcaacttaaagcaatgaggcctaactgccagggtgcttagaaccatcagtagggatgaatagcacagagtcagcatacaaatagaacatgaacatagagcaaaggcgaacatttagcctgactttggagcaaaaccagagttaagaccaagccctacctcagcacactgacgcttcagttttacatgtttgcttcgtagacagaactacttcacatttatttaccttccattatacaatctgcacattaaaaacaaaagaaaacaaaacaataatggccattaaacaaaaatacatgatgtagcttgctaaataatttatgggctttttggaagtgttttgggcagatttcaacctaacattactcttatttcctattcttttccttatagaatggagtatcatgataactaggtactaagtcaagtcaacagtgggccaagttgcctctgtggaatttaagctttacatgaagagagacttaagtatatttagtccttggtggtagaactctttagtgtgaagtcaagtagttgcttttgtagctttgattcaaagaagccaaaatcaaatgctatggggcctggaacatggtgaaagtggactatctggcactgaaacttggaaaccctatctaaaggaagcagtcactacttagctctaccaatagttgccatgctagattgtgagaccagggatgccaggtattttgtttctgcaagagaagccagaaatatggatttatcatgtcaactctcctaataaatactgaaatgtacttcattctttggtgctttatgcaagacaaaaaaaaaaaagaaaaaagagagggagagaaagaagaagcgaagaaaagacatggactctcatgtagattgaacttggtccacagtttactagcttgagatctgtaagaataaactaaggaggtaagagaaggaggagggcatattacttaggtgagaagtaattgtaaaatgtattataagcatttattagcacagtaaaatttatggacaaaatagaaacttcaaactacattaagccttctgtaatcgagctgtatcacctgcttctcattgatatcctttttcttactacttcctcccttattcagagaagtgttggctaattgttcacaattttactatgcactcactttccattctactctattaattaacactatcattcatttatttaatgaataaatatttttcaagttccatatgcgttgctttctagtatacgtggaaatgtggtatagccaaaaagtcacaatgatcacgtggatgctattcctaacgccttggcctctcaatatgttgacttccctgaattccaaaaggcatcatcattttgcttcagctcaacattcctaaggtcataatctggacattgctgttaccaggaagtgttccatgtctaaattcatgaattcagatttttaactcattgacccacccttccttccttccttccttcctgcttgcattcctctcttcttgccttcctttctttatccttctcttttccttctttccttccttccttccttctactctcccttgcctctcctgttctgaattctgtaagtattattgcactccatctattttttgctctcattaaattctttgaatcttgtaatttctcttatatcaacatcttctacctcccagtagtatggggtcctgttttattcaagctaatcttcatgctctttcatattagtgaatctcatgacaaaatctgtactctttggatcttgattttttatagacttgacatgtaaaattctacctttttgttaatccacttccctccactactggaggttgataccactgtgagtttaggttcatcaaatttgattagacctcaaaattctctagatttctagatcttttacatatcttttaaccatatctttttcttactcttcacagtggctattttaaacctttctcattctactcaagctccgactgcaactttttcttacttaacacatgaccatcagggcaactgttcttaaatttcttcacttacctcatctaccaacttaactaacaaggtatcatggttttaaaaagtgctatgttcaggataattccttcaactatgcttattatactatccgctaaactgtccttatttttcattcattcattttataaatcatatattaatcacctagtttgtgacaggtactgttctgggctctttggccacaccaatgagtaacacatattaggatcctgttctcagaaagacgttccactgaaaggaggtaatcagctgttagaaaaatattagtttcagctagtaataagaactgaaaaaatactaagacaaggtgatagatatatcagatagtgagtacctgggtgtgaagacacttccctgaggaagagacatttggtcagagaatgacaagaaggagccagccatgagaagacgtagaggagaagcatgtgaattcacaggaaagaataagcacatgcatcctaacttgggaaaggacttggtgtgtttcatcaatgcacatgcagttgaacaatcatgggtaatagtgggagatgagattagaaggtcaatcaggagcttaatgtaggttatgcaggaagccttttgtggttgttaagcatgggattgatgtcatccaatttagatttttaacaaaaacccataccatgctgaatgttgatggagttacgtaagggtagaagaagagatattatttagtaggtaattcaagtaatgtaggtgagagataatggtggcttgattttagggtgatactagggaaagagaatggttgacagattaagagtatatctagagggtaaagccaaaagatttgctgatctatggatatggaagttaagagaaagaaaggaacaagaataactcctagtgttttttgtttgtttgtttgtttctttgcttgactaattttgttatgtcattcattaaattgagaatgaaagaacaatatttttgagatcaaaataaagttgcaatcctgagttaagttttatgcatgctaaatttagatgctttattaggcatgcaagttaagatgtctaattgacaattggatatgtgagtttggagttcagaagagaggtcagcactggccatcaatattcagtacccgatgtcttgtgggtggtaaagccatgggactaagtgagataatctagggagaaatcagaaagagaaaaaaattcagggcacatccctggctcactctaatacttaaataataattagagaaagaggaaccaacaaaagagactgagaaatacctagcaagataggtgaaaagacaaggaagagtgatacatgctatagaagctaagaaaagaaagtacttaaagaggatgcaaatgtacatacttgccagagctaaaaaagaaaaagatgcaaatgaccaactgtttagctgagaaactagtaatgttaaaactgtgaaatagctgttgaagttggtctggaggggtgtcatttgttataagaactatttcaactgaattggagtcatttgaggagagaatgggaggtaaacaacaggagacagagacaacagacaactcttcttgtaagttttatcatgaaaggagaccaagaagagaaatagtagctggaagagaatgtgggctaaagcagggttttataaagtgggaagattctagaatatgtatgctgctaggattgattcaatagaaacaaattgatgatgtaggaggaagaggatacttgcaggaaccaagttcattagaaagtgagtcgcagatggagctagagcacaaattgagggatagaactttgacgtgagcagggacacttcatttattgtaaaagaaagaaaggggatgggtagaagtttaggtaggtaggtaaattttgtgatgaaaacaaggaagccctagattgaatctatttaacaaggtcatcatttgaaagggaagagtgggtggaaaagaggtagggctggaggccactacacaaagggagaaggtatgaatactcattttacatagtgtcagagtaaatatgcagtgcagtggagttgcagagtattagagaatgccattttgtcactcatggtcatgtatttagagtgagacaaaatagaattgctgtgcatcttgaagcctgcacaatgtgataggctgaataatggtccccaaagatattcagattccaatctctggaatctatgaatgttaccttatatgacaaaagagactttgcagatgtgaaaaaattgaagattttgagtacatgagattaccctatatttatcagatctgttctaaatgtagtcacaactgtccttataagaggaacaccatgattttagcccagtctgactcattttgtacttttgacctacataactgtaagataataaatttctgttgctttatgccactaagtttgtggtactgtgttgcagcagcaataggaaattaatacagtccactacttcattcctttcctttgtatctttatcctctctcttctttcaggccatttcctgttagcaggtaaacatgcttaagagtttccttttaaaaaacaacattaataaacaaaaaaccacagaatttcctacctctacctgctcagctctagctaccatccctttttatatagtccttttaacaactaaggcttgttatttttattatttccttctcatctctcatctactcaaatcttctgccaactctcgtcaacttcttttttccttagtaaactgctttcaatatttggcaaggtgctcttattcttaattccagtatattatttttacttctacccttttcaacctctttgttaatcagttgatttccccattctggtgatattctctccccttgggttctatgataccacatttttaaaaaattacatatttgctctctgaccgttcttctttattctcctttatgggctacatttttctcatggctttttcttggtgcaattttttaaatttattattattatgatgattattattattttgagacagggtctccctctattgcccaggctggagtgtagtggcacaatcatggttcactgcaaccctaacctcccgggctcaagtaatcctcacacctcagcctcctgagtagctgggactataggtgcatgctaccacacttggctaattttgttattttttgtacagatgaggtctcaccatgttgcccaggatggtatcaaactcctgggttcaagcaatccgccttcctcagcctcccaaaactctgagatcataggcgtgagccattgtgccttgctttattagtgttgttaacagggctctacttttttctcattctacatattcttttacagttatcttagctatttcccaaaactttctatttgacactcttagtactcacctggacaaatatactctgttctgtacaccttattgtcatgctaaggtgtcctgagttggaaagacaggctctcttgtcctgctccatggcacactcatgtccgactgcagtgattaactgtattggatttggtgtcactgaactgattttgaattctgaccttgcttttttcctacctgaaatagcaagtgatttaccacctgaatgtgtaaaacagtataaacccactaaactgtattaattaaatgagataatgcacatcaagtacaacgcatagtacctggcatatagggggttaataaatgtgggcaaatattagtatcgctagcttcttcttttcctctctaagttctgtttctgctggtaattctaccatggaacttctcttttccattgctgttgttgtagtagtttctaatgtctcctacaacgtttgatgttcacagcccaccattgccacccccactcctctttttatttttctgcttcacctttcctattactcttgtattatttttatttttcccccattttccccattattcccacattctttattttttctgttttccttacgttgttctccttctcctccaccttttattttttctgaatttgcacatctcaacaaatagtccagaccactctttgcagacttcttcattgccaggatctgcttcttagttttcatagttactgtttactttttcattatgatttatagtaaagatgggaagaaaatgactagtggcaggcctgcaggcctttcttaactaaagacagccctagaaaagaaatttaaagaaaatttctcaaaacatgttagtgacagaccacctggcaaatactaataatatgggctaatgggagagtccttatctatggactgctgcagcaggatgtctagtatgcttatggaaaacaaatctagaacctacggatttatgtgtcatggcccctggaaatgtatataccctatgtaactatcctaatataaaatttaaatgtttcataccaaaatagcttccttttgtgtaagttatgtgactatgcacattccatagcagctttgtttgttaaatctgggccactgtgtcctgatgtgataagaaaggcctgggaatttgtcattgtctttctggatctttccctgctttgtctgtgctgtttgattacatttgtccttgaagtcatcagtaaagcttgatactaagtaaggtttataatttgtgtgagtctgataggacagcttgaatccttccttgtgttttctcattggatatggtggcattccagatgattacagttgttaggaaatttctctctggatatctgaagcaatagtaggctatgattccaacatatctatctgtcatgattacagttctctttgtggtaatatattatcatatgtaattcagtaaagaaatgtgtatacatgcatgtaatacatcaatgtctatatctctgggtccatacaatgccataagagcaaatgtcaatctaagcattgatttgatgttatagagcctctagaatttttgactgctaaaaaaaaaaaacaaataatttgttaatttggtttctatttaagaaaccatttccatagaaatagatgcagttcttttactgaattacatatgaatcaaattcacaaataaagttagctcactttaaaatcatctaatctccttttaaaatgtatgacataaattatttaggtgttatttataagaggtggaaatataacacatcatatttatatcctttttttgctgtaatgatgaatattacaatttcttgagtgtgctattttccagacaaatgtgtattccattgtattgtcattagaaccataacattttctagaatgttacttacatcttaatgaagggataatcatgctatgaagcttttatattttcaacattacatttatttctcagtaattctctcactttgcagaaatgattttcattcttttacatttttaatgtgtgatgtacctaatggaaaataaagataatgctaaatgaaaatgagtgttattcattgataagaattcaattaatctatacaaaggtccctttcattacctcttttacagatttttaaaaattctctatttcttttataaggtttccttagatattctctatcattgtttttctttgtgcatttaaaaaagatgatctaggccaggcgtggtggctcacacatataatcccagcactttgggaggctgaggttggcagataacttgaggttcaggagttcaagatcagcctggtggccaggcacggtggctcatgcctgtaatcccagcactttgggaggctgaggcaggcggatcactaggtcaggagttccagaccagcctggccaacatggtgaaaccccatctctactaaaaatacaaaaattagctaggcatggtggcacctgcctgtactcccagctactcaggaggctgaggcaggagaatcgcttgaacccaagaggcagaggctgcagtgagccaggattgtgctacagcactccaacctaggcgacagagagagattccatctaaaaaaataaataaataaataaataaataagatgatcttataggaaggggatactacagtctgtaaggacgtaggagtctcaaaaatcatttgagttcaaaagaaatagcatttaataacaattacaatgtaataacaatgataacgagaggtgccaacgtgctagcagccctcactcactcttggcgcctcctcggtctcggtgtccactctggccacgcttgaggagtccttcagcccgctgctgcactgtgggagcccctctctgggctggccaaggccagagccagctccctctgcttgtggggaggtgtggagggcgctgctctgtggcgcctggtcccatcgaccttccaagggctgaggagtgcaggtgcgtggcgcgggactggtaggcagctccacccgcagccctggcgcaggatccactaggcgaagctagctgggctcctgagtcgggtagggacttggagaacttttatgtctagccggaggattgtatatgcaccaatcagcactctatgtctagctcagggattgtaaacgcaccaatcagcactctgtgtctagctcaaggtttgtaaacgtgacaatcagcactctgtgtctagctcagggattgtaaacacaccaagcagcactctgtgtctagctcaaggtttgtaaatgcaccaatcagtgctctgtgtctagctaatctagtggggacttggagaacttttgtgtctagctaaaggattataaatgcaccaatcagcactttgtgtctagctgaaggtttgtaaactcactaatcaatgctctgtgtctagctaatctagtggggacttggagaacttttatgtctagctagaggattgtaaatgcaccaatcagcgctctgtgtctagcttagggatcgtaaacactccaatcagctctctgtaaaacggaccaatcagctgtctgtaaagtggaccaatcagctctcagtaaaatggaccaatcagctctctgtaaaatggaccaatcagcaggatgtgggtggggccagataagggaataaaagcaggctgcccgagccagctgcggcaacccgcttgggtctcttttcatgctgtggaaggtttgttctttcactttttgcaataaatcttgctgctgctgtttgggtccatgcagcatttatgagctgtaacactcaccgcgaaggtctgcaccttcacttctgaggccagtgagaccacgaactcaccaaaaggaacaaacaactccagccacaccatctttaagaactgtaacgccgcgagggtccacagcttcattcttgaagttggcgagaccaagaacccaccagttccggacacaataatatttcatctttgtatagtctttttaatttttcaaaattatttcatcatatgatacttccaatatacaactatccgtaatctatgacacatagaagctgagacctcaaaatgttccagtacagtgaattacaagggagtgtaatttgacacattaaaatctcaaaatgtattttattttgactgttctttgaaaaggcctatttctagagttgatatatatcaagaagatttaagattggcatggaaaacaacaagctgctaatgggaagggaagcctaacaatagtactagcactcagacccaaggaggtgggcttctctttgggttttgccgtgactgtgttagtgttcatccacgcgctctacccttctatgtgggaggattatacctgcccacaatgtgaaactcaggtgtgctcatgtgatatggtccatgaaatgtccatagaagtggagggtgtcacttcctggaagacgttttaatggtcagtacacactttgccattctctttttccctctcctgtgataatagacatagtgggttccaaaagatgacatgacagagctgcagccaaccaataacggacatggaggaagagtgagatctaaacctgagtgttataggtctctgatatttgggaatcatttgttagtgaagcacaacctagactgtcttgactgatacaggtttgctcaaagattattaggaacttggctgtcctgttctccagcattgtcctttcctttttcatgttctcacctaaatgtggtcacaaaatactcttgttgattctccagcgcagagagagcaccaacgttttaaagactttactaaaattatgtctcagaaaactgtgaaacaaacccagggcctagtataattcactgtatttttgcagattcctcaattccatatggaaccccaagataaaaacatcttgatggaagtctagtctttcatgctcctggctaggaatcaaacggctcttaccatatgtggcagacaccacagagatgcaccaatcagctcccctttcaagaaaagactcattgtccatctgtgagggccatctgtgaacttcgcaagtccatctcagcttgagcggaggtcatgctctcctcagagtaacctcagtcagtgactaagcaagaatgtggtgcaagcacctagccatttcttttcaacaggggacttctgtaaaaggtgatctttgctctgaggctgtctgctgggctggcagatacgttgtcagatctgcattgcagtctggcagatcctcctacccaatcctgcattccccttgtttcttcacagatattaccttccaagatattttgtactcctaaattcagctcagcgtctgtttctgtgagtgggaaaagaaacttacataagatctacctacttattgagagtgttctcctagatataaagtcaaagatgagagtgccccatccccttgttcttctggctgttctcagtacctgttccctgtctgtgtttattcactgggcagccttatcatcagaaagacaatcatgcactataatagaacaatatcttataacagccatataacaatataacatacatccttaattctgtcaggattttgaaatgaaatgttctccttgataattttctcaagtgtaaagtgggaataataaaagtaattttctcacagagttgtgagaataattaatagccaaagtttattaagtgttcactttatgtcaggctttacaggcactacagtatttcattttattcaataggtgaggctattggggcaaagaaaggataagtaacatatagctaatgataggctgagtgggaactggggtctacacagagtgacatcacagcccacttacacaattactctctgctactctgtctctcaaagagatctgtcaagaccttagcaacgtgcctgcatggattaagcttaccatttgttggagtaggcaccccacaaatgttaaccactatgattacttattcattttcaaagttgaacaaataaaaaaaaaaccctgaataattcaaatacaaagaaataaaggtccttttaagctacctgttctccagcgttgtcccttcctttttcatgttctcacctaaatgtggtcataaaataagccaagtcaatgagtttggactttatcttttgggcattgaagagttattggagagtattaagaatggactgacatttagattcacagattaaaaaggtgactctatttgtagtgcagtcaatgaaaggaactgatgcataaagtggggtaagggaatggtagaatttgtccagacgaaaagcgaagtctgcctgaactacggtagtggcaacaggaattagaaaaaaaaaattaaataggctaggcgcatgggcttgcgcctgtaatcccagcactttgggaggcggaggcaggcggatcatgaggtcaggagatcgagaccatcctggctaacatggtgaaaccctgtccctactaaaaaaaaacaaaaaacaaaaattaggggggtgcctatagtcgcagctactagggaggctgaggcaggagaatcgtgtgaacctgggaggcggagcttgcagtgagccgtgatcgtgccactgcgctccagcctgggcaacagagcaagactctgtctcaaaaataagaaagaaagagagagagagggagggaggaagggagggagggaggaaggaaggaaggaaggaatcaagtagactagttaattgatttaaagtgtcacactggtttggacacttcatctggatgggcttcagttgatttatttgtgaaaatcttttggatgagatggttgctaaagtggtttttttgtttgttttgttttttccaattggcatctcttaagagggagctggaggtagaaagggtgggggaaagaaggaaacagagtaggtagaattgtaggaataaatatagtgaaaaacttttggaatgactttggtttggaaacttggtgcatttataacattattaagaaaatttttttaggcaaaaatctaaataaaatgcctttaacatccagctttatgttcccctaattttccaatttacttctaaactcccttaaagcaatacatttatctagtcttttgaaagagaatttataacatcttggagctctcaaataaaaagaggagagccaatcatggtggagggtttgttgttgttgttgttgttgttgttgttaagtataagaagcattaagcaagctcccaatgaaaccaagttttctttttaaaaatcctacaatttatgcaaatcccatatgggatttatgcaaattccatacgctttggtagtcagggcaaatagatatttgccataaagagaagtgagttgagtctatcttgcaaacaatatagataattgcagagaaagtaaggaaacaagctgcactttactattttatgctttggcaaattgtgttgcattgttatatacctggcaaaagaaagtgtatcattttggaaattgctgctgagtgtggttattgtgcacaaccacagcagagattttgaagtcatcatggagccgaggtggcagggtcactacgtgttctcactaccagggctatctgttagagtctgctgaatagctggcatcaatttcaggaggcaggaggcagaaaagtgctggactctatcctcatttggcaaagctttgaaggataatggttgagtgaataaaacttctactagcttactttcatttctagaacttcatgttatttctgtgaatattgaattaaacgagaaggctaagaaataattgaattcaaacatatttatcattctaaattttttttggaaagaatttatattttaaagtaatatcagtaaatgtaaatggagcaatgaagattaatgcaattctaaatatttaccctagtgggacaccatcacttcttgcctcaaatactgaaattgtctccttagctcccatttttgcattctgaagtttttctacacaatgtagtcagatttttctgaaatcaaaattggatcacggcactccctatttaaaaacctttggtagattaattaattaactaatgctacatcataactcactaaaacttagtttttcggaatgaaaactttttgttttttttcctcacagtttctgtgggtccacaactccagagtggcttagcttgggggttatggcttgaagtttcatgagattatactcactgtctgtagctacagatatatttgaaggcttgactgaagctagagaatctgcttctagtcattaacatggcggtcaagttgctgatgacaagttgtttttttctccacagggttgcttgagtgtcctcacaacaaggtggctagcttaccccagagtaagtgatatttaaaaagcaaggcagaattcttcactgatttttgtgactaacctcagaacttatttcatcacttctgtcatattctattggtcacataggccagtactgtttcactgtgggaggtgactatacaaggatgtgaaaaacgggaagcaaagattattaggcaccatcttgaaggcttaatatcacagttggttttcatttactttgggataaagttcaaatttttagacactgcttacaaaacctgtcatgatatgacaatttcttacctcttcaacttcatcctgcccctcatgaatcatgttcaagccattaaaaacgtatttcttcagttcttctaatgcactacactgttttcactctcttgttggatcttttttcccatcctttaaattgactcactgttactcactcttcatgtcaagttattagaaattctctttctcaaaagtttccatttgacttccaaatcatggattagtcacttggttttgtgaacccctaacatcttgtctgtcttaattatagcatttattgcacttacttttttataattattattttttcattgtgtaccctagtagattgatatgaaagtaggtgctctgcatatatgtgtgtgtatatgtatatatgtcattctgcctcattgcctatcatgtgcctaaaatgtaggaatatttattgaatgaatgattcaataaatgaatgagagactatcttgactctcactcagtaagtgatatttaccctaattttctaaggtgatggaaaaaaatctaataaactcacctataattacttttttgttagcttatatctctttataaacccaaacagaaaagaacaatctgatatactgatactggggtttggttccatgtgtgataatactggtaatttgttgaatctggagatatagatcctatatttatcttctaatgaacaatgatagagtaatgaaaatgtttttatctttctaggttacaaatcaatactatgacatatgagagtcagtgaaagtcaataaagattttctaccaaactatttttttctctcaaaactgtgaaattacaatactatggttaaaatagactgatccaaaatttttatatcattacatttagtaatgcctacatattattttccatagaccagttttaaagatgaacaaaatattacatagcaaaatatagtgttacttattaactgtacaaaacaaagatcagttgaaaagatttcaatgaattttaaatgctcccattaggtatgtcattttccccttctaacatgccacctaaaataaccagatcactattgacaataaaatatcctatactgcataccatttatagaaatagtagcacttaagaagagtatgtcagtggtaaaatttcagtcaaagatttcaatattttaaaagtattggggtggccgggcatggtggctcatgcctgtaatcccagcacgttaggaagtcgaggcgggtagatcacctgaggtcaggagttcaagaccagcctgggctgggtgtggtggctcacgcctgtaatcccagcacttttggaagccaaggtgggtggatcacaaggtcaggagttcaagatcagcctggcaaacatggtgaaacccctactaaaaatagtatttgaaatctctactaaaaatacaaaaaaattaggcaggtgttatggcacacaccgcaggagaatcacttgaacccaggaggcagaggctgcagtgagccgagaccatgccattgcactccagtctgggtgacaaagtgagactccatccaaaaaggggggaaaaaagtactggggtatctatttctcccaaaatgttaaatggcaagtgagtggagggaaacagaaggggatagttcatgtcccatcttactggtttacaactgggaaagcagagtaagatcttcatgtgggttgatgtgatatctgtatatatcagcagacataacagaatcttcttgttggcctatcctgtttagactaacattatggtattagttcctttggggctcacatttattctctgactgccctctagcaaaacttatggggcagacactttggtaaaaggtcccaaactataatgattaccttatattttgtcagtgcaccattggcattgaacaaaatttagtacattatttaataaccatggtagttcatggcaatccatggccctcttgcatattggcaaagttgaaacatcaagtaatctacattttaaaaaatgtctttgatcctttctcgtttgaaatatggatgtaacaggtgcaatggaaaaggaaggtgtgagagtcctttctataatgtttacataacgtctgtctataggagggacaagacattcccttcgagatttgggggtatttggacatagtcttgcaaattcacaaatatcttatgaaagaaaaaagaattaggaaacacttatggaatatttcaagctataattcagttaatcaaagttttaaattatgtttcatgtacctatgattaaaagagctttaattgattaaacaggggttcattttacttttgttaacttgacacatactacaaaaaattcaagatactaggagggaaaaaataaacactatcaaaagctatgttgtggaccttactctgtttttttcaagtatacaggtagaattttactaaccaataaagaaaagttataaaaaaacatggagaatatagttctttttatatacctgatgccccatcctccagtccctcttaaagagatagagtggtgacacacacttccttcaaaggctgacaaagaatatttgatttcataatgtttaaggtcatttctcagaatacacaggtttgaccattgcctaaatgctaatcattaattcaaaggctatattttattttttaaagaaagtttattatagtttgtgtattttgctattgaaatcaatgtgtaagtgcaagttactgtacacaaatttagaagttataggaggtcaggcacagtggctcacgcctgtaatcccagcactttagaaggccgaggtgggcggatcacgaggcaggcagataaggatggagatggagactctcctggctaacatggtgaaacctcgtctctactaaaaaataatacaaaaaattagctgggggtggtggcacatgcctgtagtctcagctactcgggaggctgaggcaggagaatcacttgaacccaggaggcagaggttgcagtgagccgagatcgcaccactgcgctccagcctgggtgacaaagcaaaaatctgtctttaaaaaaaaaaaaaagaagttataggaaatgacataaatcttcagaaaaatgataaaattacatgtaattcataaacaattacgtcatgctttttaaagttcattttattataactaagcgtaaggtatcttaagtctctggaacaagggtataagcatgtatctatgtattaaatagtaatgaaacatttcacaaacatatagttcaatgttcatattcaaaaacatatattaggatgggaatcacattgtatggctgtgttgtagtggtgtgttagtgtggcgactctgaaaaattactcttacaattaggcgtacataaatatgacataattctctcaacacactttagtaacatggcttttcccccaatgtgcaaggtaaaatagttttcctctgaggtactactttcgtggcaaaactttagtgaccaagaccttttaaatgaaagaaatccataccattgttgttaggagtccatattaagggcctatactggtatcgaagtaacttaagatgttgaccgtgtggtcaattttcttttctcccatcctgatataatgtaatgtggccatttaatgagttctaactcatttactaatgagcatattgtttcctcatcacatgctaggcaaacagaaagtaaacagcatctttttagcaaaaaccttttctggaattttttttttaattgtaataatataggaataaacaacgaaaacctatagcaattaccataaaagttttagtgcatttgtaatatgctaagtatttgatatattccttgtaaaagactatttaagtaaatctttagctgccggtgtttgcttgctgtacagaatcataaactatcaatattcctaaattagcatggtccagtcatccaacttattgcctcagtcactcaattttcaagtttatgtactttcctctcagttatcagatggtgacttttggataaattgttatggcaaaaattttttttaatatcatggtgaatacatgttgatgtgatctgaatatataaaatatcaatatctaaagatcatttagaaaatgtttatttttactacaaaagttatgcatgtttacataagacgttaaaagtaaagtaaaaactcatttcctgtgaccctgacaaaacatcattagcattttattaaaatttatcctagttattttctgtgtttatatatatttttgcctataataatttttatttattttttacaattttctttcctttttttttttttaaagacagagtcttgctctgttgctcaggctggagtacaatggtgcaatcttggctcactgcaattccacctcaggttcaagcaattcacctcccttagcctcctgagtagctgagattacaggtgtgcaccaccacacccagctaatttttgtatttttactagagatgggatttcaccatgttggccagggtggtctcgaactcctgacctcaggtgatctgcctgccttggcctcccaaagtgctgggattataggtgtgagccaccacgcccgacccgttcttacaattttctatttttatttatctctgtagacatctaacactatgtattctaacatcaagcttagtacacagtagacatttaataaatgtgattagttaagtatgttaaatatcagatgctagaatatttatacatatatataatgtatatttttaagggtttacacaattccaggaggcaccattctcattatctacacaaatggcattctcaggagggcacatttatttacatagactgcaatataaatggcctaggaaaatggtgtcttctagatgtacaatgatatggccatggatgtatatttgtgtgtatgtatacatgtatatgtatatacatacatataagtatacgtgtaatagccgcaggtatttcagtccatctataaaaccaaggcaaatgtcctcaaaattaaatgcattttcactcatttattatttattcaacaaatatttatgttcactgaaactgagctgagggctagggaaataatatatcagcaagatagacattgttctatatcctttgaaaatatcataggtgacagtgtacaagagtgttaaaaagagacttctacccatataagatacttaatagctctaacactgcagacagtagtcaggaaataccactgcacttcaaattagagtgccgcaccatctaagccagacttgtaaaagatgacaagagaaattattctggcagtatcacaccctctacacgtagtaagacaaggctgaaaattcatttgaatctggtatttgaaagatataatttcattgaaagaagtcagcatcctgtggcatttgcccttctttctctctagggaagaagaaagcttcttctttccttccatatcaagtgaagctgtctcaaaaaagaccatactgagaacttacttgagtcctcagaaattggaaaagtatcaaagctagattatggtttactaaaataaaataaaaataagcatcttttatttttgtttgtcttttaaaaggtaagaagatagacagcttccctgcttacctggtggcagggcgaggagatactgtctgtattagtctgttctcatactgctacgaagaaatacctgaggctgggtaatttataaagaaaagaggtttaatggactcacagttccacgtggttggggaggcatcaggaggcctgcaatcatggcagaaggcatctcttcacagggcggcaggagagagaatgagtgccgagcgcagtgggggaaagcccctcataaaaccatcaggtctggtgagaattcactcactaccatgagaacagcatgggggaaccgcccccatgatctaatcacctcctctgaggtccctcccccaacacgtagggattataattcagattacaattcaagatgggatttgggtgaggacacagccaaaccataccactgcctttgtcatgaaggacacttcttgtgaggcaggggatgggccatatttcttgtaaatcggatatggttgccacacaagagagagaactgggagaagtcttgaataggactttgtccaagatgtcctgctgaagggatgtagtaaccacagcaaaaggaggctggaaacagtactaaggggcattataagtgtcctgcatttggaggaatcacttcttaggaataacaaatgaggtctctaggggaggattctctgaagaagtcacaagtaccctacaaaagaaaaaacaaacagattttggacatcagccactttagggcgtcaatgacataaggcaactgtgccagtcatttcagctttcctctacttctcaccacttctccatcccacacagaggactcaagagacaatgtagagtaaaaattcaaggcagggaaagaaagaagctgtaatgacttcctgttttatctatttcaagacaaactggaagatagaaggtgagagtgattagctctcagggtttttatatcagactggactgggatttttaagaccatgaggtagcttgaaaagcaatgaactttaattgaaattttatctatcacaggaaagaagctgttgaaaggggaaattgaacaaagtataaaatcatgttcttcttacattttatccagtttgctttattctagtaaccattcacaaagaacaatgataacaaactatcaaaagttctataacatgagaaaaaaaggatgttatgggaacacaggaagagctttgcttccagcgacccaagctactctcctagcaaatcttccactgatgacagtaaagagagagtgatcttggatccctggtaaatcctgcctcagatactgaatgtagaggtgagctctctccaagaggtggatggaaagccagaaatccaggagctaagtaggtacaaacaactcgaggacaatatattgcctgtgtctcaggatgtgcagtggaatatttttagtgtactcaactttcttttgtggtgtctgccaaaaactctcataagcatcccataagggaaagaaagctttaaacacctgtcacattcagaaattgctgagccatcttacaataattccagtcaagaaagaacttaggtgttcttctcacccttttttttcttcctcctctttggccctagaggggagacagaaataacagctaacaggtggcagggaaggggaataaaagagatttttacagttgaacaaaattggaaactcaaattattcatatggtttagggcttttataattactaaattactaaactatatctttgactttaaagtcagccaaatttttccatttcctaataataagaaaaataatgaacaagcatggcccctactatgtgccaaacatgattgtaagaactattacctcctaatcctcataataatgctaaaatgcagaaattcataacactctgcatttcatagggaaaactgaggcacacagttaaatgacttgcccaattttattgggatttaaacccaacgaatctggtaacagagtacatgatcctaatcactactttataagttaaaagagaagataaatgatgtagttttcattaagtgccagacatcgggaacccaacccccactaagtaggtttgaatggagagagggagacaataacaaagttgcttctacggctataattctttgttcaatgtactgattgcttactttgtacttcagctggccgttagaagctactgaagagttttaaaatgatttgttcctatgatgggatttgcttttcagtgtgatcactgtgacttctttgtagagactggtttggaggagtataagagtggaagaaaataggtagatcagaaagactattatgagcggactgctgcctgaacaaagtaatgaaagtgggatggatggaaaagattcaagttaggtagatctatctgtctatctatctatctatctatctatctatctatctatctatctatccattcatccatctaagacagagtaaattggacctaatgattggatatggaggtgagaaaacattaagttataaatttccatgtgtgtatgtgaaactgctaaagtacatcataaaatatcataaagttagagtaaggatcaaattagataattcgtgacaagcgcttaccaccatgaactgtaagtggctaaggaagtttgctgaagtgaaaatagcttgggttctagcaccgtgtgtatatcctggggaaggtgttgtactctctgttcctctggcatcttatctgtgaaatatcagtaccttcctcatggtatacattgagtgaattacgtgaaatgattcttgtgaagagattagcacaattgctgacacactatagatctcaattaatgctagccatcttttactagactgttttcttttcatctacctgacattagttgtatggctttttgaggttaatttctgcatgtcacaaagcacactgttttcctcagaagaagctgatatttcataaagctagtttattgctcttatgcaaatggggcagtactttaagactgttaactactgaaaaaactagtattttgtcatgatgcaagtgaggagggtactgggacaccactccttccccatgggtcagataattagttaagtgggaaaaagttacaaaccacacagtgcactattgtatctagtaggaagtgataaaactattatcaaggattaatattgccctcatctatttgtttaaggcctataacaaagatttcatgggaattttctacatttttattttctaatttttacatatgacctctaatttggttctgaaatgaaatcaacttttagttctttttttatctcaagtgtattacatttttggagatgttatttataatactttgatttttcaaattaataaattgaagatgcaatacagtattcaatttgctgcaaaactctactcttcatacgaaaatagagatagagctatgacctaaagattaatacacagctccatcacagcatagcttgaaatgttaaacagctgatgtacaaaatgatgtgagagtatcagtgaataatacacagaagtgcatactgtaaacaaagcaaacatttctaaattgagagctgtctaattctagaggcaaactcagaatttggatttaagaagataattataggggagaaagaaagtaacaactatgttttcttaaaccaagatagagagtaagaaacatccttaaccaggaagctattgtcttaaactgctgttgttttggcatcattcataatcacttaccaactatttttttgagggtaaatcaggttatcttctgtttataattcttctgagggcaacttaacttcttttctttaacctatcatttctaactaccttcaagtttagccgtatacaacttaaatcacattttgctacactttttagatcttgagattgttttttggctactctgtcatcagtgtaatttttaaaattctatttgctatcggtaggacctggagtttacacatagccagaattaaaatgtattgacaagtgaaaataagttctttgatctcagtggggaaaagggatgcagctctgcactcctgaattctaccactttcatattctgagcctttgaagtttttctttgctttcctgcacatcctttggttcatagtttgtgcttattttttttcctgataaaattgtttgacaggcttagagctgtaaagataggagtgttgtttaataaataaaaataaaaagataattaattgtttctgtaaggtcgaatgcataatccatagagagcttctttctgctgtactcgctccctacgtaactcaactgtgaaaagcagaaacttttcatttttttttttttttttgagacggaatctcgtctgtcgcccaggctggagcgcagtggtgcctgccatctcagctcactgcaagctccgcctcccaggtacatgccattctccggcctcaggctcctgagtagctaggactacaggcgcccgccaccaagcctggctaatttttgttgcatttttagtagagacagggtttcaccatgttagccaggatggtctcgatctcctgacctcgtgatccgcccgcctcagcttcccaaagtgctgggattacaggtgtgagccactgcgcccggcaaaagtaggaccttttctatctccagtgtgaatttaaccacctggcaatatttgaaaggtagagattctgactcagaacgtccggagacttaaactctttttttttttaaacaagtttccagatggtcttcaggggaccacattttgagcagtaaagataaacaggaagaaaggaaagcagaagtattctaaatacattacttcaatactgttcactatgttagacatcttacatccattatctgctattaactcctataatatgtagtattatccctaaaatataggaaaataaatagacacagatgtagcaatacatagtaacaaactgatctttttgcaagatacagattacaaaattatttaacctctgagtgtcttactttccattttacaaaatggggttttaaacataagacccaaaaccataaaaaccctagaagaaaacctaggcagtaacattcaggacataggcatgggcttagacttcatgactaaaacacgaaaagcaatggcaacaatgccaaaattgacaaatgggatctaattaaactaaatagcttctgcacagcaaaagaaactatcaccggagttaaaaaggcaacctacagaatgggagaaaatttttgcaacctatccatctgacaaagggataatatccagaatctacaaagaacttaaacaagtttacaaaaaaaaaaaaaaaaaaaagaaaaccaccaaatagtgggcaaaggatatgaacagacacttctcaaaagcagacatttatgtggccaataaacaaatgaaaaaagctcataatcactggtcactagagaaatgcaaaccaaaaccacaatgagatactgagaggtgacagcatgctggcagtcctcagagccctcgcttgctctcggcaccccccctgcctgggctcccactttggtggcatttgaggagcccttcagtccccccactgcactgtgggagcccctttctgggctggccaaggctggagcccactccctcagctttcagggaggtgtggagggagaggcaccagcgggaaccggggctgcctgcggtgcttgcaggccagctggagttccgggtgggcgtgggcttggtgggccccgcactggaagcagccagtcagccctgctggcccggggcaatgggggacttagcacccgggccagtggctgcggagggtgtactgagtcccccagcagtgctggcccacctgcgctgtgctcgatttctcgtggggccttagctgccttcccgcggggcagggctcgggacctgcagcccgccatgcctgagcctcccacccactccatgggctcctgtgcagcccaagcctccccgacgagcaccaccccctactccacggcgcccagtcccatcgaccacccaagggctgaggaatgcgagcacacggcgcaggactggcaggcagctccacctgcagccctggtgcgggatccactaggtgaagccagctgggctcctgagtctggtggggacgtggagtctttatatctagttcagggattgtaaatacaccaatcagcaccctgtgtttagctcaaggtttgtgagtgcaccaggcgacactcggtatctagctgctctggtgaggacgtggagaacctttatgtctagctcagggattgtaaatacaccaatcggcactctgtatctagctcaaggtttgtaaatacaccaatcagcaccctgtgtttagctcaaggtttgtgagtgcaccaatcgacactctgtatctagctgctctggtggggccttggagaacctttatgtctagctcaaggattgtaaatacaccaataggcactctgtatctagctcaaggtttgtaaacacaccaatcagcaccctgtgtttagctcaaggtttgtgaatgcaccaatcgacactctgtatctagctgctctggtggggccttggagaacctgtgtgtcgaatctctgtatctaactaatctgatgcagaggcggagaacctttgtatctagctcagggattgtaaacacaccaatcagcaccctgacaaaacaggccacttggctctaccaatcagcaggatgtgggtggggccagataagagaataaaagcaggctgcccgagccagcattggcaaccagctccggtcacccaccaattctggacacaataccatctcatgctagttagatcggcaatcattaaaaagtcaggaaacaacagatgctggagaggatgtggagaaataggaatgcttttacactgttggtgggagtataaattagttcaatgattgtggaagacagtgtggcaattcctcaaggatctagaaccagaaataccatttgacccagcaatcccattactgagtatatacccaaaggattataaatcattctactgcaaacacacatgcacacgtatgtttattgcaacactgttcacaatagtaaagacttggaaccaacccaaatacccatcagtgatagactggataaagaaaatgtggcacatattcactatggaatactatgcagccataaaaaaggatgagttcatgtcctttgcagggatatggatgaaactagaacaatcattctcagtaaactaacacaggaacagaaaaccaaacaccacatgttctcactcataagtgggatttgaacaatgagaattcatgggcacacggaggggaacatcacacaccagggcctttcgggggctggggatctaggggagcaataagattaggagaaatacctaatgtagatgaggggttgatgggtgcagcaaaccatcatggcacgtgtatacctatgtaataaacctgctggttctgcacatgtatcccagaacttaaagtataagaaaaaaaataggccaggcgcagtggctaacacctgtaatcccagcactttgggaggccgaggtgggcagatcatgaggtcaggagatcgagactatcctgcctaacatggtgaaaccccatctctactaaaaatacaaaaaaaaaaaaaaaaattagctgggcatggtggtgggcgcctggagttccagctactccgaaggctgaggcaggacaatggtgtgaacctgggaggcggagcttgcagtgagtggagatcgcgccactgcactccagcctgggcgacagagaaagactccatctaaaaacttaaataaataaagaaaaaaaatatttacctcacagtgatgttagaagggtttgggatatattcacatcatgtagccaagtgcctggccgaagtaagtcctttttttttttttttttttttgagatggagtctcgctctttccaccaggctggagtgcaatggcacgatctcggctcactgcaagctccgcctcccgggttcaagcgattctcctgcctcagtctcccagttagctgggactacagttgcctgccaccacgcccggctaatttttttgtattttttagtagagatggttttcactgtgatagccaggatggtctcaatttatatttcttgacctcgtgatccgcccacctcagcctcccaaagtgctgggattacaggtgtgagccaccgtgcccagccccaagtaagttcttaaaacattttctatcattattataattccaattttattttattattagtttttgagatggagtctctctctgtaacccaggctgagtgcagtggcttgatctcggctcactgcaacctgtgcttcctgggttcaagctgcctcttgcctcagcctcccgagtagctgggattaaaggcacctgccaacccgcccagctcatttttgtatttttagtagagatggggtttcaccatgttggcgaggctcgtctcgaactcctgacctcaagtgatctgcacacttcggcctcccaaagtgctgagattacaggcgtaagccaccgcgcctggcctataattccaattttagcagtatatcttgctaatcaaccaaaaggaacacttaagtgcttatattttatatttactgttagtcatttagaaatgatacaatttgaattatagatgtaattgacaaatttgtactttcattgacctgattggttaagatacttaatcatatgataccacttttcctctttaaacggtaataaccattcattgcaaattactaatatactgacttactcatagttttcactagtcagcactgaatcatactgcatgtgtattttgttctcagcatggaaaagtacatgtcaaatagtaaaccctagtatgccaatcatttagtaacttcaagattactaattaccataatgttgaagtgctaagattatcagggtataatgcattcattatgttaatgattctttatcttatccaagaatcacacattttccctgggagcaaaaagaatcaaaagaaccaactggaagcttttaataaaagtttatgcatttaagcgtgtgattaaccgacaatcatattacaagtgctttattttaaaggaaataataaaaagaaaaaactgtttataacgggtaagattttctttctaaacataattgacatttcactaactgaaattggaattaccaaagaagtgtaagacatgtcttgtgccctcaagggggaagaaatattacatacaaataatgaaactaattatagtctaaactcatagaaaaacaactacttataaagaattaaaaatgggagaaataaggttagataggagtagtcacagaagtgatgaaagagacgttaactcaaatttgaaagataagtacaggtggatagagtgtagaaatgaaaaacagctactcagaacaaagtatctctttttcttttttggaagaacatagtactaagcatcagaaaatttgaatttaaagttgaatttaaattgactgtacattccttgaaatgtgttctctcatttgtagaatgggagatttagaaaagaggtttccctaactactctatgcttctttaactgtaaaattttaggcctagctatatagggcaggaaatagaagggcacatgcagagcacaggtattagggcctggtagtaaacatggttgtgtgcagagcatgggtcaaactatacggccttcagaacctagtacttgagatggaatcagtacctgctgctaaggatggtaataagaaggaatttcacatgagatcaggattatgatgcggtttaggacaagcaatccagtggatataaaaagtaagatacaagacagatatgacaatattggaaaggctgtgtaacatgcagattgactctgaattgtcagtgaaagtggatgacatcaccatccaagcagttgaaatgggctctgtggggaaatgtcagagctgtacagaaaaaaaaataggtgcccagaattcataacaggaaactcagttgtttggggggcttaggatttgatttttatttctaagcctcttttataagggcatcaatttcacttatgggggttctggcctcatgatccaatcacttcccaaaggctccatctcttaataccaaaatgttggggattaagtttccacatgaattttgaggggacaccaacattcagaacatgaacagggacttccatttggagagattttgaagagtaacactcctggcctttcctccagcccggattttctcctctcctatggataaagagtgacttatctgattggaaattatagctcctttcttgctcttgttataattagataagcattctggtctactctttatcatccagtaagtagcctgcccctgtgtggatggcatgtggctggccagcttagcctctctgggatttagatactaatttagataatcatactaataataaagagctgactctctgctctttgttgttcagggtaaaatcttaggaaacccactgtgtttgcatatgaaagccaggttctataatccatgctacgccttctgtctgtctcatttgcttctgaagtctgagggaaagatgggtgttattttgcactgaattaccacaaaggatcaaattgttgaattgaatgtagaaggacagagagcttacccagtctcaaattttaccaatagcttcaaggatgcaagcactcaagaaacatggacaaaaaagagagtggttggggacatcttttatggcttgccaggtcttcctttgcttcaagagaaatgcattctaacccagaggaatagaatgtttgcagatcacctcagctaatagagatttttaggttatgaaacaagtttatttcacagccaaattgttatagggcttatataaccatttccagggagctgtgcttcaaaaattcacagactctcggtttgtatactatagaaaatgccaaaccagggatatcctgtctagatcattctatagataagaatggtcttccctgtaaatacctttagtttatttaccaggaagtgcctcatcagcatgtttataaagattacttaggtagcttgcttctttctttggcatgtctcttggtcatcagggtgagagagagaaagaaagataaaccacaggcacattgctttaacttcttcctccccagacccattaaatttccacagactggaatagggaagtgtaggagtgaaaacagacataggtctgcttctagcattaagccaagtaactatttttacttgacatgagtggaaatagtataaggaaaatattgtcttgggaaaaatagctcactgggacgttatagaagagtttaagggtgaataaatggagatgcaatgactagtcagaaagcatgatttagtgagtctgagcgttactgtggtagcaatgacaatggggaggaaggagtaaaacacaaaggtattttaaagaaagaaatgacagaaattggtaactttagcattaaggatagaagaaagataagactaaaatgttaccctggaatttctagtgagggagacaatatttaaaatgctaaaattaaaataaaccatgtatttccagagtaggtcaaagtcatttaaaaaaaggataaactgggccgggtgcagtggctcatgcctgtaatcccagcactttgggaggctgaggcaggtggatcacctgaggtccggagttcgagaccatcctggccaacatggtgaaaccctgtctctactaaaaatacaaaaattagccgggtgtggtggcgagtgcctgtagtcccagctacttgggaggctgaggcaggagaattgcttgaactcggcaatggaggttgcagtgagccgaaaaagcaccactgcactccagcctgggtgacagagtgagactctgtctcaaaaaaaaaaaaaaaaaaaaaaaaagaaaaaaggataaactaagtttaattgatgagtatgaaaacatgccagatcatcccaaaggatgtattagggaaaagcagaatttgtgagtatgtgaaaatttggaaattagttggagaaatctaatagttgatttattcagtcaacaaataggccagtatgcacactctcaatttaaggcatgagagatataatgtgactaaaacgtccaaaaccaaataagactctgctcctttttttttttctttgaggcatagcctggctctgtcgcccaggctggagtgcagtggcttgatcttggctcactgcagtctcaaactccctgagctcaggtgatactcccacctcagcctccctagcagctgggacctcaggtgtgtaccatcatgcccagctaatttttgtagagacagggttttgtcactttgcccaggctggtctggaactcctgagctcaagtgatccagctgcttaggcctctcaaagggctggtattacaggcatgaaccactgcactgagccaactctctggtctttgttattcaattgctgtgtgcctcactaatctgattcttagtactcccaaactctgaccttagtgatataaccatattctaaattcatcatcatggaatgcccatccatcctcatttctgttctgtctagccaaacctgcagttggagtcactacaaaactggtggcacagaattccaacaaaggacttccccatagcatcccaagatggggctgattgagattccaaagaaggaggtactagatgccaggaaaatcaatcccaagcatttattaggggaatttacataaagaagagggtgcggcgtgtcttagcaacagtgagaaaagagatattccacctagatatgtctgcaatgaggggatggagttaatggagttgacttgagtgtttaagaagtttggctcagggccaaagctagtttctatgtatgtaacaacatggctgatcttttagtgttttccaacagcaacctaaatagctttatcaatttctgagaaggttcaagactgaaggggaagacatagctggctgggtcacagagcagttaggtcactgtgtttctgggtcaggacattgaaagaaggcagggggaaagtgggggaccctacaatctgtcacccagagaccatgtcaagagagatctctttttcggcatttctcaacatctgtagtatttacagtcaatgctctgcccacgttcccttactcctacagtgcatgccagcctaatacccaactgccaatataataggcaaggagatactgaggacttcctctccctgctgaagttcactttgcccacctatgtggcagtccagaaatgatggggcattaaaactttccaggagcaaccctcagtcggtgactggcagtagacagtgtgtaaataaataccccatctctctcatccctagcattggctatctctcagggatgtgtcctgcactgcagaggttctccagcaggactgagatccagtcctccacagtgagctggattgattcctacccttcattaggtacctttcctttcttgccttagttggaagtactgtaggcaaggataactgaacaccaccattcctatccaaaatactcaaagcatattaatgtgtttagctagagaatacagttagagattattagttgccaaaccttgctttgaaaaaaaagtgaagaattttagcttctgaaagtcattgcaatcaaatattgagcaacatgaagataaatcgggagctcgccggtttctatcagaaatgtgcccacatacgcaccacactacactggtcttgaattggtatttggcatttgctttgaacatttcaagagctagaataacaaaaacagctgtgtcaaaagtaagtgtctacttggtttcattaatgtgatcacactcatatggattgttttaaaatatccaaaagactgaaggtcctgatgaatccgacaaaatagagtactttttagggaaattagcagccttaatgtcaaagacaaatgtcagattattttgttccaatttactcattttaggcttaaggattctcaaaagatagtgaacaatatataatacactagacattctactccgcaaatttaattttgagcatataataatagaattttatctttggaaagtttgtgaaaattcttatgcattcaatcttgatatgaatcattgtctttatagttgttttgataataatctaatattatcaaatcacgatccccaacttctcaagacataatgaatatacattgaaatttaaagtacatgtgtttaccagacaatgcctagaggaaataaataattcaatttcatatcatacaggaatattggttttctagacaattgcctttactgtttcaatcaattaatcatttgtgctgggcattacaaattaagtagtaactgaaatatacaatgcaaaagaacctcccttcctggagattaattctgcagaagagactggcagtttttttaaaaaaaagtttaaaaataatttaatggtgatatgtgctgtggagaaaaatatataaatcaatggagtgtgacaggacctgctaatgttggtttgagtgcttgatatcaattttaaataaggtggtcaagaaaaaaaatcaatgagaagataattgagcaaaaacaggaagccagtgaaagggtgatccatgacagtgcctgcactaagggtacaccaagcaaggagaactggtacaaaggcgctgacgtggaaatgtttctacatagcaattgcgttagtgtgacatggagaggaataaatgagaaaaggagtgttgggagataagggaagaaaagtagcaatggggctgaagctattccaaggattttggtttttaagctgagtgataagggatacctctaaggatgctaggcaatggaatgacatgaattgacttacattttactatgatctaactggctaacatgtaaagaacataaaagggaggtgctttagtcagattagatgaatgactttttattttattttattttattttgagacggaatttcactcttgtcgcccaggttggagtgcaatggcgtgatctcagctcactgcaacctccgtctcctgggttcaagcgattcttcttcttcagcctcctgagtagctgggattacaggcacccgccaccactctcggttaatttttgtatttttagtggagacgaggtttcactacgttggtcaggctggtctcaaactcctgacctcaggtgatctgcctgcctcggcctcccaaagtgcttggattacagacgtgaaccactgcacccggccaaatgacagttcttaaatctcactggcttaatgcaataatcattttttctcttatttatatacctaaatgaatgtgtttggcagagaggaattctgttccaagtagttggtgagagattcagcttgtggagcttgtggcttccttagagtctcagcccccagagtgtctactgcctccttctacctttctgcagtcaggggaagagaaacgaaaagcacttgagcagcagtggttattattttcaccagtaactcacaggcaagaactcaatcatatgctgtacttagcagcaaaggaaactgggagatgccgtctaaatctgtgttcaggaggaaaaggaaatgggttttagagaacacgttatagtctctgccacagggaataaggacagaaacagaatgctacttaggaagatgttgctttatacaaaaaggagatgatggtggccaggcccggtggctcacgcctgtaatcccagcactttgggaggccgaagcgggcggatcacctgaggtcaggagatcgagaccatcctggctaacacggtgaaaccctgtctctactaaaaatacgaaaaattagccgggcgtggtggtgggtgcctgtagtcccagctgctcggcaggctgaggcaggagaatggcacgaactcgggaggcagagcttgcggtgagctgagattgcaccactgcactccagcctgggcgacagagtgagactccgtctcaaaaaaaaaaaaaaaaaaaaaaaaaaaaaaaaaaaaaaaaaaaaagatgatggaatgatggcagccttgaccacagtgcttgcatgggtataaggagaatgatgtactggaaaatgtcccaaactatttattttttgatggggatagtaacattaataggtgatcaatgaaaaattgtttcagaagtaaaatacgattaggaaatgctggatttctctacaaaagatttcttgcaacatttattaggcttgaggatctttgttattttgttgtaaaaatataaaatatgcggttatcaaaatcatcaggaattttttaatagacaatatcacatagctaatattccaaagaatattctttaagaagacaagtgaattattggatagaagatagggtctggtttttgacacgtacttcctgtgtgactctggatgactctttaacctctttgagatttacttccctcaattctagaatggacacactaccttttagattgctcaccttacagggctatacaaagctaataaaatgtacatataagcactgtaagcatcagtgagtattattataagacttagcgtggcaacaaaggagcagagcaaactgagatgcttagtttttgccaggaggagcctgaatgtcagccatcaaggagtcttatcaggtagcattatcttgacagtgacccaatggccctcagtcctttgcctctggaattgatcaaactatatttacagagcctaactacatctgtcagcttataaacaacattgaaataagaatttctaccgattaatgtaaagttgtctagggacaactgtgctgatgttccctatttattataacttattttcaaaatgaggatatttgggaatggcaagcaaagacatttgtttagtaaacaccaaagatcagagagcaaaaacatcagatttttgtggaaggtattctctttaggccttggtgagaacagactaacatcagtcctcagctaggcagtgaccaagtcctctatatttaatgtctagatgaactctctatcactggactgagaggatgctccttttgtaaattaaacaaaatgagcaactctttacgtgcagacactcttgctccaaattagagagaggaccagtgatttgattttcatttataaatcatggtctgtttccacttatggttccttgcaattacctcaggtctctcagaaatatccagtggcctaaatcactcattcacagttgattaagctcgtccactttgcagattttagcagtttaaccatcagaggaatcccatttctaatataaaagacattgagtcaatctcactcattgtaacaccaactagggaaagactcagttaaggaagaaactgcagtggctgtggttgatggcaaagtttatgaaacatatcataagtattgtatagtgaataaagaagaagtttgggatcaaaatacaattatagggaaatcagtagcatatttttaccataagagcagctgattttgtatcctgccctttgtgggataattggattgtcttgacttttttattccatctcttccacttaattttgctgaatataactctagattgataggtttttctttcaatactttcaataactcacttcactctcttgtttatatggtttctgactagaaatctatgctaattcttattatcgtttctctatagataaggcattatttcccctatgggttctttcaaatatttttctgtctttggttttctaaagtttaaatatgatgtagttctcctacttggtgttctctgagcttcctgaatatttggtttagtgtttgtcattaatttggaggaagttctagccattatttcttccaatgttctcctactctgttctctcttcttcttcaggtattccaattaggcatgtgttatgccttttgattgttccttagctcctcaatgttgtgttgttttgtttgtttgttttacttgtttgttactttgcacttcgggttgggaagtttctaatgaccaatttttaggctcactgattttttcctttactgtgccaagactactaatgagtccatcaaaggcattcttcatttctattacatttttttatttttttatggtttcttagagttttcatctctctgcttacattatccttctatttttgcatattttctagttttccactagagtccttaatatattatacacagttaatttaagttccctgtctgataattccaacatctacattatatctgagttttttttttttttttttttgagttggagttttgctcttgttgcccaggctggagtgtagtggcgcgatctcagctcactgcaacctctgcctcccaggtccaagtgattctcctgcctcagcctcctgagtagctaggattacaggcacccactaacatgcctggctaattctttttgtatttttagtagagacggggtttcaccatgttgggcaggctggtcttgaactcctgacatcaggtgatccatccacctcggcctcccaaattgctgggattacaggcgtgagccaccatgtccagctgtttttttttttttttttcttttccaacttttaagttcaggggtacatgtgcaggatgtgcagatttgttacataggtaaatgtgtgccatggtggtttgctgcacagatcatcccatcacccaggtattaagcccatcttccattggctcttcttcctgatcctgcccctcttcccaccccctgccctccaacacgtcccagtgtgtgtgttgttctccacaatgtatccatgtgttctcataatttagttaccacttttctgttcctgtgttagtttgctaagtataatgtcctccagctccatccatgtccctgcaaaagatatgatctcattcctttttatggctgcatagtattccatagtgtatatgtactacattttctttatccactcttgatggttgtcttttcactccgttggtagtttattttgctatgcaggagctctttaggttaattagattccatttgtcaatttttgcttttgttgcaatggcttttgatgtttttgtcatgaaatctttacctgtgcctatgttctgaatggtatctcctagattttcttctagggtttatatagtttttggttttacatttaagtcttttatccatcttgagttgatttttgttgatggtgtaaggaagggatccagtatcaattttctgcatatggctagccagttttcccagcaccatttattaaatagggaatccttttcccattgcttgtttttgtcagacttgttaaagatcagatggttgtagatgagtggtcttatttctgggttctctgttctgtttcattggtcaatgtgtctgttcatccatcttggcaagccaaatcacaaatgaactcccattcacgattgccccccccgcaaaaaaaatgcccaggaatacaggtaacaaagaaagtgaaggagggatgtcctcaaggagaactacaagccactgctcaaaagatccactattaccctagattactgtagccctgttttggttactatagccctatagtatagtttgagattgcatagtgtgatgcttccagctttgttctttttgcttatgattgccttggctattcaggctcttttttgtttccacatgaattttaagatagttttttctaattctgtgaaaaatgtcatggtagtttaatggggatagcattgaatgaatctgtaaattgttttggggactatggccattttcacaatatcaactcttcctatccatgagcatggaataatgtttttccatttgcttgtgttatctgtgattttttttgagcagtgatttatagttctccttgaagataagcacttaggttgagttcatgtctttgttattgtgaatagtgctgcagtgaacatatgcatgcacatgtctttataataggattatttctatttttgtgtgtatatacccagtaatgggattgctgggttgaatagtatttctgcccctaggtctttgaggaattgccacactgtcttccagattaattgaactaatttacactcccaccaacagtgtaagagttttcctttttctcacaacctcaccagcatctgttgttttttgactttttactaatagccattctgactggtgtgagatggtatctcattgtggttttgatttacatttctgtaatgctcactgatgttgagctgtttttcatatatttattggctgcgagtatgtctgttcatgtaaagggttcatgtccttcacctactttgtaatggggttgttttttttttcttgtaaatttaagttccttatagatgctgaatattagacctttgtcagatggatagactgcagaaattttctctcattctgtaggttccacattttttgttgtgacaggaatgctggaaggggttgaaatgggaacagttttcttcctccagttgggaggaggaatatcccaataaaggtgggggaaagtgattttccttggagaacagacctgagtgtatttcacaatgattatttcttcatttcttctgccagagttatgaagggattttttttttttttttttttggtgtgtgtcttcatgagaacatcgtggggattctgaaagtaaagcaaacaaaaatgtaaaggcctccccaagactatggcctccaagactttcttgtatttggtttctagttagtttccaagctagtccatccttaacctccagtactttatcaacattaccattttgtggtgtcctcatcaatttatggttccagtggcttctgtttcaagtgagacttctgttgtgtttctcttgtctccagatttaagggtgatggtttgcctagtgacttcagttctctgataggttcaagaaaagttcatggtttttagtttgttcaactttttcttattttaaggatggagcaacttgcaagctcttggcatattagagttaaaaccagaagtcctttattctgttttatagccacttttatattcctttttttggaaatgagtttctagagaaagaaaggagtccgttactaaacctgaaacttactagatttagaagttcacatcacactgagactcactgtgattctctgtgaatataacatctgtcacttctctgtctaaattctggggaaagtccagtttaggcctactcttgtggcgtgcatttatgcccctgggtatgatttaggttacctaacagttttcattcttgatcgagtgatgggaggaaagaattgcaaggactgtaaaatgaaactggccatgagcaggacccagcaagaaaagagataaatgctagatggaaactgccatttgcccacaattctaacatcttaaattcagttcttagctattgggtgtcagtttttagaagtgaaaaactaacactcttctctccccaccaaaccaagagaaaaaagcattgagacatttcttgatagtcactataaaaaataaagataaactgagcaaagattaagtatttttccttcttccaaaataagataaaacttttattataaaatatgctgctaaatatggacatgctctttgaaaaaataacagaaatcatatgcttgcagtagatttatagaatcaagtttttagaattggaatgtattttgaaggtgagtgtctttttaataacttttaaataactaattttatccagttgcaataaaggggttatatgcaaatacaccagaatgctatgggttcttctttctcattctttcattttatgtagacttggacatgtttttttttggtatgaacatgaatttctttagttttcagtggcatttattataagccagacaatatgctatttatttttttgaattatttttaaacttttgaaaagtagcatatccaataaattctgtaattataaaataaaatgatggctttgtacttcatatgatgtgacaattgttaatctccatcgcctgtttcagtaggtctcaaccttttattcattattgtcccctaaggtgcctttctagatatttttttttcctaattactccctctcccataaaattttattactattgcagatatactccatatctgcttatgtactgcagcccttgagaagtccaaaaacactgtaatatctcctaatttaccccttccccataaaccagttttcacctcttgaacatgctattatcctagttgagaatgcatgccctatttgattaataataatggttatcttttataaatcaccaaactaaatatgtaggtgctggttctagagtcacattatttaggttagtattctggagcaactctttaccagatttgtgattgtgaattatttattaaactcaaagttcctcaattttctcaattcaaaataaaaataatagcacccgaattggtgaaagtaatactgacagttgtaacaaacatccccaaatgcaggatgtttcaaatcctatagaagagtatttctcagtaatataaattccaaacagaatgttactgagtgtcaggttagctctagtccaggtgctggcttcttccaccatgcgattcatcaactgaagctcatattgtttcccaggttgcactgggagttggtatccagccattagtcaagacaagataagggaaaattgcaaaataatgaaaagcctttaggggccagtgtggaagtgatacatactagttttagccacgttcctctcaccagaatttaggtccagctatgattgccacacttaagtaaaagaggggaatgggtgggaaatatgttccatctctgtgtttaggaaagataggagatgaatttcattaatagctagtcagtctctgccatggcagttatttcatagcattgtgaagattattaaactatttgaaagatatattatgtctagaattgtctagcactacaactgggatgttttgaatattatggatggggcataaaatgtaagtttagataccgtcattatacagatgagggaaatgacaggcagagataccactatcctaatgaggatgactggagatgagggaattgatatttatggagattaagaatttgctcaatgtcactgaggtagaattttaatacagcttaataaaaatttaaaacccatttgtttcctctcatttcactgtgcttactctattcaataatttaattagttacttttgctttttaaaaggcactgtcattctgttttccatgataactcaaggtttctttaatagagtgaataaataattatatcattttataaaatgttttgggattatcataataaagataatgatgatgacatcaattcttgagttcctaattgctgtaggttcagatttttttttctttttttgagatggagtctcactctgtcacccaggctggagtgcagtggtgtgatctcggctcactgtaaacttcaccttccaggttattctcccatttcagccttccaagtagctggcattacatgcacccaccaccacacccggctaatttttgtatttttagtagagacagggtttcgccatgttggccaggctggtctcaaactcctgacctcagatgatccacctgcctcggcctcccaaagtgtttggattacaggttcagattttaataagatgacaactgaagtgtgtttcacaggggtaataaaaatagagatcttaataccaaattaagaaataaatttctccaagcatatagaaattaatctaattgatgtgtgcatatatttttaaataatttttttttttttttgagacagagtttcacttttgttccccaagctgcagtgcaatggcgagatctcggcttgctgcaacctctgcctcctcggttcaagtgattctcctgcctcagccttccaagtagctgggattacaggcgcgcaccaccatgcccagctaattttttgtatttttagtagaaacggggtttcaccatgttagccaggctggtcttgaacgcctgacctcaggtgatctgcccacctcggccccccaaagtgatgggattacaggcgtcagccaccatgcccagcccaatgctgttgatcttttcaactaactcatgttagcagccctattaaggcagccaacattttatcagtttcaaatttattcactatgtcactaagatgatggttcttgatttatttttattaatttttatttctatagaaaatctatgaattgtgattgcagttttatggctgataactttctagaaaaaattatgatatacaacaaaacttaacgaatatcagcaaaaaggggaatctacaccttcacactattctattcacgtttgcactttcttccaattttctttgtgcatacgtgtttgcagttatagcatactatactctttatattttttgttgtttgctaatgtaattctgtatttctacggagtcttcaaaattatcacttttaatggcttcaagacattctctatgctgttatataattggtaacatttaaccgtttagtaccaactttttttctccttactttttctttttcttttcttttttttttttgagacggagtctcgctctgtcgcctaggctggagtgcagtggcgcgatctcggctcactgcaagctccgcctcccaggttcacgccattctcctgcctcagcctcccgagtagctgggactataggcgcccgccaccacgcccggctaatttttttgtatttttagtagagacggggtttcatcgtgttagccaggatggtctcgatctcctgaccttgtgatcagcccgcctcggcctcccaaagtgctgggattacaggcgtgagccaccgcgcctggcctctcattactttttcttacatgtatactttcttcttaacattagtaaatgtaggttgagaagttattttcgatttttgtcagcatgacattttgccccagttgtgtctctttttctgtctatagttgctacctatcaatatttttaaaaaaattctgcccctcttttaagccataattatcactcattcattcattgaatttcttaagtgtttctcttcattgtagttttaaatttttctctttctaaacactttatagttttctaaaaactttagcattcaaataatatcctggttttattgccttacagtgcaagataattcatattgaacagcttgttattttactgactgtaaattgattacattctcaaatctcattattgaacattttgtagagccagtatagttaagtatagtagtccgtctttacatgggggatacatttcaagacccccagtggatgcctgaaattgtagatagtactgaaccctaccctatatatgctatgttttccctaaacatacatacttatgataaaatttaatttataaattaggcaaggtaggagattaatgaccagttattcagaagatagagcatatgagagtgatgactgataaacctgtaaaagattttccacattccttaaaatataatgcctttaaggatatgaaactaatttatttcataacagtagctacattactattcttggcatatgaaaaattgaatgttgagaagtaccactataaaattttaaaaatgagaagtcatggcaaatatataccttataacttatatcaatacagaggtgccataagacattaaaaattatcattgctttctgatattagtttactattattttattgtttttgttattattgtcagtttagcatagttaaaaatatactgtatgaaaaatatgatagttataatgctgttcaccaattatttccaactctccgttcttttttaacacatggtaggattgcactttttaggggctccatttggggagatagggctttaagacaggttctgtccagtgggtttggaacagacatatcttctggccagatttcattgccagtatgacattctcaagctcattttcttctgccacaggtagccacgttacagagagtgactgttctgctcatattgatcttgatatgcatataggataaacaggaaataagtctttgcttacttttacttaaacaactgtgatttggggattgttaacatagcaaaatcaatcatcttctgctcatgacagaaaagtcagtttttgttttatttgggcaatttgctcatctaatatttgctcatcttattattatcctagtagcaatttataacaaatggttcatgaagagttctgatttcagattatttatttcccacgtagcctcagtaggataatgtggtttggttaatttggccccctattacttgtacttcaacaggttaattttataactacttattttataatgtaggtttcattgcttttattcagaattaaaatgtgtctttgcatagtaatatttcatttacaggataaatattcattgaataaattctcaaatgcacatctgttacctttgaaaaagttctttcttccctaagtttcatttagttcttaccttacttagatagatatccacaagtttatcatgaattctttaaaaataaactcttaatctaggcatacttatttagtggagcatagttcagcatatcatttatggaaaaaattgttttgacactaaattacaatattccctaatttaaaatctctgctttttcttttttttcctcctgagacggagtcttgctttgtcgcccaggctggagcacaatggtgggatctcggctcactgcaacctctccctcccaggttcaagtgattctcctgcctcagcctcctgagtagctgggaccacaggcatgggccaccacggccagctaatttttgtgtttttagtagaggtggggttttaccatgttggccaggttggtctcaaactcctgacctcaggctatctgcctgcctcgacctcccaaagtgctgggaccaaaagcgtgagccactgtgcctggccaaaatctctgcatatcctttgaaaaattaaatataaatataacttgtattaatatatttgaatttcaaatacatttggaagcacttagtttttagggcaacaatactatgaattcttttggaaagccaagatttattttgtccctttattcttaagaataaagattttataaaatgactcctttccttagactgaaaaatcatattacattacacattacatatatacctaaaaatgaagttaaatttaatatcatgttacatcagagatgtagctgtaagataatttataattacaaattatttttagtaatgtctcctaaattagagctaagagtggtaaaataatcaatataatctctattctgaggtttaaacagatgactccaggaatataaaatctgaggtagacacttcattagttgagtgaagtttctgtaacaaactgtaaagaaaggttgatgtcttatgaaatgtgaaaggttgatgtcttatgaaatgggagtggaccagaaaggaacagctgctcactaccaaaaagaggtgagtgaaggctctgcctgtaaagagggccacattttcttttaagaagtcaattttaagtcttctggtagattgcgttgtagttcaggccatcatcatttgcctcactctcatcatgcttactgaaatgagcaaatgaataaactccagggggaagtcccgtatcagcaaggcatcatatgccacagacttctactagttatagggcatatacactgtgtaaagtgaaaataacaagggtaacttactaacctcctcagtgagaggctgtggcaaagtcagtaagaggaagagaaagggtaactgttggctgaacacccaagagtgtggggtaaagatggggcgtgaaggtgaagctgggctatggacaaagaaagaccaattacttggaacccatttcactatcatttattgacagcattctaaccatccccatcagtgactgctgaggcaatagaaaccactttcaaacagattaaaacagaaattaactgttctttcaacctatgtttccttaaaatatatcatgccatagtgtgagtttttaaagtttggggaattttagggctaaaacagcaggtgctgagcattaagttattcaactattaatttaacgcctcataactttagttaatgtgacaactaaaagaaattaaaatataataaatgtttcttaaggagaaatcttattaatctttattaaaggtaagggtaaagtaagaatatatgataaaaatctgaataaaataaaaaatactagttaagcgcatgtctacaggcaccactttaaacattttctatgtataagtatatttaataatacattattgttattatttccatttcaaaaataaaggaagttaaggacagacagattgggtgatatgctgactcctatatgttggaatttgaattaaatccaatcagtattctctacctccccaagtctgagtatgctccattgccttcaaaaaccagaagcaaatatctgttaggatcataattgtaaatgagttaaccttacctgttgaaagactaaggaaaaaaaagtaaaccgctgagtaaaataaaatgatacacagagatgataaattaaagtttagtcaaagttatattaatcaagtacagataaaagaaagcagagattataatgttgatttcagattttaaaaaataattcatagcaaactaaaattgaatgtttccaagaaggccatttttattgcagtgtaaaatcttagggattttacaatgactaaacattacattagtcattttatatatgtgccaaatagcttgataggtatattgtaaattcagctttataaatttagagattatattattaactcaaattggatttgcaattgttatatctacctgttgaattaaacctgtatcattttgagttgttctcttttttccttgaactctcttgtctaatatttatagagttacactaggtttctttggcttcatatgtgcatggttattatttttcattcttttttcaacctttctgtgtaattgtgttgtagaagtcttttgtaagtggcttatagttttgtttttttaatctagttctcatttgtttttaattggagcattaaatcaatttatagttgatgtaataccaatgtgtttgggtttaaatctgccatctggttttgtacttgctgttctgtgtttagtattttttttttactctcttttcttggtttcctttttattacaaaagcattttcaattaaattttttccctaagaattttggaacttacagattgtttactaattttggagacagtacagattctgtcttatatacttctagttgaatattaataaattcatttgtcttccctttcaagaatacaaggacattagtatagtccatttgcacctcttctgactgacatgttactattgtatattttaatttcattctgttatgatactaacaagacattatcttattgttctgttcaattactagtttataaatttactcacgtatttaccatacccactgatcacctcacataaaattataaatacctctacaggtacactcttgatccctcctgtcttattttgcttatttcttttttttttttttttttttttgagacgaagtttcggtcttgtcgcccaggctggagtgcgtggcgcaatctcgcctcactgcaacctccacctcccgggtgcaagcaattctccagtctcagcttctcgagtagctgggattacaggcgcccaccaccacgcctggctaatttttgtattttttagtacagacagcgtttcaccatgttggccaggctggtcctgaacccctgacctcaggtgatccacccgtctcggccttccaagtaatcctgagtagctgggattacaggcgtgagccaccgtgctcggctgcttatttcttaattctacaaatttgccagtatttaacatgccgtattgttgtttttttgagacggagtctcgctctgtcgcccaggctggagtgcagtggtgagatctccactcactgcgagctccacctcccgcgttcacgccattctcctgcctcagcctcccgagtagctgggactacaggcgcccgccaccacgcccggctaattttttgtatttttggtagagacagggtttcactgtgttagcgaggatggtctctatctcctgacctcgtgatccacccgcgtcagcctcccaaagtgctgggattacaggcgtgagccaccgcgcccggctgtattgttgttttttaaaaaattattttagtgtttattgtatctcctcttccaactaaaatgtatgttctgaatacactgacattcatggattttttcctagtgcttagaacaatgcctggcccctataggaagcaccaattatatatttattgagtgaaagaatgaatttattcttaagtgtcttacactccatcctgagatcaacttccttctgtccaaagtatatcttttatgttccctttgtgaagatttgctgatgtgctcccttattttttccctagaaatatcttatttcatcctaaaaaatgtttttcagcatacaggaatgcttttattatttaatattaagacatttaagatattaattctctgacacctgacttccattattgctgttgagcagtctgctgtcagtcaaactgtccctcctttgtggtaaatttgtctgtcttctcgggctactactaaaaacttcttttcacattctatactcttcattttcacagtgttgtatttgttgcgcatttcttttttaattaacttgtttttgggttcattagatctcgtcttgtcttctatcacttctagaaaattctcagccatagcatcttcaaatacttgtctctgtcccattttcccactgttctccttttaaactttaaatgtgttagaactcaatctgttcttcatgtattttaacttcctttttagatttttcatctctgcttctgctgattcttattcctgctttttctgcttcgtggtaccttgcctcttgcatgcttagttatattttagtgtgagcatctctttttccttgggaaattatccatgggaatatttgaggctagaatgaaggtgtattcattccttcagaggatttacttttgctacctcccagagcactccctatatgagagtagtttatggaggttgaaggatgttttgtctgctcagttgatatgtattaatatttggacagctctgaaccaaagcagctttttctttttttcagcttccttgggttgtcaatgaagtaggtgcacatatttctgggtcgcatgtgccctctgaggatacagttatataattgagaatctcctccttgattttccatgttggctggaaactggattttactttatttctctcttaccaccccacagtcatcccaagcttcctgcccaggttatcagtctgtgatcatggaagcttgagctctccaagcttggcagttatctaagaataaggaattctgtctttactcttttttttgtcaggtctttagtgagatatttatacatgtaatcacaaaataatatattatcattacctagtttttaatactttttagctagagactccatctgacaatggaatcatccatagtatctttgtgtcattgttctctacaaataatgattttaaatcaatgggaagtattaggaactgtttaataataaaacactgggagaagtggttaatcattaagggatggaggaagactttgagaaggaaaaaggctgataactatgtgatttgaatctaattcatttcacactgcaactggatacatagtttggcatatggtggtttaaataccatacatataaggtgccattagatacacctttaccacttccatattaacatttctggtgactcacaagaacatctgtaacaaaattctggcattcatagattttcaaacaaaaatacatgtttacttttaattccattttgcctatttttaaagttttatactcatttatggattttgggtattgtatgacatacgttgatttttcttcatttgaagatcaaacataaattcacctacacaacttttccaaaactgttatggtttcacgttttcaacttctatttgtgaattagctttttctttttttctaaaaagttaaccagttatacaatgcaattaattaaatgcagatgtctatgattttaaaaaactatctatactacataaattaatttgatctatttctgatacattcatattttaaatatgtagctatttattttttttcttttgagatgaagttttgttcttgttgcccaggctggagcgcaatggaatgatcttggctcactgcaacctctgcctcccgggttcaagcaattctcctgcctcagcctcccgagtagctgggattacaggtgcctgccaccatgcctggctaatttttgtatatttagtagagacggagtttcaccatgttgactaggctggtcttgaactcctgacttcaggtgatccactcacctcgacctcccaaagtgctgagagtacaggcgtgagccactgcacctggcccaactatttcatacttattaaatatcatgattttatatttaagttatagatatattcatacttttaagaaaaatagtatatctgcattttccaaaattgttatatttaaaaatagctttgaattttgcgtacatgtttcacttccttattggtatgtctttagtatatggtgctttattcaaatgccataattataaaaatatcttataataatcaactttaaaaagggacatcggtttgattttgaaaaatcacttcttgaccttaaatactagaatgtaataataaaagagattatttgaaatggtgaactgagtacataaaatttgatggtacacttttaacacagatttttctattgttcatgtttaacttaagaaaggtggtaggtttcatctctttatgtcttgatttctcgtacaattgcttcatgctgttatgctaagatcagaattacagatctttcctggctgaaatgaatgatcaacatttaattgactaagttcctcattgtttaagatgctttgacttgtggacgtcagatgcagggaaacagatttactgaaattctgacccctggcatattttttgtcatagacacatagatattacttgaaaccaaatatgtatttttcatcatactttatccattaagccactgaagtcttttggaatattgtcttttatttaagtgccatccatctaaagccgcctgaagttgcagagttctgcaattactgacagtaatactctctgaaaaactatgttaatccagtcttatgccacttaacctcattttggtcaatgatgaaccacatatactatagtgtcccataagattataacagagctgaaaaattcctatcacctagtgacactgtagccgttatgatgtgttagtgcaaggcaatactctgtggttgtggtgatgcttatgtaaataaacctactgcaccgccagttatataaaagtatagcacagtccgggtgcggtggctcatgcctgtaatcccagcactttgggaggctgaggcaggcagatcacccgaggtcaggagttcgagaccagcctggccaatatggcaaaaaccctgtctctaccaaaaatacaaaaattagctgggcgtggtggtgcgtgcctgtagtcccagttactagggtggctgaggcaggagaatcacttgaacccaggaggcagaagttgcagtgagccaagatcgcaccactgcactccagcctgggcgacagagcaagactccatttcaaaaaaagaagaaaagaaaaagtatagcacatatgattgtgtacaatacgtaatacctgatagtgataatagatgactgttcctggtttatgtatttactgtactttttatcattattttagagtgtactccttctacttatcaaaaaaaagttaactgtaaatcagtctcaggtcctttaagaagtattccataagaaggtattgtcataaaaggagataacagctccatgcatgttattgcccccaaagaccttccgggggacaagatgtggatgtagaagacagtgatattgatgaccctgaccttgtgtaggcctaggctaagtatgtgcttgtgtcttagcttttaacaaaaaagttcaagcagtaaaagataacagtttttaaaaatacaaaaagtcttataaaagaaatctataaagaaaatattctgtatagctgtacatgtttgtgtcttaacctaagtgttatttcaaaagaacaaaacagattttaaaaaatttatgaagtaaaaatatagaaagctaaggttaatttattacttaataaaatattttttataaatttagagtagcctaagtgtacagtgtttataaagtcgatagtaatgtacactagcgtcctaggccttcacatttactcgccactcactcactttcttacctagatcaaattgcagtcctgtaggcaccattcatagtaagtgctcaatatgggtataccattcttatctttatactgtattttttgcacaaattttctgtgttcagatacacaaatagttaccattatgttactatcgctacaatattcggtatggtaacatgctatacaggtttgtaggctaggagcaacaggctagaccatatagcctaggtgtggggtaggccctgctatctaggtttgtataagtacactcaatgatgttcgaagaaggataccatctcagaatacatcaccgtcttgataccatctcagaatacatcaccgtctttaagggatacatgactatggtttagcagaaagatcatttatttgtctgtaacgtttgaatcagttcatctgatgatcaaaatcttgccacaataaaacatattctgtcattcagaagtatgctattgagacagctgaactttcacctttgctttccatataaaactcagggttctatagcaattaatttattcaagttggacgattattgttaataatacccttgtctttaaaaaagttattgacttaatccttttggattatttaaaaatgtatcaattcttttttttcttccagtatccattataaacttacagcacagttcatgaatttcaggttacaaaaaatagacatagagttgttaacagcatagttcatgaatttcaggttacgaaaaatagagttgttttcctcaagaatattttatgaaatacttttaaaaggaacatattcctaaatgaaaaaatatttcattgtgcatgtttcagaagcacttttattcaggtatgattaatacatagaactggaatgaacatttgttcatattctttcagataaaacacaaataggagtatatacatgtctttaaaaagatataagtaaatttgcattaaaagtttatgttcttttccaagtctatattttctctttttattaagttgaaaaaaaatgaagaaataattaataagttttatttcattagttctttgtaaaatattattagaatatgtaaaaatagctcatgctactgaaagttattaattggatatgtttactgtgtttatttttatgtatatcattcattaacatataaataagaaaggaaatctgaaagtaagcgtaaggactattatacataatcttgtgtaatttcccaaattcagaaatcaatacatgtgatataattactaatacctagatgatcaatttaattcttttttagatatgtaatataaatagaaaatttcttagggcttaagtaaaaaacaacagtgttttagtttttttctgtgtgaaaaaatactttcatttgcctcattctttacctgttaaaaagcctctcagggtggggcgtggtggcacacgtctgtaatcctagcactttgagaggcctaggcagggggatcatgaggtcaggagatcgagaccatcctggccaacaaggtgaaaccctgtctctattaaaaatacaaaagttagctgggcatggtggcgggcgcctgtagtcccagctactcaggaggctgaggcaggagcattgcttgaacccgggaggcggaggttgcagtgagccgagatcgcgccactgtactacaccctgggtgacagagtgagactctcagaaaaacaaaaacagaaacaaaaacaaaacaaaacaaaaaacactcagaaaaactttatttgctcccacttattttctactttttcttcttttgctattatatttatatttatgtttaatggtcatttatatttaatataaatctatttatataattgtatttaatggccattttatatttttctgtattctcccagttaacatatcctggcagcataaatgaaatttgatgatttcattatcagttatccaaacaagctttcctatccctgacctgtgaatctgtgctaggtggggtagattagaagcttcaggatcttgtaagggtgacgtgacaagggcagataactgatggtcctgatagcacccagagaaaagctacgttaaatctctgtcctccatatagctgaagtagtgtctagtatcagtttatggttcttcacttgaaatgagaatatgttgtatactatagatttaaataaaacaaacttagatttaaactgcttaagctaaagatcttggctatttagctataatttttagtgaaaatatcctagtttattgaatcttacctagatattctttttataagtttgattttattttgttctccttctttcctttttgtcatttctttacttaggctataaatttattttaaagactgagttttctcttgaccaattctttccataagttcacctgttttttatatgacttacactataagagcctatgtagacactcaataaatgtgttttattttgtagcagaatccatgacttattatcagtaaaaccctggttgaggtacttttaatcttgttttccacacctaaacctatctagccctgttgcattgtatcccgaggcccagcattattcaatattttgtgtatttacagtaagccaagtggagtacttattgtatcctggaaataataactatgtcgactaataggcatcaaaataagaattaatttttactttgcaggacaagtactccaagaaacctgagttgttaaggtggtaaacacagaaagcactatacaaagtatttgtaaagattaacattgctacagttatgcaagcacatatttgccttaacaagattagtaatgccagctgcctgcattcaaagagacaatttaacttcaattttaatattacctgaaacagtgtaaaatgacaagagttacatcgaaatatgtatcacaatttcaaatgaagaaattaaagcatacctttatgttatctgctgtgacttttataaatgaatgaaatggaatatatgaatttttattatagaaagctatttgtccaaaattaaaataatattttattacaatatagtttttactgatgtttttacaagtattgtattctctttgatggtaggttctcttgttggtaaattccaatcgattaaaaattcatgttcctttgtttaggcgttggtcatagtggatggtgaattgagtcacttcctcacctctctctattcaaccttttgtgctgcacaggctgtttcctaggaccacttgaagcttgagttctgttcataatttgggttctgccaattagatgcacttgagtaaaatgtggaaggtggaaagcagtctaggctatgtttctaaggtttttctgctggcagactcctgatagaattatctgatatctgtagagtgtcttaccagaataatgcttcccttaatatgggttgcatcctcatcataacagcttcctaatcatggccagcttctggaccaccgatgatacattaactccttgggtcatctagttctgtgaccctcacagttgttctgttaaatgcaatgtaaagtctgttttcagccttcaatatgattcagaaagttatttaaaatttcataatgcattttttatgtttatactacaaaaatgtagttggtctctgcatttaattgatacaattaacaataatatattttaaattttatttacttcaattgttaatttttttttttactaaagaaaatgtacttatatggtaaatgttataaattttatttactatagttgctgcctctacatttatttttagggctgacatagttatttaaaacctggtcataacctagttaaaatttctcctccacgtatggttgcttgcaatatagcccacttgttcctcatcccactgaccctaaactcaacataccccacagctgctaatcacgagaaaacctagtgttcaatattagaataatgtaaataagttctcccttcacacgtgttttctttaaaccagctaatccacaacctctgagggaaagcctaagtggtaacactcataggccttaataatggtgtagccacccaggttctctccatcgtttcctgctcactgggtgaactccctgccacctccagtcttaccgtcagcctcctgttgtcaccccaacctctctggaatctgtgagtaataaatatcttctattttctgcactgtggcttcacttccttattgtgtctcccctgacgcacacgcacgcctgaacttaaccttatattcagccagagctcttttgggcagtggctgtcttgacaagaataaacaagggtatctgctgtataaacaagtttcctgtgaaaggacgacctggtcacagtgagatacttaggcattaggccatcatcaggataaagaaatagcccaaaaaaggcatgctacaaactctcaggcccagtttttttactttccaggtcagaacagggctggagcttatggccagtcttgagagagaccacaaaaccaaattggaaacaattcataacaaattaaatcaaaactgtaaactaaaccgaaaaagtaaaggtgatacctataattaaaggtagcaatttattggccccactactcccactccaaattgccgtagctagaaacaattgctttttaatttttctgggttttgttattttggtggttacttcatatctctgaataacacacgtattccaacaatcatgattttctcatgcgagacatattccgttgatttttctgctagactagataaggactttgtcttcttaaccttcttcccagctcctctccccatagccacccaatgtagttatatcaccattttaatttctttattatgtttttaatttaaataatatgtacttttatcacctttccatcagctctagaaatatgatttttgactcccctctttgtaagatattatcagtgctaatcttccctgacctttctctcctctaccattctttcctccacttctgtgtttcttctgtagttataataaatagtacattttctttctcttgaaaacttctaaaatgcttaaggttttaagctttctttaaacatagtgagatcggaaaataaaggccttatcgaattactcatgattttatcttttctcatggtcatttaatgcctgatctttcaaaagtttcactttcttttactgacattcctctgttgccttggttttgtatttgctgccttcttactctttttctctgctttgtattttgtgaagcacaaaaagctacacagtacactaaaacacaactaattatacttcacattaatgaataggctaatgcttttccggtgtggtgggggagtttccaaaacctagattaggaagactatcaatttgttgactattcagttagcagtagaataagggaacagtatagagagactccagttccctttcctagccaatgaataaaagcttacaaaccatcgtcttatgttcatagattgttttccctaaatattttacatgtatttatatatactgaagttcattagtcaattctatgctaactcaaaaagttattattttttcaatttttttcttttttgagacggagtctcgctctgtcacccaggctggagtgcagtggcgtgatctcagctcactgcaagctccacctcccaggttcatgccattctcctgcctcagcctcccgagtagctgggactacaggtgcccgtcaccacgcccggctaattttttgtatttttagtagagatggggtttcactttgttagccaggatggtcttgatttcctgacctcgtgatccgcctgcctcggcctcccaaagtgctgggattacacgtgtgagctgctgcgcccagcctattttttcaatcttatgctatttatcttactactttctttctcataagtgcataggaaaatttgacactgctgagaaatcactgaactgtttgtgggataccaccagattatttatggttctataagatatttctcaggccaggccttttataaagcaattttaatatatgtatgaattattatatgtcatgtaattattctataattttagaatgtatattcagattaagacattagtttcatgtaatactttcaggcatgctgaagtcccagtagctacaggtagggaagaagcaggaaactgtaaacaggtggacccaggatcaggtacctcacatagctctaggactagtactacagagagtaatagtagtatagtcaacactgtacagtgtggatgtaatatggcagcaggttcttccaggacaggtgaggatacttgcagattgactggtaccatcactgcaattgtagatggcatgaatgacttagacctaactaggaacatgaagacatgtgtggtcttaggaaaaagggttgagtagatatggccagattatcaggaatcaggaaaatgctctaccttcataagaatgataaatcacagtcaagaaacaaaaggataattccagttgcatgttcagcaagccgtgacataggttagaagcaaagtctgcagctcactggacacagagatatcttgagagttaattctaacctagtatttatcaaaaggtgatctattataactctctggaatcctggtcaaaaactaagataattaggcctgttccaactcttagacttcagatcaaatccaataatctctgtgaacctccctgagtgatccttatgaatcttaaaatttgagaaccacatctttagacataccagatactaagtttagaacagaaagacaaatttgaggcattttatttcacttgcttactaccctttaccaaaatattgaggctagttttcttaatttactcttgtcaatgtggacaaaggcctgaaaacactgtgcttatagtttgaaagcatttatatttgcagtgatgtggagctggaaaatgaggatttgctcatttttatttatttttctatactagttgagtgttataataaaatataaaaactcattttagcttcatcttagtctaatgtgcttttcatgacaagtacttaaagattatgtctagtcagtgtagcttcataattgatgtaaaacaatgcagaaacatattaaacatatgacagcttatgagatctaaatttgtaaacttcataaatattaaaaaactttcatattttaaactttcatattttaaaataaatatgaaacctacgatagtcttacattagtcaaaatgaaataaaattaatgtatcacagcccaatgactagtttcttctcattcacctgatgaatgcaagaaagcctgttagttggagtaaaatcatctggtgtgtgctcagctgcatttaactgtagaggccttaagacatgttaagcaatgtgattttgatttcacctgctgactttccgaaggcaacttattataagaaacagttgaatagtgatatcatgctgttggcacttgagctttctgctggaggttgcaatctaatctttgcaaacctgtaattactatttcctaagtaattctaggtttccattattgaatctctaaatgtctaaaaggtactgagatgtaatatacaaaaaggcatagggatcaaatgataacaacaaactctttgtgtcagtaatactcaatttcgatgtttttgatgttataatgacatgttactggcaagaatatttggtgcattttgcaggttcagtgtatttttttatgttggtgttatgaagtctttgaaataaaaagatgttttattccagggttatcaatccatgcatcacagtttagagaaataagtgaaagatagtgattctactttgaaatttaaatgtttgtctctggttattcaagttaagtattttaaaatagttttgactgatatcatgttatatagaaaatgtgaagtcataggtgtctgtgtaatggaatatgaaaaacattgtttattaaaaaaataaaatcctggtagagacatcatttctcctttgaaatatatagataagtgatccactaaaaaagtaaacatctcaaacacaaagtttaattctgcttgtgagaatatgccatacattgcactttttttgtgaaagataaactactcttttttatcatttcattttaatgtgtttcatgtactgtcctaggcacaaggaatagaatcgtaacaaggacagggtttgcttttgtagagcatagattctaatggagaagatagaaagttaaaaagcaaacagaaatttcaagctgatgataatgatgactgagatgatagctgtcacagtgaagatgataggcagtggactttagtagatattagaaagatatacccaagagcactgcatgagatatgtaactaatagagaggaatctgtaataactcaagaaaataaagttctgtgaccaaattattcagacatatatgataaaatattataaaatagtagaaaagaatatttgcagtccctgtggctgcatttaaccatctaaatatatcaatatctatatacctatatatgaaaatccctatctaatgaaatagtttaaaaatcttcccaagattatgcagctacttaaatggctgagtaggactagatctgcagacccctgaggccagcctcagatatcagtcagagtgaacataacaaatcaaagtagtgtccttccacagaggagttaaaatatttaaacataagtaattttagcaatccaataggtgttaaaaaaaagaaaaaagtctatgggccaggcacgatggctcatgcatgtaatcctagcactttgggaggccgaggcaggtggatcacctgaggtcaggagttcaagaccagcctggccaacgtggtaaaaccccgtctcaaaaaaataaataaataaataaaaattagccaggtgtggtggcatcctcctgtagtcccagctattcggaaggctgaggcaggagaattgcttgaacctaggaggcagaggttgcatgcagtgagctgagatcacaccactgcactccagcctaggtgacagaaaataaaaatctatgcccagataaatctttagactaattgagcaaggcctttgcttatacatctttggtgtaccataggtttggatttgtagctgtagactttaacttttgcttgtctatagccactgcattacaaagatgcaaataccagacttttccaaacatgttaatatgggatctctgggagcgggaaccccctaaatggctaatgtataccaggccaattaaaatttaacggcctaggatatgtgtgggtatgcatgtgtatttatttaaaaagacactcaaatagtttttttttatatgaagaaagtaaagctttgacactgaaattaaatgatgtaataactgttatattcagctaatatctcaatgatggctttgaggcagttgatagtagatagcttttttaaagaagtgtttttgaatgtttagcatatgaaacccttatggtgttgtctttatagagcaaagagggaataaagaaatggaatgtaaaaaatcctaaatattccacataaaaaagcttactagaattaataaatgtattcagcaaagttgcaggacacaaaatcaatatgcaaatatcagttgtgatttcatatactaacataaatctgaaacggaaatttttaaaaattgggttaaaatagcatcaaaaatacatagaaatataaacttaacaggagactaaagacttgttctctgaaaactacaaacatttctaaagaaaataaagatggtaataaatagacatatatattcatgaattagatgacttaatattgttgtccatactacttaaagctatccacaggttaaataccatccatatcaaaatacccatagctgttttttttttctgaaatagaaaaagcaattctaaaattcatatgcaaccgcagagaaccaaaaagagcccaaacaatctaaagaacaagctggaggtcctgcacttcctgacttcaaaggatattacaaaattacagtagttaaaacattatggagaaatagttatagaaatatggtggagtaggaagcaccaggaatctgtcttcccacctagagaacaattgtactggcagaatctgtctgatatataactattttggatttttgacatctactaaaggcttgcaacttctaggggaaagcttgcatggcgaattatgattaatttcagtcaatttcagcacttaaccacagtagtagctacccatttcccacagtcacccctgtagcaggcagctgtgcacatgttactggagcagtctgcacagagcatgcaggaaccagagtgggcaaaaaaaggacctgtcatccaaatatcggcaatctttgctctgattgctgattgctgtttctggtcacaaagatggacgcaaagaggtgagtggttattgttgcacctctatccattattgcaagcccctccctgctggctgaagtgacttccagaagattaaaagggccagtgcccttctcctactttatttttctgtttttccccctttgacagctagacattaaaaagtagggcattcaaagtaactgcacatatggtgacaatcagaaaatgactaagttactaagtgtaaacttaaggactgtcttttctaagcctgtgccttgcctttcctttggcacaggcttagaaaagacagtctttaagtttacacttcagactgattcttggcacagagatagcctacaacagaatcctcttatgacaatataaaaagcaaaatcattgactgaagtaaccgcaaactctcagtaagagggagaatctaatttttagagttactatgttattagatccaaaatcacaattcatacaaaaaattaagaaactatgtcttgtccaaaggaaaatatgaaatccctaaaatgacttgatggtggatctgctacagagggactttaaaataattgtgttaaatgatcaaagaactacaggaagatatagagaaagtcaagaaaatgatatatgaacaaaatgaaaaaaattcaatggataggaaacctcacaagaagttaaaaaaaattgggagctgaaaagtacaacaacttaaataaaaaatttactagagcgattcaaaggaagatttgagcaagcaaaggaaacagtcagtaaacttgaagataggacaatggaaatcaaggaacagaaggaaaaagaattgaaaaaagtaaacagagtctaagggacctgtgtgacacaatcaaggagtcacaggaggagaggagaaagagaagagaaaacttgaagaaacaacggatagaacctttccaaatctgataaaagacattaatataaacattcaagaaatccaacagaattcaaggaagatgaactcaaaaagacataaactgaaatacattataatcaaagctttaaaaggtggagacaaagatagaatcttaaaagcagcagaaaaacatcaatatattacttataaggaataatcagtaagattatcagtatatttctcaccagaaacgttgcaggccagaaggcagtgggctgacattcgaagtgctaaagaaaaacaaaaacagaaaacattatcaaacaagaatcttatatccagccaaactgtccttaaagtgagggcgaaattaagacatccccaggaaaacaacagttgggagagcttgttaccattggacctgacttgcaagaaatcctcctgcagagtgaaatgagaagacactagacagtaacttgaagttgtgtaaagaaataaagatcttaataaaggaaaatacatagaaaattataaaagcttatattattgtaacaatactttttaactgcacttttcgtgttctacatgctttaagaggttaatatatatatatttaaatttgtataaaagttcatattatgctttgtaactccaattttgttttgtacataatttaagagactaatgaatttaaaatacttacatgtttatatttttgtataatacataaagatataattttgtgacatcaaaaattgagagggtgggggaatggagcttttgaaggagccgagtttttatatattattgcagttatggtggtacaaatttaaattagaatgttatatatgcaggatctaaaatataatccctatggtaaccaccaagaaaatagctatatacaaggaaatgagaaagaaatttaagcaaatcactaaagaaaataaaatagacaactaaatataaaagatagtaatgcaggaaatgtagggaaacatctataagctataacgaattcaaatagtggctgggcgcagtggctcacacctgcaatccctgcgctttgggaggccgaggtgggtggatcatgaagtcaggagatcgaaaccatcctggccaacatggtgaaaccctgtctctactaaaaatacaaaaaatagctaggtgtggtggcacatgcctatagtcccagatactcatgaggctgagggaggagaatcacttgaacccaggaggcggaggctgcagtgatccaagattgtgccatggcactccatcctgggtgacaaagcaagactctgtctcaaaaaaagaaaaaaaaaagaattcaaaaatagtaaaatgacagaagtagcttccttcttttcagaaattacttataaattgattaaatgagctaatcaaaagactggcaaaatagatttttttaaaaaagatctatgtgtgtacaagagactcattttagatccaaagatgcaaatagattgaaggtagagggacagaaaaagatttctcaggcaaataaccaaacaagagcagggtagctatactgagaacagacaaaatagactttaatcaaaaagtttacaaaaggcaaagaaggacattctatattaataaaaggtttaatacagtaagaagttataacaagtataaacatttatgaacctagtaacagatcactaaattatatgaagaaataacttacataatggaagggaatgatacacagttccacagtaatagttgaagatgaataaatcactctcaataatggctagaaaaaaaaaacaaagataaataagaaaatgcaatacattaaaaaaaaaacaattagacctaactctgtgcaacaacagcgtacacattcttctcaagtgtacatggtacattttccaaaatagactatatgttacttcataaattaagtctcattagattgaaaagatagttatagaaagtatcttctctgatcctaagaagattgtcttagttcattttttgctgttataacaaaatgccacacactggataatttatataaaaatgttttttcctcacagttttggaggatgaggaatccagaagcatggtgccaacatttggcaagggacatcctatggcagaaggcattagatggcaagaaacagagaaagagacagacatcaggggctgaacttgtttataactaccccgctacttcaataatgacagtagtagttttagtccttatggcaggatttatgggaggactctgcctgtatgacccactcaccccttatttggctccatctcctaacactgttgcattggagattaagttttcaacatatgaattttagggggacatattcaaaccatagcaaggatgaagttagaaatcaatataaataaaaccagaaaaagttacaaaactttggaatttaaacaatacactcttaaacaatgaacgttatcaaagagaaattgtaagggaaattcgaaaatacttggagatgaaggaaaatgaaaacaatatatcaaaacatatgggatgaggaaacagtgctaagggggaaatttatagctataagttcttaaagatctcaagtcaacaacctagctttacaatgtatggaactagaaaaataacaaattaaacctaaagctagcacaagaaaggaaataataaaaattcgaccagagataaacaagatagtgaatagaaaaacaacagaataaaccaatgaacccaagacttggttctttaaaaagatgaacaaaatttacaaaactttagctaaataaactaataaaaaatgagagaaaagattcaagtaacaaagtcagaaatagaaaaagggacattcaggctgggcacggtggctcacgcctgtaatctcagcactttgggaggctgaggcaggtggatcacgagatcaggagatgagatcatcctggctaacatggtgaaaccccatctgtactaaaactacaaaaacaaaaaattagctgggcgtggtggcgggcgcctgtagtcccagttactcaggaggctgaggcaggagaatggcatgaacccgggaggcagaggttgcagtgagccgagatcgtgccactgcattccagcctgggtgacagagtgagattccgtgtcaaaaaacaaaaataaaaacaaaaaaacaaaacaaaaaaaaaccctacagaccaatatctcttacgaatattgaggcaaaaatgctcaaaaaatactagaaaacagaattctgcaacatattaatgtatgataagccacaatcaagtgggatttcttcttggaatgcaagggtgactcaacatagcaaagtcgatcaatgaaatacaccacattaagagaacaaagaagaaaaaacacacatgattatctcaattgcagaagaaaaagtatttgacaaaatgcttagagtagtcaaaactgtaaagccaaaaggtagaccagtggcttccagggactgggaggaagggagaatgaggagttactgtttaaggggaatagagtttcagtttataaaataaaaagagtgatggagatgaataatggtaatgtggttgtacaacattatgaacacatttaatagcactgaactgtacacttaaaataggctgataaattatatgttatgttcattttaccacgataaaaaatggagaaaacaacaaaaaacaaacagtatggtactagaataaagacagctatataaaccaatgaaacagaaaacagaacctagaaataaacccacacatatgcaatcaaattatcttcaacaagggggctaagaacacacaatggagaaataatagttgtttcaacaaatgaatttggaaaaactggttaccctcatgtaaaagaatgaaattgaacccttaccttgcaccatacacaaaaataaacagtactaaaaattttaacaaagacctgaaactataaatcctatttaagaaaacttaggggaaaattttataacatttgtcttggcaatgattgcttggataaggcaccaaaagcgtaggcaacaaaggcagagataataagtcgaactacaccaaactaaaaagcttctgtacaacaaaggaagcaatccaacagagtgaaaatgcagtccacggaatgggggaaagtatttgcaagttgcaaatcttataaggggtcaatctttaaaatatggaaagaactcctacaactcaatagttaaaaaaaccaaataaccttatttaaaaatgggcaaagaacttgactagacatttctccaaagacataaaaatgttcaacaggtgtatgtaaaggtgctcaccatcactaatcaccagagaaatgcaagtcaaaaccacaaaatatatcacctcacacatgttaggatggctgttatcaaaataacagaaaataaaaattgtaaggatatagagaaatctgaatccttgagttgtgttagtgtgaatgtaaaatagtgtagcctcaatggaaaactgtttggaggttcctcaaaaaaatcaaaaacagaactatcatctgatccagcagtcccacttctgggtatttagcactaagaattgaaattaggatattgaagagatatttgtattcctatgttcattgcagtattatttataatagctaaaaattacaatgatacaatgtggatgaaccttaagggcattatgttaagtgaaataaaccagttatagaaagaaaaatactgcatgatctcacttatattaggtattcaagtagtcaaactcatagaagcagaaacttgaatagtggttttcagaggctggggagagttgctgttcaattggtgtagagtttcagttatgcaacattaaaaagttctaggtatttgctttacaacaatgtgcatatagttaacaatactatactgtgtgcttaaaaattttaaagggtggatctcattttttttttaccacgataaaaaggaaaagaaaaatgaactggaagtttggaatagaatatcagctgtgatgcaatatgatattgtggaaagaccgttcgttgcactcatgatgccaagatctggatgaccgtcttgctctcatccttatgaactattttacctggcacaagttacttaagctcattgactattttaggactattgtgagaagcaaatgaaataaactttgaagcagcagcttttaatatgagaaggactaatgagcgaggtttgcacagttgggcttcaggaggtgtgtgaaccaactaaaataaaacacaaatgtgaagggtgggtgtggattcatttccatagctctctcttttcagagtcacaagtgaatctctaagataccctcaaagactcaggactattgctcctaagtgttacacaaatattagttagatatcttgtgagttaattaagttattcagaaagatggtgatttagaaaaatgctgactatgtaaacgagattttaaaatgatgactaagtttttttttctctttttcttcatttctccaccactttgccttttaggagtaattttctttcagtttttgaggtagaacccaaatgaatgcttggaattttttttcttttttcatttgttttgttccccatactactttgcagtgctttatcagcatgggtgacattaggaacattcagggggaaaaaaaaaacctgagtaaattaaaattgtcagttgctggatgagaataaactacaaaagacaataaataggcagtgaactagatatagtgtccttggacttacattttgcaacgtagtagatgatatattgtattccacatattttttttaaactctctgaaaaatagagaatctagaaaagaaataacttctaggaacttcttttatttatatagctaaattgtttcatttttctggctggcttttctccgaattcagttctggtgttactatcttgaatcaaagcaaaatatttactactactgagagaacatgatattattccccaaaagctaatattaatgaaaagaatatggaaaagattatgaaactataaaatattaagttataagtgatattttaattatatgaagtatgtaatatattcaatattataattcattgccatcttgaaatcatttataattattacattttaacactttgtttctcaaagaatgctcattatgagaaggatattttatgcataaaagtctgaaagcacatcatgtcaattataaatgcttgactcaagcaagagtcagtgctcttctgtcacatgaaatgtgcctttctcatcattgcaggccttttccacttccggccactgaatcacatggaaaataaacaacaaggtcaacaaaatacaaaaattaacattaaaacagaggccgggcacgatggctcatgcctgtaatcccagcactttgggaagtgcccgaggcgggcggatcacaaggtcaggagaccgagaccatcctggccaacacggtgaaaccacgtctatactaaaaatacaaaaattagctgggcgtggtggtgcatgtctgtaatcccagctactcgggagactgaggcaggcgaattgcttgaacccgggagtcggaggttgcagtgagccgagatcacaccactgcactccagcctggtgacagagtgagactctgtctcaaaacaaatcaaaacaaaacaaaaaaagattaaaacagaaatttcagtgatttattttttcatcaggcttagaagaatggagatagaaaaagcaagcagattcccaattatggaatgccttctatgtcctcttgagtctatatgtgtatattcccagttagggaatccacttacctttttctgtctgcattcttacattccttacatttattcattcacaatgtcacgtgtgtgtgtgtgtgtgtgttatttacttgtttcttctatctcaaattcttccagtatatactcattcttcttcctccaaccttgttttaaaaatatgcttcttttaaaattaagacatttataggaatcacattaactttcaattaattgctttgttcctaacactgaagtactaggggggttctgtttttggtaatgacagaggtatggttgtgctggaagttgatgcttttgtagttggaaatgtttaggagatagaacaaacttaagcagctatgtagataggtttaggacaataggattagggaaacagatccagatcccggttcctcagtaaacgagaacaggccagagtcaaacaagaatgaatgtaacattgacctggaactgaccttggactgaaaggtataggaggacttctgtttcatatactgagagcttcgtggctttaacgctacatttcagtcttatggaagaatacactgtgtcttgggaattccgtattcaaggctctaaataagaaactggcttccacatggacttttataaaatgccatgtattgtatgattccatttacttgaaatctccaaaaccagaaagtgcatagaaatagaaagtagtttagtggttaccctcaggtaaagaacaggagaaagggagtgactgttgagaatacaggtttctttcttaggtgacaacaatgttctggagttagatagtggtcatggttgtacaaccttgtgactctactataaaacatgaattgtacacttttaaatggtgaatttattaaattatatcttaataaaaatacatctagtcacaggttgggagctctatgcagtgatctctgtcagcagctcagctgaaattaaaaaagagctgaactttcaggtgtcagggagctgatgaaagccacaagtcgaaaatgaaagttaagcctttaatcacttactgctatgctgtaagcatgattcaaaccagagaaatctctgacagctcagatatgggggtggtctcagtgtcgagaaagcaccaaacaaaaaggctctagtagttttatgagccttagattagggatggggagcagaagaggctaggaatggaaaagtgaagtacaggctactgagtcagagtggtgaaaagtgtcttcgagatgtgccacacttcacagtgaggaggtctcagcagagacacatgggctaggtatgcaaatatgcaaagagaatagctagctagagaggactgaattctggcctgcagcttcctttcaacactgtgatttattacctgagcacaaagtctgggttggagagggtagctttctcctgcgaggcctgccgggtaaaaccttaggaattacccatggtcaggcctgaaaaatcatggataggttttcagtcaggagccagactcctcaatctccatatcaccagttgtttttgtggacatagccaggcatacgtttatcatcccttacattcactgattggattaccatgtaggtcatcatgtcattcttcaaaggaaaaggttctcttcgttatcttccaggtgggaaattaattcatacattgttgggcttgtctttaccatcaatgatttaagttgtcttaacacgcattatatgttctattatccaagtattaattttctatcatataattatcactgaatatttaatacatacccataccacgcagtagggtatcatgtaataaatgctctcccttttagagtaaggaatgaaaatcagtagtgtaggtaggaatattagaaagtaaattaaggctgggtgcagtggctcacacctgtaatcctagcactttgggaagctgaaatgagaggatcacttgagcccaggagttccaggtcaacctaggcaacatagtgagtccccatccttacaaaaaataaaaataaattagccaggcggttgagaggtcgcttgagcctgggaggtggaggctgcagggacctctgattacattactatgctgcagcctgggcaatggagtgagatcttgtctttttgaaaaaaaaagagaacaacatacttcacacacacacacacacacacacaaaatcagatataagaatttatgaatcctttaggttactaaaggcagaagttttaagctatttttgatgttttgcctactttctccactggaataacttaaaattaatgtagttcaaattaatgtgacatttattgggcaacaaatgagcctgccactgagatggctttgagtgataaaatggtacagaagtagacaagatgtagtctactctttcagagtttgtagactagcaggcatgtataaataagcaattatagtatagtgtaacaaatattctgatgagagaaatggcagtgtgtcaaagtgctgcactggaacagctcttaactcagtttggcaatggtgggtaagtttgactgctttttaagatcttatccccaaattatgtaaagaaaataaaaaaggaggcaataagaaggaaagggtatctagtgaagaggaaagaacatgggcacacacctacaggtaaaggtgtactctggggtctaaacagattttaatatggtttgagcataaagtattgggggtaaaggactgatgaaagcaggagctagaaaaaagagataagaatgcaataaaggcaggctttctaagctatattataggaaaaatttgtcactaaacagggcaatgacataatcaaatttacatttcataatgagcctttctaacaccagtgccaagagtggattgcagatgagcaagagtgtagacagaaaagttactctgaaagctctgttgtgaattcaggcaatattgtagagttctaacttagactagtagacttcacaagacagcactatatatgaatacaagtaaatctttagaatttaatatttacgaggacaggtgactgggtatggaaggtgtggaaagagatctaaattttgaatttggacaactagttggaaaatgataccatttgttccaaaatggaacaaagggaaaataataggtctcagatgatgaaaataaatttcgaatatgttgaatttgcaatgtttgtgagaaatccaaatggaaatatccaatcacatatctgggtgtgtggctcaggagaaagatctgagttgtggctataaatttgtaaatcatcagcctataaggcataagaaatgtatgtcaatagatgtggccatgctggacaagtatgtatcagagaggaatgcctagaacaatgcccatctgaacacaaaaactttagaaaagagaagggggtaagtcaggagaaggctataacatagagaatccataagaaaaggtctgagaggtaagagggaaaccagaaaagtagtgtcaggaaatcccaggaaagagatggttggttatgagaaagaattagttgatgatattataaaaagggtgaggtcaggtaggaaaaggatgggaaagaaactagttcacttagcattaaagaagtattggtagcctaggcaagagcactttcactaacatgcttggattaaatccaaacatgagttgaatgaggaattggggtggataaagtcaactctaagttaaatgtttggggatacatttattaattttatattaccaattctatcttgaggaatttctcctccttttatatatcagtgagttgtagagatctctttctagtatagtgaaaatttccatagaagttgaaggtagtacatccttagttcatttgcggtagaatatggacttgaagacagccttactcagactttgaattgacagttggtataaagaagtagtgccaacagcatatcttttctggcagtggcattggtgacagcgttatcagattaggtggtataccagagtcagaagtccaagctgtggcacgtgcttctcagtaccagtatcagaaacaagggcagaggaatcctcatctactagttacctggcatgcttttgaacatagttctgatttttataaattctcttgattcctgctgatttccccagcctggctttgcaggatccctggaaattgctcactacctaatatcttttaaatatgtctctttctgtttaattaaaattcaatttctattgcttctgctaaaaaattttgactgatacacaatacaacaaaatgcacagacgtgtacagtttgatcatctttgacaaattcatatacccatatacagtttgatcatctttaacaaattcatatacccatcaaacccctatcaagacatggaacattgctatcaactcacaaagtgtgcccaataagccactgcaccctgaagcaaccagcatctgatttttactaccatagattaattttgcaggttctaaaacttcatataaatagaagcacacaatatgtactgttttgtccctggcttctttaactcagcatgaagatttgaagatttgtccatgttgttgcttatatcaatgctctgtgtatttattttactgagttttatttcaatatatgaatatatcacagtttatttatatatgtgtattaataggcacctggttgtttatttccagcttggggctattaggaatgaaagtgctataaactttcttgtacaaggttttgtgatgatttatttttttcttatttttttgtttttacggatatgtcatttttattggataaatacctagaagtggaattgctaggcatcatgataggtgcatgtttaacgttttaagaaattaagaagcattgttttctaagttgtataattttttgctctcatcagcatgccttttcattttcatcttctcaacactgtaattttaggatcagattatatatttttaaatttaatttaattttaagttccagggtacatatgcaggacatgcaggtttgttacatggggaaacatgtcccatggtggtttgctgcacctatcaatccatcacataggtattaagccccatatgcattaactctttatcctgataatatgcttcccctaacacccccttgacaggccccagtgtgtgttattcatctccttgtgttcatgtgttctcactgttcagctcccacttataagtgagaagatgtggtgtttggtcttctgttcctgtgttagtttgctgagggataataccttcaagctccatccatgtccctgcaacagacatgatctagttcctttttatggcttcatagtattccatagtgtatatgtaccacattttctttatccagtctatcattgatgggcatttggttgattccctgtgtttgctattttgaatagtgctgcagtgaacacatgcgtgcaagtgtctttataatagaatgatttatattcctttgggtatatactctgtaatgggattgctgggtcaaatggtttttctggttctaggtctatgaggaatcaccactctgtcttccataatggttgaactaatttacattccctccaaaagtaaaagtgttcctatttctccacagcttcaccaggatctgatgtttttgactttttaattatcaccattctgactgacatgaaatggtatctaattgttgttttgttttacatttctctaatgatcaatgatgctgagttttttttcgtatgtttgctggatgcatgaatgtcttcttttgaaaagtgtctattcatgtcctttgtccactttttaatgtttttttccttgtaaatttgtttaagttccttgtagattctggatattagacatttatcaaatggttagatcacaaaaactttctcctattctgtaggttgtctgttcactctgatgatggtttcttttgctgtgcagaaactcttttttttaattagatcccatttgtcaatttttgcttttgttgcaattgcttctggtgttttcatcataaaatctttgcccatgcctatatcctgaaaggtattgcctagattttcttctagggtttttatagttttgggttttacatttaagtctttaatccatcttgaattaatttttatgtgtggtgtaaagaaggggtccagtttcaattttctgtatatggctagtcagtttttccaccatttattaaatagggaatcctttccccattgcttgttttcatcaggtttgttgaagatcagatgatcatagacgtgcagtcttatttctgagatctctattctgttcctttgaattatgtgtcagttttggtaccagtaccatgctgtttggttactgtagccttgtaatatagtttgaagtcaggtagcataatgcctccagctttgttctttttgcttaggattatcttggatatacaggctctttttttgtttcatatgagttttaaagtattttttttctaattctgtgaagaatgtcaatggtagtttaatgggaatagcattgaatctataaattactttgggcactttggccattttcaaaacattgattcttcctgtctgagcatggaatgtttttccatttgtgtcctcttatttccttgagcagtggtttgtagttctcattgaagaggtccttcactttccttgttatctgtattcctaggtattttattctctttgtagcaattgtgaatgggagttaattcatgatttggctctctgcttgtctattgttggtgtagaggaaagcttatgatttttgcacattgattttgtaccctgagaccaccctcaacatgccagatcttgactatctcagaagctaagcaggattgggcctggttagtacttggatggaagcagatattttttactttttttcttcagtgatttgaacattttgtatcctatgtagcaaataatcttctaacataaggtcaaaactatttttcctgtgtttttgcctagaagttttttaattttagcttttatgtttaggttcttcctcattgaattgctgtagtactcttgcgaaaagagtactactatatatatgtgggtttatttctattccattgactggttagtgcatccttttaccaatataacatctttctgattagtataactttataataagccttaatgtcaggtagattaattctcctaaatttgttttctttcttatcaagtttgtttgggctactttagaatcaacttgtctatttctataaaaaagcctatgcattttggttagaattgagttgaacctgtacatcaatttgaggaaaactgacatctaacaatattgtcttccaatctatgaacatgaggtatttgaggtattctcctattccttttagcataattttataatttcactgtaatggttttatatatctttcattaaattggtccctaataattttttgagatgcttttatatacaatatgttctattttacttattctttttttttcaattttttcattcatatggtttgtttttcactaaagcctttaacatattaatcacaattattttaaagtctttgataattttgatatatgcatcatatcttgatatcatttggtttatcccttttagagttctttttatcatttttttaatttagtgtcttataattttgtttttaatgatggacatcatgtcttagtttcaggcagtttctacggaattctgttttatagatgagattttctcagcatttgtgagttttttcccacaaggcattcacacactcccttgaatctgagcaaagtcatttaggagagattttctgtgctctttcaagggaaggtgactttaaaacaaattgatgcataagaaaacttcatatttatggcatatagagtgaaatttcattacatgtatacaatgtgtgattatcagttcatgtaactagtatatccatcacctttcctgcatcagatgacgtttgctcatggcataatggtagtgtatcctttcctgggaatggtgtttctttttgttttaatttggaaatttttctttctttcctttccttttttgatggagtctttctctgtcgcccaggatggagtgtgcagtggcatgatctcggcttactgcaacctctgcctcccaggttcaagcagttctctatctcagcctcctgagtagctgggattacaggcacctgccaccacgcctggctaatttttgtatttttagtagagatagagtttcaccatcttggccaggctggtcctgaactcctgaccttgtgatccacccgcctcagcctcccaaagtgctgggattacaggcatgagccaccaagcctggcctaatttggaaatttctattgacctctcttcaagatagactcttgtctatctggtcctcaaataatccaaccaaaagaatttcttatattcattatcatatattatatttctaacatttccttttagcttgtttttatagcattcattgctcttttagaatcctctgtctgttcactcctattttctattcctattttttaccgcaatgtgtggtaaatggtgtaatacatttatcatagctattttgatgttctggttagataattctaatatctgggatatcttttggtctctttatcttgactatttttcttttgcctattggttatgtgtcagtttcttagggctgctgtaacaaattaccatacactgggtggattaaagcaacagaaatttattttctttcagttctgtaggttagaagtttaaaatcaaggtgttgacagggacataatccttacgaaaactctatgagagttctttcttgtcttttctagcttcttccagtttgcttataatctttcatgtttttgtcttgtagatgcatcactccaatccttaatcttcacatggcatttttcgtgtgtctgtctgcatgtggtcatcttcttttaaggacatcagtcttattgatttaggggtctaccctatttcctgtgatctcatattaagcaattttatatgcaatggtgttatttccaaataagttcatattctgagttaatgggggttaggatttcaacatattctttacaggggagacaattcagttcctaaaagagttctggtttcttgtttcttctctggtaccatcacttttaaaaataaaataccagatatttgtgtaaagaaacacttaacactgaagtcaataatacctgtgccctagataggagatggctcaatttcttcgaggccagtagtgtggcaggctgactcaacctatattttatctggacctaattttgttgaagctttagttagattcacttctcaggcttcaaatggtctaaaagcagaatcacaaatttttccttagtacgtgcatgaagtatgcatgctggagggttttctcatatctcctactcagctcccattcttcagcaggcccagtgtacctgtgtctcaggttggatctgtctcggcactactgtattgtttctaaattttctcaagacttgtcaaaaagagtttgttagtgagctcagattctcagagtacaactattttcttctagccggcatttatgacgacttgctccttttcctgctgctctgccaaagacgaaagcatcctgagtctcttctagattgaatgccttacattttagattttgttttaaaaattttctttgcatcctcagttctttgctgggctttataaatcataattgtatataccattttgtatttctttgtaattgaagtgctcttgcaacttttctaaatcactttattgtagtataattaatatataaaaatacatgtttaatgtatacaactaagtttgaagatatgcatatagctgtgaaattattactacattctattttataaacacagctatcacctccaaaagtttcctctcactctcctaatttgttattacctattttgtgataacaacacttaacataagatctatctaccctcttaacaagtttccaagtacacagtacagtattgctatctataggcactgtgctgtatagtagatcttcaggacttattcatcttacataactgaaacactgtacactttgactgatgcctcactgttttcccatcccctcagtccctgctacttaccattctactctccgcttttatgagtttggctattttagattcttcatataagtgttataacatagtatttgttcttcttgcaactttctacatctttataagtagaagtcactgatatcctttttaaaggtcttttcataattatcctttaccttagatttattaagtggaagctgcattttttggttttatttgtgtataccattacaactaagaaacacaatgtacaaactctcagtcaaatttattgaactggagattgttagtaaacccctaataaattagctccaaatagctatgattgctttctttccaagggttgtgtatttgccacattggcataaatgtaaactagataaagaaagcattataaattattttgtgtgtagttacatataattcaaggtctcagtaggcaaagtaaccccttcccaacatcccaaaatatctacatcccaatcattgggatttatgttacctcatatggcaaaggaactttgtgacagtgattaagttagagccctgatttgtagagattatcctggattatgttggtggacccagtctaatcataggagcccttaaaagtggataaatttattctggcttctgttcatgggagatgtgattgcaggagggagagagacacaacattgctggctttgacaattgggagagggctataagctaaggaatgtgggtgatcactagaagttggaaacagcaaggaaatggattctccaccagagcactcagaaaaacatgaagctcttctgggtccttgatttaagttcagtgagacccatgtctgactgctaatctatagaagtggaagataacaaatctgtgttgtttgaaaccaagtttgcggtaatttgctacagcagcaatagaaaactagtaaaaggccagaacaacaacaaaaaattctgaatatcaatttgtaaaagttgtgagggtgaaattttaaaaagtttttttttcttattctcccatgtttagttcgctaggttagttttataagaaataaaatagaaagctggaaaagacattgacttttttacagacattacttttagagactaatatagagaaataaatttggtttcaaatttgaagatcacaagaaaaggagatctcataatatcttaccagcgttctatgccaccccccccccaccccaggacccgagcattattcttaatataacacatacatgttcttaataagattaacataattttagcaaaaaatttcataagaaggaaatgttgatgggtctataatagtggaaaaaaaggtaaacttagagttatgtaagattaaaaaaagaaacaaaagtaactgactttttgaaatactgtacattaaccgtagttattaaaatgtcataggtttctttgttacttcacaattgagaacattatactatttttccctttttcatgtatatcatttgaaaaatatttcctaaagaaactattgtttttcctacttaaattcaactattctgacaatatattaatactaaccccaaatcttctggtcattcttcagcaagtgtccagtttgtaggaatttttttttttttttttttttttttttgagacgtagtctcattctgtcgctcaggctggagtgcagtggtgcaatctcggcttactgcaacctccacctcccaggttcaagagattctcccacctcagcttcctgagtagctgggattacagtcatgtaccacaacgcccaactaatttttttttttgagatggagtctcgctctgtctcccaggctggagtgcagtggcgcgatctccccttactgcaagctccgcctcccgggttcacgccattctcctgcctcagcctccccagcagctggattacaggcgcccgcctccacgcctggctaattttttaagtatttttagtagagacggggtttcaccttgttcgccgggatggtctcgatctcctgaccttgtgatccgcccgcctcggcctcccaaagtgttgggattacaggcgtgagccgcccaactaatttttgtatttttaggagagatagggtttcaccgtgttggccaggctggtcttgaactcctgacctcaagtgatctgcctgcctcggcctctcaaagtgctgggattacagacttgagccactgggcctggcctgtaagaacaatttaattgcactccagttgtgcctaattcaattgcactccaagttttttttacaggcaatccaattatactctaaaatatcatcttcctgaagagcaaagaattaggatccttgaaaaacttgctcttttagttttgctcttgagattataataaatttcttaggaaaggtgctagataataaatttctggatatgtaaaaatactgtatgtataagctgtccaacccaggaaatctaaatatatagaatgaacgttatactgtttaatattaaagtgtttgattcttaaatatcctgatactagatgagaattagataagtacatgtactacaaatcacacgatgattgtcatttccacaaggttgcttaacatctttaattagtctatctgaattcttagtttaacatatatacttaactataaaagttaaaataagaaagtcatacctagacttttttgacactattttgagaattgacacctgaaaacctgctattgaggataaaagaaaggggaacacacttaaaaaatagacttaattactaaagtcaaataatctttgattctttataataggggcaaaaatttttatacctttcactttcccagggcagtatgtagtatgctttattacggaccatatcaaccctagtgctttcatctctattatatcttcatccatcttttcaaataactctatcctaggttttgtcataactctcagtacccaatccactggccataagtcaagagcttaccaactctcatactcttagtacacattttcttcttttccatggtatattatctttctctcccttctgttctgtccctacttggctaaatccatcagtcatcacttcaaccaacctctgccactatctctagttctttggccccactgatctatcttcattaatgtagctgtttaccaagcaaacttctcttatgcaactggaaagccttgagttaatattaatgaatttttttcagttccatgtctgcagtgattctcagcaagccttctttggccccttaattatttacgttttcttcatactagcaatttcaaagtatttctgctccccataaactaatgacatagccaccatatttcattttattctcatcccatcacttaattcttcaaaagtaaagttaaaattgccttgagtgaagttactcaacttcccaccactaaacctgcacaaatgccttcatctatttcaatcctttccagttttccctttaacttttcacactttaaagagatgtattctttcctacttaatgtttcttgagaatattgctactccataagttttctttgtttttagttatacctccaacttctttttttccagatgtcctttattgagttcttaaatacgtctgtttcttctacattagaattgataacagtagtagtataatcaaaccaaaccttcaactccacattccatttttagatctgtaatatttaatatggcttaagctgcaaattagagtaaccttaacctaaaatgaatttaaaaattttaaaaaaattgtgcttgcctaacaggatttccaggaagtcagtgttccaactctattccttttgtgatatgttcagttctgccctcttctatattttggttttgttattcatggtcaaagatggctgccattcacagctaaagcaacatctgctttgttaatatcaagaaagagggagaggtaaccgctccttcaactataaaaaaaattatcattccctgaatagggtcatctggtgccctaggatcagtagtagtcatgagatgttgagatgattgacatatctggagcctgtaccagtcattggcaagaggaatggaattgctgtgatcaacttagcctactcaggattcttacctggagctcttggtagggataacatctcctgaatcataacgatgatgtaagggaagtctgaatacttaaaaattgaaacgtgttattttatcccagtaaggaagaaagtggaatacttgataagccaccagtggtgtctattacatgaagaagcaaagggaatgaagtaaacttaagtgcataaaaatgacttctcagaaaagtacagatccagatcctatggatacccaaattaattcctaatttattgcttaaaatagctactaggcatgctgactcctgtttcaccctgtcagagggactttgaataaaatggtactagattattaattatggggactagtcatgtacttcatgctctctcaaagcaatgtctagatctgtccttgctttggctgctcttcagccagctctggggtctggcctcatcctgcactccaccctcccaaccttttagtgagaggtacttttaccatctgcaaaggtaaaagagatacctttactatcacatggcatcacatttgccacatgatgtctctatcaaattcaaattaacctacccttaagggtaactgttgcactatctttagtctttctgattccaggtctcttcccatttttctctgacttgtgtgaaatatatacactttccttatatttccaggcatcttctcctcttggggaattgtacctttttctcttattattcctattttctggacctaatgttttttcaactatgtggaatctggtgttagtttcaagtagaaccttcctatgtatgctagtttaccaaagcaggtccaaacatttttcttttctttcttttttttttttttttttggtggtgagcgggggtgaatctcaactatcttagggaattccttttgactttggatttaagaactgagggaaagcatttagctctttgtgtatttgcaaaggagaataatttatgtactattacctttgtttccttcttattttcccaactttgagaactctattttgtttcctgaaactgcctgtatgctttttttgccagagaagtcatcttataaatacttggctatctataatttggcaatgataaaactaaaacagaaaatagcacacacataataataaagggtggtttggtcacaatcaatttctaatagtatacattaccactagctgtatatcatattccacatgatactattggtagtccacagaagactagacatttgctttacctgaaggcccatgtcaagtcattgtcagaaaaagccctgaaaaataatataggcttttacaaaattgccttctgaagtggtggcaacagagttacattacagacattatatgttactcagcaaaactcctttaaggtcttccttggttgagcatgtcttcctcttggttcctccattcctcaagccttccatcttcatagttcctacctccccttttttaggcggatgcctctgccttctgagaagctatctgttagtgtttgtctaagtcttctccattatggagagggaaaaactatgaaaacttatatagaatatttttgtccacatcacccaatgagaaataatttgctttttatagaaggcattaatagatataagatatattaccttgataaaataaaaagaaaagcaaaaagttgatgccctctcctaatcccccccaggtttcttcctgccttcttaatgctttcatgtgtagctctgctatctagagtgctcattctcctaacccctcccctgcccatactttccccatggaaggaaagaataccttcctttattccttacaaatgactaaaaagtctttagtcctgctcacaacagtatttaaattcaaacggaaagcggtattttacattaaggagaaaaatctttaatttaggacttttgcatatccactctgtacctagggaaggactgtgcactgggtaaattttctagaacttctgaaatcacattacgtggacaactttgtatttgcagtttggtcatgaagaagactgctcttgaatgtgttcattgaagagctttttccttctgtgattgtcttttggagcatgaaagtcaaaataccaaagaatgataaaacttaatcaaaatttaaattactgtttaagatctccaaaatccttttggaaaataatttcatagtacattttataactagagcaaaaagagctaatagaggcacgttttctatagcaataactacctcctctgtgttttcacctcttcagaggctaataacactgtcaaattgatggaaaccttcctgcttactgaattatagcacctccatttacattagcataatatatgccaaaaatgaaatactatctcatttcaaagtctgtgggtttattttattacttgtagttgatatttcttgtactctaaactgtaatagtcttcagttttttttttttaaataataaaaaaaggaaggaaagaaagagggatggaaagatgaagggaaggaagaaactgttttttagtgttcttcctcccatggtagataattaataaaaacattgatactaaacaatgatgtaaaagattatatggaaacagggaaatctcaaaaagaaaccaaatatttatatagtgaggtatggtacctaatggaagagcatttaagaagaattatgtagttataatagtcgtatagatatgtagtaccaaatgtaacaacttaacatgattacttcagcaactttcaatgaagtatttgtttcaaatattctttgatccctttcaaaaagaaattacatagctgttattcaataaagataatcgaggtaggtggaactgaaggttgaaattacaggaatctatattggtcataacacagaatttttgaaagcttcacaacaacccaaacaagtggttatggtaggttttaccacattttacagatgagaaactgaaggccagggaattcactgataaaagtatgagagggaactggcagtgggacattgactcctactctaactttagtgaaattctcactatgccatacttttattttttgcagatagatgttctaaaagtaagaattaaatattctcatgtttgtaatttttctcaagcaaactttcattatctcatttaactctgggtgcttctgtaaaagagttctaagaactgtgggagctttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccaagtgatctcattgttcaattcccacctatgagtgagaatatgctgtgtttggttttttgttcttgcgatagtttactgagaatgatggtttccaatttcatccatgtccctacaaaggacatgaactcatcattttttatggctgcatagtattccatggtgtatatgtgccacattttcttaatgtgcacatgtaccctaaaacttagagtataataaaaaaaaaaaaaaaaatcttaatgacttaggaagaatcagagtgaagattttgaagcctttttatatataccatgagttatacagtcaatacatttttgaaggcagagtatctatatctattattttttttaagaacacattgttttacacaattattttacttccagaaacctatgccacagaagacttaacaccctggacaaaaaaatatatacgtatgaggaattttgcataattgtccatagtgaaaatttggcaacaaccaaaatctcacccccaaataaatgattaaagaaaaatatatttatacagtttatgttgtacagttacacaatggaattagctagttctaatgaaaatgaaagattttcttcagaatacagttagtgaaaattgccagttggagaacatatacaacactacttttggggaaaaaaatatgtaggtgtatgtaaatagtgaaaatattttaggcatgggattttggtaatcttcataatctacatgttaggagtgaagttttggtaatcttatgtagtctacatttgtacatttttgtattatgaagagaaactacagagaagtttgcattgtcatctcattaatataatttttaaaatttaaaaaggcttctctgagattgcaagaggtgagtgactttgccacaggtttttagaaaagtagatgactacacgcttaacatgttgttgaggtcatctatgcatcagcaatgggaggttcaggtattatctggtgtccttctagttctaagactctgtgatgctgagagatgggagagatatgaaatctgctgtgctgaaatggaagggcttagcttactcgtggcactccaactgcaatttagaatttcttatctcactccttcttcctggaccgaatcattctcactgtcccatcatattttaaggaataccattaggaagtcactaaagatttcactttttaagatttcactttttctagcacaactagaaacaatgtgatggatttgagttcttaatttaaaaattgtatgcttcatatagttatctagtccaaaaatattttacattgtatgtttataactaaagtgtatcttgttctccctccaccttgtgtagtttatcagtaaaaccaataaagcctactgaattaacagacatataatatcacttacaataaaagtaaatgtactttttacttacagtaaaacaatacaattttacttacgataaaattgtatcacttacagtaaaagtaaatttgtaataggaaaactggaaaataaatgcacagcaattatttctaaaaaaaaaaaaaaaaaaaaaaaaaaagaactgtgagagctccgtgatagaactatatgctgtttgctctctaagagattccaatataatggaaagaaaagagaagcacatgtcctaaagttcttacacctccattgtactggaaacttgtgcaactcttgaacaagtttattattttttttttgtagctaatgtccctacttttatgctcccttgagattttttgtatggtgctatttatgatatccacatgtattaagattatttgtaattatgtttcaaaattattttcaatcatgtcttggacttgtggaatgtgaagattagttcctattcatcctagttctataaggctaagtgtagtgcttacaacacagtaaatgttcagtacatgcttgtgtttggtatatatttattattagaaaggtctatacctctcatataaaattcaagcaatatggacgtatataatgtaaacagttaaactttacatgtctttcacccactcctactgctctcaggtaaccatcgttagcattttgattcagaactacttagactttttttacatggacaaatacgatgtgatttttgaattcataagttaaattcataagacgcactgagaatcaaaaatattctataagctgaagacattatataaaattaaaatattattttatgattttaaactacttcaactgtgttctgtagaaagaaaacaattgaacaggatgatcttaaaactttgatagttgtatagattatcaatagtattttacatgttacaccaaaaatattcatttcatattaacattctaatttatcaggacaacacactaaattttagttttctcattatcagacatcactttattttcacatacattggaatattattggtcaaacttttactctagtaagagctgacatttctatttattaggttctaaactagtgatttataaggtatttctgctttgcagagtattcccattcagtaatggaaataatccttggtcctttgagttaacatttgaaagtacataattaataaatgaacattaagaactttatatctatatttactattcttcaaaagaagtttagccaggcgcagtggctcacacctgtaatcccagcactttgggaggccgaggcgggaggatcaagagactgagaacatcctggccaacatggtgaaaccccgtctctactaacaatacaaaaattagctgggcatggtggcacttgcctatagtcccagctacttgggaggctgaggtaggggaatcacttgaacccgggaggcggagtttgcagtgagccgagatcacaccattgcactccagcctcggcgacaagagcaaaactccgtctaaaaaaaaaaaaagaattttatatatagacagcaattcaaatgtattttttagttttctttatttctatttcattaatgtgcttgactattgatagtcttgattaaggatataatatttactctatttctctgacttaaagaggaaatatatgctcctcattctctatgctacttagtgattttaatttttctcaaggaaactttcatcgtcccatttaacatttgcgcttctgtcgtaaaagaatgctaagaactatgggagctccgtggtagaattatatgctgtttgctctcagagagcttgttagaattttggagtttaagtggtgactttgacctaaaggctgaacatcaaattacaaatgttattacactttagtgagtattagaagaaagaaaaaaatggtacattattgagaattaatgaattatgattgaactaaatggattttagctagccatacagaaactgtgaggttaaaaacatggatttttctgtttcataaaacaacttataattatttgctatcatttaaaattttggactataaataaataaactattaccatgtaatttaattaaacttggtatgacaaacactttgtggcctcagatagaagatgatgtagagctatgcaaactgtgtattcataaaacatatggcagaaaagctctatgaataatagttgactaagagcttaacatatgtctaataatgtgttcagcatagattaatgggaaataaatatattgaaacaatatatttgatatttaaaaactgatttgagctgtgttctaattacctcattgtgccttaatttaatagtgtataaaaactgggaataatacaataaatttattgaggaatttgcaattagtaatagttactagagttaaaacaattctaataatttcatgtggaaagtgataaaaatgatataagtggtatggaaacaaatgaaggttatttattagtaaaattgattaccaacatttttgtgtgaaaggtctaagaaaatttacataatcaatattaagtttaatgtctcatatccaagtcgagtactagtagttaaatagcgttaggaaaaatagctaatgtatgctgggcttaatactgaggtgatgggttgataggtgcagcaaatcaccatgacacacgtttacctatgtaacaaatctgcacatcctgcacacgtaccctggaacttaaaataataataaagaaaatttaaaaaatacaagacttcatacttttctgaggataaagaagtagaagttgatgagtgataatggtattgatgctttctatttgcttttgaaactataagatataaataaatagaccaagagctactaagctactatttactgaatttttaccttattctaagtaattttcatatattagcttctttcatgacttgggtttagatgtgtgtgagaaactgaatgaaatataatatagctacaataccaaattcaagagaaatttggtgaggtgagcttggagataggaaggctgtagattttggatagccatgtaagtcatgtgccctttattttatgggcagtgggaaagcattgtgggttataagtatcaaattacattataggataaaatataattaaatgatttttaaattatatgaacaattcagatttgttttattattaaattggaaaacatcttaaaatttttacagtaacctcatgataggtggaaaaggaatagaaatttatacattgtttttaggagtggcagttgatacaacaatttttggatggcaatattatactatgaaataaaattttaaaatcacatactcttttacataggaatacaacttctaggaattaaaaatctggatactatcacaaaaatttatcgtgaaaactatatatttgaagatgtccaaaaatcctagaagagcatgtcactacttgagaaagactaacatatatgtgcaaataataagaaagaatcataagagctggtgttgttgataggacaattggcactcttaggcactattggattgaatcatcattatattcacacagaataatttaacctttatgaaagatttaggtttgactcagcagtttcgatcactcattctaagaaatttattggattccaatccaaaaatttaagtacaaatgtgctattgtaatgttgtttatcatagcaactaaaaattaagagttaaataaattataatacattaagcagctgaattttatatagtcaatataagtatttatagaagtaaatggtcataataacctataaaaaggaaataagctacacaatcacatttatacaaatctcatatgagtaagtcatatatacatatgtatataaatataaacattatgaaaacttatgctaagctattggtaatggtaaccctgtgatgatggaattttaggggttgttattgtttttgtggtagtgtttatctctacttccttttctttctgtgcaagattctttgttatttatttaattagaaacactaagaaaattatttacataaattctatatctcatagccaatatccacagtgtttttccttttaggagactcataaattcttcccctagaggagcctgatatgctaaatttcacaggaaggccttagaatagactacatcactgggacctttggtataggctgacttaatccctctgttcaaaacttgcttcaaatattgcctagaatatactcaattattaataaatgctgaaaggaataagacaacatctaaacccatctctcagctcttatatttgtttttgtttgcttgttttatggatgtgacattgatgatatacttgtgtgacgtctttatgagtgattctcaaattattgtgcaatttccataggtagaatctttccatttatattaattctaagtagtataattccttctctctgtttttatagcatcatttgctttataaagatagatgaaaaacaggagtctgaacgtttttcctgttttctctgtcactgaaagaagaatgtcagtatacttaaagataagcaattgaatgcaaataatttggaagaaccattttaatcaccataattgtactgaagcacttaaaaatgcatgtatggaattgaaaaatagattaaaaatcctttcaataagtgtactcatttatttaattactttgaagttggaagtaaaaccatcctttctgtaggctatagtatttcactttgggttaacaacttagtaagatgaacaccatttttgacagttagtgtgggtcttgatgttttatcagcattttaataaatttgacttcagtcatttatgtgctttatcattgagattttccaatatcttattccaataagaatgactaatagttatgctcatttaaaaagtaatattgcaatgctgagaatgatcattgcctttatgttcagatttatctgagagtatgtgtggcatctttcctgaaaaatacacacaaggtgattattttgttggagacattgtttgaagaccaatttatgtgttatcttttatttgaaaagcagcttaaaaagacaaaccattccagcacaacattcaacatttgacagttcggctcagtgataaccttattcactcacacgatgtaatggttatttttgttgcaaaggaaccctccctggttttcttgtatctccattatactttgtccgtaagctctatgatgctagaatttccaaatagattgatttttcaactaaaattgaatgtatctacttattcactttcaaacccaaaatatactcacctatttttgcctcaaattctttttaaagcagggaagttaaaaataatttgtaaatccctaatttctccaattttcggtaacgatatcattatcatccaatgtattttgagtcaaaactgtggtattatttttattcttcacttttctagatctttcttaaccacttatattaattaaaatctgcccttcaaaaatgatctctcatcttttttgtcccctcagtattattcaacttgattattgctattttagttaccttctaattccacaacatcatccactcccttgttctttccccagtggagtacctttgttctatggccaaaattattctcataaattaatcatgaattttattattaagcatcactgatgattcatcactgcctataaaataagatgcaattttttggcattcaagactctccacgatagtttccaaaattatcttttcagctctataatttcacttctataaacttttaactcctcatctccaactctcaactctcaacacttatttaggttcaagtccagtggatcatttatcattctctgaacattttctttgtaaagaactgccgtcactagcttcaatgttctccataactcagaccgttataaccaaaagcatatttttggtgtaatattatatctttcatgaaggtttaatggattatttttcttttttttgttaatttctacctcttctgtacttatattttcattaatatatttaaaatattaatattagtcttctaacagttattataatatttgttttggtctgttttattttgtgggtgaaaaacaccaattatatacaatgtgagcataccagtattgtgtatatatgtacatatgcatcctcaagcatctatgtgtatggtctaagtgtgtgcatgtgtgtatatgcatagaggtagaataatgaaggtagcttaagatgtaagaggtaatctttgcctgtataatgattttgtcatgggccaattctgattatgtcacatcagttgaagatgcacatcaagatgtctgaaataactttcttctgcctgttctgacctttgttgtctcactttaactcatcatccagctgctgcctgagtattttgctttaatctattctctactcagctaaattagaaatactattttagatgaaaatagcacataagtatccactgagaaatccctggtggtttaattatcactgattttttttagaagcaatttgaaatggtctccaattgtggttaatttagcaatgagttttcagtggtgtggacatagtaataagtgttaaaatattaaacaagccttcattttgattgccaaatttcttttagagcaaaactaatatagaaatccttacagtcaaggcttctttacaaatccaaacctggaatgtgtgtgtgggtttgtttttaaccttgcagtgaaaaaataaattcctcattaaagaaaactaaagtttgaaaaaaaaaacataaatcctttgcatataccccttatttttgaatcatgaggcatttttggtaaaagtggaaagcaaataatgtcacttatctttagtataacttctttttttatacaaagaaaatagttttaaggaataaaatggtacatcagattcaactcctgactagataatcataatatttacggaagactatttgacaacagcttaaaggatacacaaaataagagcattaaaccatgtaaaagggattagactagtgttctctcagcagtggtcagagttgcataaatctgaaacttgaatgggagaagaaatgtgtgcattctaatcctaaacatgaaaaatattcattctgaaatctacgttaaatacttcaaataaaaaagtatttataatatccatatgggttttctaaaatatattcttccaaaatataagtcaagcatggttaagacaggcccttatcatttaatggaaaggattaggagtgagtataaaaatgttttaagtcacgttttgcaaagtttattctgtggaaagtaagtcctacaaggtacttaatggaaaaaggtgttcatgaataaatgttttaaatattttgtacatattatgtcatcctgtattgaagttaaagcattcattaacatattaaagactgagtattttgcaacacattggaagccaacttttctcaaaattatttcagaacaagatagcttcccaagccaaatgtgtctttcttttttcttaaaacaccaagccagtattcatcgagacaaattctcagaaatgttgtttaaaagtgttaccaattaaaaacaaaacaaaactttacaggtttgtttgttacagaaaacagaattgaagtaagaactactttgcaatggctcatagtattaagtacataaaataaaagtgccaaggaatcccatagcttttgctgacggaagcaaatcgcactcactgtactgactgtgcaatattccatttgacttcattgaagttctgttttctcataaaggagcaacagttgtgcctccctcagtgtgttgaaaggatcatatacagctatttgttttaacagccctaaagtgctacaaaattttcaacttacatttgcctcacactgcctaataagcttgatttttcatgtcagttcaatttccccagtctgaaatgactattgtaaacatgttctcctctcacttctcttaggacactctagcagcattgttcatcaaacagcattgcttcctaattttcagtgaaaatgagtatcttttttttttttttttttttttttggagaccgggtctcactctcttgcccaggctggagtgcagtggcttgatcctggctcactgcaacctccgcctcctgggttcaagcgattctcctgcctcagcctcccgagtagctggaattacaggcatgagccactgtgcccagccgaaaatgagaatcttctgggcagtcctcagtgtctagctgccacatctctaaaactggcctccatcttgccagtgcttctcatctgagtgaaatgttggtgttcttttcttcaatcccaggaggtctgaatcccacgtctccaacactctaagatctttaagtaatttttccttctttagtattttctttttttttgagatgaagtctcactcttgtccccaggctggagtgcaatggcgtgatctcacctcactgcaatctctgcctcctgggttcaagcgattctcctgcctcagcctcccaaatagctgggattacaggcgcctgccaccgcgcccagctaatttttgttatttttagtacagacggggtttcaccatgttggtcaggctggtcttgagctcctgacctcaggtgatccacccgcctcggcctctcaaagtgctgggattacagatgtgagccaccgcgcggccttatctagtattttcattgagtttttctcctttagattcttactgtcaatattttgttattcctatcaaactaagataaacagtaccccaaacatacaaagcaacaaaacatgcaaacctttatcctgtacccgtcagctaccatcatacctcttacctctcaatgtcaaaaaattttaaaagagttataggtacatgccactccttctgcttaccttccagttactctgaataaataaattgccagtctggtttctgcacatacaagttactctcaaatttagttttaaatagctagctaccagtttgtttctatgtgacaactttaatatcctttgaaaaatacttatgaaaaactgacttcaagtgtctagttttctgtaagttacaaagatatatagtctacctacatctattgtaagcactagtaataattcaaaatgaaattctctaaaagatgttaaatgaataaagtaagatttattcccaaaatcagaatctcagagacaaggtaatgttaatgttgcctctttgaaatgctagtttcttcgctctgtggtccagtttggatatcccagaagtcataaagtataacgtcttaatacctccaagtatccattatctacctatataatttattaatgggccgtgcataaatgagacacttctcagtggattatgaatatatattgcttctcagatgtcttaggttgatttcctttttaaataaccagtacatttgaatttaaccacgtcttttgttcacaaacatcatcaaattcttaaatcttacattcaaatccaaactttagaaacttttcaaccttttacaaagtataataaagactgctcactgcatcagtgaaatgtgttttaagtccaggatgtattaaattaaagttcaagctttgtccttaactgtttattttttagaactctcttaatatcggagagtagttctcctgttgtattctaaaaagactcgctgaatttgaaataaaaattattttaattacagcaacaaaaaagtcaatattttcagcagttttttctgtatgagtttattcaagaagtgagtttttattggacataacttatatgcacattgtacagttttaatatataaatgactgtttaaatcctaacagtggcctaatttcataagtagtattttgaaacaaagtatctaggctctctgtaaatagtaagggctattaagaatagattccttttctgcatgttccctttcctggtctttttgggtactttgctttgactttttcctttcccttatgttgattatatcatttgttttaaacttttcttcccgaaatacttatctccaaaggcagatattgagatggggacaaaaaatgttgttggactggtagctaaagaacaaactatagttcagagaatatacttgaaatctcacaagataggtacattttgtttagtaactttgttatttagtaacttttacagcattatcactttgatcttaacaataactcttcgaaaaatacactaaaactatgccctgcatccagcaaatgagaaaacaaatttggataagataaacatctaagatggcagttgataagagacatagaattagaacacagatctgtcttaaatttcatgctctgattttcctgaaattaataaatggcatgaatctaaagctttagattacctaaaatttatttaaatttggctttagaatgttaatttattctctactggaccactattaaaattaatatgcattctctgaacatgtagcaaatgatgatgaaagactctgaagataattgagccgatgagaataaaaacctgtgcaaacttttaaaaattattgataagccccatttcagtatatcattatagataattgaaagttcattctcaaagtgtaagaaagttctgttcaatgtggtagttgtgagataaactctgtaaatcttactagtaatgagatgttatgtttagcaatgattaagaattgttattggcaaattctggaaaagaaattattttcatgatatgtttgtatctgtagattaatatatataagctatttacacagtactcagtatgtgaaattgtaatgtaattgacaaatacacaaaaaggttactaataccactagtcatttctacacttttatgtcttcccatcagtggcaaactaaatccttatgctttcaacatttttctacttagcatcaatatatccttcacacacaaaacattctgccttcaaaaaatacgccaatcctttaattagaaattacagacaattttctgtttgttcattcttgttcatatttctgacacttggtgatacggtctggatctttgtcaccacctaaatctcatgatcagttgtaatcctcagtgttagaggtggggcctggtgggaggtgattagatcatgagggtggatctttcatgaatggtttagcaccatcccctcagtgctgttctcatgttggtgagttctcacgagatctggttgtttaaaagtgtgtagcatctttcccctctgtcttgctcctactctagccacataaaacgtacctgcttttccttcaccttccacagtgattttaagtttcctgaggactccgcagaagcagaagccactatgctttctgtacagcctgcagaaccatgagccagatagcctctattcattataaattacccagcctcaagtgtttctttatagcagtgaaagaatggactaatacactttgtattccagatcatgaattgtgttttgaaggaaaaaagtcacataattataagaattttggaggatacgatatatcttaataaaacatctaatctattcaactccccccaaaatggttaaaaatttttattacagatctttcgtgggattctcaaatatttttgcatttttatttatatattatagtaatttaatttccataaaatttgcccattttaattctacaatgtaaggatttttagtaagtttacagaattgtgcaactatcttctcaacctaattttactctattgccattacccccgaaaaaagtccatacctattctgactttcaaccccaggaaacatctaatctactttctatctctctatatttgtctcttctggacatttaatgtaaataatttgtgttttttaatgtctgaattatttcattgagcataacgtcttcaaagttcattcacgttgtaacatttatcagtacttcatttctttttatgactgaataatattccattctatggatatacagtcatgtgccacctaatactttggtaaaggacagactgtatgtaggatgatgatcccataatattataatagagctgaaaattttccattgcttagtgatgtcatagctgtccttaagttgtagcacaatgcattacttatgtgttagtggtgatgctggtgtcaacaaacctgctgcacttctaatcataaaaaagtatagcacataaaattatgtacaatacataatacttgataataaataaagttactggtttatatatttactgtattatttattattattttaagtgtacttctacttattaaaaaaaagttaactataaaatagtctcaggcaggtccttcaggaggaatttcagaagaagatatggttattatgggtgatgacagctgcatgcatgttatttctcctaaagaccttttagtgagagaagatgtggatgtggaagaaagtgatattgatgatcctgacacgctgtgtaggcctgagctaatgtgtacatcttaagtttttaacaaaaaaattaaaattaaaaaaaaaaacattaaaatagaatcaaccttatagaataagaatataaggaaaatattttgtacagctgtacaatgtatgttttaagctaactgttaatataagacatccgtaaagttaaaaaattaaacagtttataaagtaaaaatgttacagtaagctaaggttaatttatcattgaacaaaattttttaaaaagaaaatttagtttagcctaagtatatagtatttataaagtctacagtaatgtacagtagtgtcctaggccttcacattcactcaccactgactcactgtctcacccagggcaacttacaatcctgtagttttcattcatagtgccgagaaaatgtgtatcatttttatctttatgctggatttttagcattacttttctatgtttagatatgtttagacacacaaataccattgtgttacaatgcctatagtatacaagacaataacatattgtacatatttgtagcctagaagcaataggctagaccatataacctaggtgtgtagtaagctataccatctaggtttgtgtaagtacactctattgatatactcacagtgacaaaactgtccaaggacacgtttctcagatcatattcccatcattaaacaatgaatggctgtgtaccacattttgtttattcattcactaattgttgaggaattgggcttttcccagtttgggggcattgtgaataagctgctgtgagcatttatgtacaagtctttgtgtagacatctgctttcatttctcttgggtagataactaggagtagagctgctgtcttatagggttaactgtgtttagcatatgagaaactggcagacagttttcaaactgcctatagcattttgcattcctttcagcaatgtatgagtgttccaccttctctcattctcatcaacatttgctgtctttcttttgattatatttcaatagatgtgaacggggcatggcattgtggccattacttgcattcccctaatgactactcctgagtaccttctcatgtgcttattgcccagtcatatatcttctttggaaaaatgttcaattcccttaaccatttgttgaattatttactcttttgttattgacttgtaagcgttctttatatattttagatataaatcccttatcagacttatgacttgcaaatattttctcccattctatggcattttttgtttgtttgtttgttttgagatgaagtctcactgttgcccaggctggaatgcagtggcacaatcttggctcactacaacctctgcctcccaggttcaagtgattctcctgcctcagcctcgctagtagctgggattacaggtgcccatcaccacacctggctaatttttgtttttttttatagagatggggtttcaccatgatgggcaggctggtcttgaacttctgatctcaagtgatcctcccaccttggcctcccagaatgttggtattaacagatgtgagccactgcacccggcctctgtggaatgttttgaagcataaaacttttaaattctgatgaagcctagtgtattgtttatttatcacttgtacttttaatacaatctaatgagtcagggagtgacccaagattatgaaaatttactccaatgttttctgttttataaccttacctcttatgtttaggtccgtgatccatttttatttaattttcctgtatgctgtgaaataagggtagaaatttatatttttacaatggatgcccaattgtctcagcaccatttcttaaaaagactattcctttcctattaaaatttcctagcatatttgttaaaaaatcaatagatcataaatgtaagagtttattactgggttcttaattatattccatttatttacatgtctgtcatcatgccagtaccctattccttactgtaggtttgtaataagttttgaaatggggaaatgtaattcctccaaatttgttattttttaaggtttctttggcaatttggcatctttgtatttatgtagacattttaggatcagcttgtaagtttttgcaaaaccaaaaaagcagagattttgatagagattccattgaatctatagaccaatttgtagagtattgccatcttaacaatattaagtcttctgatacatgaacataggatgctattccatgtatttaggtcttgtttaatttctttcagcaatgttttatagtttcgagtataaatttttcacttattttattaaatttattcctaaatattttattcttctggaatctattgtggatggaattattttcctaatttcattttcagtctgttcattgctaatgtataaaaatgcaatttatttttacatgttgattttaatcctatgacattgctgaatcaaatattttatgagagtttagaaaagcccaccctaaatacataatgataacattacagaaaacttagggggaaatctgtgagccaaccatcttgttaaaataattctgacattctgatgtaatttttttattttaacaaatttttgcacaactttgtaggatacatgtataacacaatacaatgtgccttctgtttttacatttattattgtattttatgtgtttttctataacagttttatagaaaatataacataaatgattacttgtcagagaagtaaacttgttataggacttatcagaatccataattgaggatatcaagccaaattgttttgtataaaagtgtttcagaataaatatatgggttccggggtcagaaatatggaagtcaatatcaataggaaacatataactactataacaacaacaaaatcagcaatgctattgtgaatagtgctgcgataaacatgcatgtgcagtgtctacccaaatgcccatcagtgatagactggattgaaaaaaaaaaaaaaaagaaaaaactgttttcagctctcacactgtctgttttactgtcttttaaaagttctttagttcacctatggctttcttaaattatgatgttgacagaatactttgacctgtataaagtatgggagactattgacctccttgttctggagattcattattttatttgctgcaatcttagcttctatgcagcaatattacagtctcagtttatacttattttgtgatcacctaatatcctggtttttatactcattaaatgttgttaaatcatgcttctgccatatttcttgtgtactttccttcatcttgtctccctatatttccctccctttctccttccctccctccctccctccctctctccctctctccctctctccctctctccctctctccctttcttcttttctttcttttgtctcactcttttgtccaggctggagtgtgggggcacaatcatagctcactgtaatctcaaactcctgggtttgagcgatcctcccaccttagcctccttgagtatctaggactacacgtgcacaccaccatgctcgtttgttttgattttttaaaaatttttatatggacagggactcactaagttgccgaggctggcatttattcttcctatgttttattgtgttgactttatcccacagtagtgtattctttaaaaatatctcttgacttatataaactaaaattaaataataaaaatagtcttggaagcaaaccagcctacaggtatactacatccaaaaatttctaaatctcataccaaatttgtagtgatgctttgtataaacataacgtcccaattctgcttgaactgttactacacttccacataatacagtagagtacgctgtgccaatattatgctatgctttctaccaagtgtcatgtgttttgccgcagcagaaaagattttagtcaaatcaaaaagcaatgaaactcaagaactttaccattatatttctagctttattctctcattgatgctatatttttgaaactttgatatcccatcattatcaccaatagcataaaaacaataatgccaatactacaaataataaaaatgtattattgaaatgtatatggattaaaacaaatgtgcaacatttgtaagtgttcatatgtcttcagatcttttctggcagacctggaaaatagttattgtcaaatcaacaatgaaaacaataataaactattaaatagaggagtgaggaaggagctttgcgtgtgtgtgtgcgtgcgcgcgtgcccacatgtgtttttggtggaataaatactttctctatttcctaatttatgattctactaatcaggtgtcttcaaaacaataatgtattccttggcaatacaaatctgaaagctgtcagtaaattctgtcatttatttccattgttttcaccacgtactaaaagatagaaagaacaagactataggagattgacagattgtccaggcatatgccacattagttccacagtcaaatatatattttgcaaatcataaggcacacagtcttttcaggattacacaatgaggcacagatctttacacactgtccaaacaaatgtcttccaagccaagtagacctatgtgctaaggttgatttcaaaaagagtacggtaaagaaaataagccaagataggagatcacaggagaaaatggaggttgacagatgaagcacaatggtaggaacagagactctgagatggaactttgagaatgctgaattttcaatctcaaactcatttacttatggtcataagccactgaatttacgtgtcaatatgagaagggatgaaagtattccaagcttggaaaaataactaagtttctgacgattgttgtgggaaccaattgtataatgtgaataagaattagtttatttgataagtttgagtttgctctattcatttataaaatcaggatgaaacactttataaacgccaagtcacattataagttatatataagacataggcatttacttaatcatagtgtcatttgaggcaaattacctacaacattttcaggtcaccatcacacaaataatgtctgaaaagaacctgagaaaagcccacttttttgtttgaatttattttctgttacaaggaaaagcttgagattatacagttgtttttaagttacttgagatggttttgaagaaatggacttgatgagagatgataaggggaggaatgttttagttcttgccatgtccctctctgattatctcctctgtggtcagaagatagggactggggtgaagatggcaatctggccaaagaggaggtgttagagactcattgcccttctttaccattttgcctaaaaccagccctccatctgattaacagaatatctgagaaagcaaatgtttacttaaaacccaaatgattcatgtctctatctatctatctatctatctatctatctatctatctatctatctatctacacatacctggagttcagtgtcttatcatgatctgattgtataacccaataattttctgagatagccaactattttttccagagacaatgtgagaaagaatagtttcttttgagaaaagttaaaaaaagcacctaccctaattctgaagacaaagaccataataaatgcttttaatattgtaccaaatgaaccaacatctgattccctaagaggaataacattaagagtattcatgatttaaaaaaggaacaaaggtgttaagaagaataaaatatataaactgtgattactcagagtttaatttgtacatttttgtgtggtgaattattcaaactctaacttctgtctctctctttttttaatcttaatgtcttcctttcaccacttgttatcacttccagaaaaaaaaagtagactaaaattgcaaaatagaagaaaatatagaaattatcaggggctgaagttactatagaagaagataaaaattattctgggcagctaccataactgaataggtagtaattggtctcatctggattatacttcagggcagtgtacgtaggaatcttttggagttttttttttgtataacctatatctgtctatgaagtagatatatctttataatatctgtgtgagtagaaataagtgaataacagaaaatttgagtaagccaggtaattccaagaaatgtatgtatcctacaagtaggacaatggacagataacctttaatagtcaattatagacatgagatagaaagtcccctggaatatggcaagatgacagattggacataatttgtaaaaggcagagatgtcccattccttgagagtgcataactcaagattaccctactaaaatgtaatgagagaataatgaggcatcataaatagaggagtgagacaaaatatcttgtgacaaagatttgatgttctttatcctaagggggaaaatacagaggtgagaagggagtgagagacagattttaccttggaattgtatcataagctagacttcccattgtctttctgtctcttctgagagactataagtaagctcaaaaatcaaagcctccagatagatttttttaaaagaaaaaaacgtttgaaaaaagaaggaaaacaaaacaaagcaaaatatatgaatagttccagggctcccaatccagagccgcgaggtgttcactaggttcttacctccaatttttgtcttctagcaccaaaagactactgaaaattttactctgtttttcagtggctttctctttaactttttttaaaaatgtattatgtatgtatatatttagaggaaggatctcgctctgtcacccaggctggagcacggtggtgccatcctagctcactgcagcctcaaactcctgggctccagggatcctcccacctcagtatatacaaaaataaacaaacaaatcagccagacttcatggcacaggccttgagtctctaactttttagctttgatcctttgcatctcagaattagaaaattccttgaggggagatccactgctaaatactaaattcatatccctgggcttttcctctttccagcctctccaactcttaatttttagtttctttgtcagtattgaattacaatttatatgatataaatgtttattgatgacctattatagatcaagtagtgggccacgtactaggggaaaattgggcacaaaaaaacagatgaggtcttggccctcatacaatttaaaatctgctagaggactcagacatagtcaagtaattacacaaacaaaagaagccgaatgagtggaaggaagtacatggtgccacaaacccatgccttaggtgattttaacttggttggggaggtaggcagaagattctcttaggaaataattctttatctctgactaaggatgggcaaggggtaagtaaggaaggagggctactaaagaacattataagggccgggcactgtggctggcgcctgtaatcccagcactttgggaggccgaggcgggcagatcacaaggtcaagagatcgagaccgtcctggctaacacggtgaaaccctgtctctactaaaaatacaaaaaattagttgggcgtggtggcaggcgcctgtagtcccagctacccgggaggctgaggcaggagaatggcgtgaaccctggaggcggagcttgcagtgagccgagatcgcgccactgcagtccagcttgggcgacagagcgagactccgtctcaactaactaactaactaactaactaactaactaactaactaactaactaagattacgagacaggaagcacagaagcataagccctgtgcgggatggtgagaataagaaaccaagagaagacggatgtgcctgaaaggagagagctctgggaaatttgacacgtgatgaggccagataggatgctggaggccaattcacgtcgtgcctcttaagccaaactaagaagcgttatcttcatcctcagagcaacggaagccattcaaagactttaagaagggaagaacataatgagaatggcttattggaaattttagctggctgtaatgtagctaatgggctgtagctcattacatattataataccaatgttactgttgaggagtataaatgtcaaagagattgtcaaatgtatttatggccacagagctaataagtaatggagttggaactcaagctcagaattctacttcctgacctggggcttctccctttaatcagagttgtctgatatgaaagaagaagagcacacatagaaagggctcccaggtaaacaccagcagtttgatttgattgtcagatgacaccaagaaaggagaggccagtcttggggtctatattttcaaactgggagaaaaagagagaaagaccagattggtggagaaactgatgtggcatgtgaggaatagaatactaggtatgtctaccctaaaggaaagaatatgtgggcggtgaaaacatggcaactgtcttcaaatagtgaagaatatgaatttatttgacagggcttcagagaaccaaccaaggccaatagagataagatacagggaagtaccttttaggtttttagaagagttatctgaggaggggtgttgtcgaaactgtagcagagttttcctattattgaaattatataagcagagctggataaccacttataataatagtgtagaaaatattcatcttttgggcagagaaacaaaccttctgatgtctgagagcccttccaactcctccattctgtgattctctgacacataattacacataacctttcaaatttcttaaagagaagatcccaatataaaaatacagtaaaatgtctataatgcaaataaacttgctcagagttcaaactatttttaaattttaaaatattttcatatagcaatggttgttataatgcctaaggcatggtaaaaagccaagttgtaggcagtgtagcaaattataaataccaggttgtatagtaaaacgtcattccttttaaaagcttactttagatataatggttattaattcttgaaaattagatatgctggaaatcgctttatatgtagcatatatggataaaattattattaggttttatgtataacttgattgctgatataaaattgatggtttctttgtcagcatgcaacattattaatgtgctcagcacacacatatcaatgttccaataaatactagagagcatcatcccactaaaacaaaaacaaaaacacctgtaaatgtttaagtttttcaagtgaaagatgatacttgcaatgtgggagattattttagaattgcttagtgaggcctggtttacaggcttgataagaattatgaatataacttttaattctgccaccagatggcagaagtagccattacttaggtaaatgtttacagttaaagtgctttaatatgttttacattattagattaaaccaaaacaaacaatttggatatttgtaatagcgtgtaacatgttttgtaatggtaaagatggaaaatattagcttaaatgagattttggaattaaattaatcataatgtttatgtatcccctgagaatagtatttttctttaataaaaaaactctcacaaggaattcccactgatatgttttaatgaatgcagtaaatatcttaattaattatttatacattaataattcctatatcttcctaaaggtagtcattggactcaatattggggtaaatttaaaagcattatgcacatgctgagtacaaaccaaagactaaagatattatatagttattgagttaaggcatggatgattttttaaaaagattacaaatgttacaaacgaaatacaatcacatgtacctaatacaaagttatttgcctttaataagttaaaaaataaaattaatttgtctagtctctagacaattttaaaacatcaatccaaagggatacatgtgtttctttactaaacagtaaatgccatggctaattaatgcgtgttttcaaagatcacggatacattagctgttttccatatcaattcacatttttgttgtgttgttttgttcagtcctttaaaaaaatctacttccttacatcccactgactctttaaccttctacatctggcttatcctaactatgacaaagaaaatagttttatccagtaaatttgactcttctttaccaactaacacactattttggtcctaaactctcagtattatgtgacaaagattactgtgtttttcttcttaaaacaggatctttccttgactcatttgcttccatactccttcatgtttttctttgcactgctttttagtctatttggagggggagattcttgtcctcgactccacctgcagatgtcagaaatcataggaccacttgttttcttttttttttcccctcaacatttccctacatagtgccattcattctgtcacctcccaatgttatctctatgatgaagcttcccaagtgcctatcccagcccacttctctctactgacctctagacttgtacatccaattgcctccttgaacaaagtctcttttattctagtacattccctttcttcatgagactgacttgatgaatgggctaggcacaatgttttaccttccagcaaaagtgtcgaaaatgtgctaaagtaaaaaccacacaacctattttcttgtcaagtgggaaaaagtaattgtacaggagaatggccacactatcatcagtttcatccagaagcaagatatttataaagggctttgaaaacttctgcttagggcagtaataactatatagttaaggtgtgccttaatttacagagtagacatattaggactaaagataagcttgagctaaattgtgttaattcataatgcattaattcataaagttctttgcagtgaagattcttggtttacactggttgttttatactgaaagacctgtcaacttaaatatgactgtgatgtatattttctatttattgtttcacctagctagtgacctatgataggccttggtgccaaatattctgcccaaatgaaaacaagatgcaatacagactcactttaaattagaatcaagaaacacggaaagaatgagacactggacaatgagatctacccatgtaaagttatggattaaattactgaagaggccatgagtaaagccacgtatgaatgaggctgttctataaggaagaatagtgtttgttaaaatgagtacctgctatgtgctgagtattgttctgagcacttgtttgcaggtaaacaagaacatttaccaagtaaggtgcatgttaacaagtaaacacattcaaaattttgtggaagaacattttaggcagcataaacaacaaatgcaaagatcctaaggcagaaactaaaaaacgaaagaacagccactcgtttacaagcaaacgagaacatttactggaaaacacaccttaaagaggaaagaatggtatagctatagtttagtgagtgagaggttatcagagaccgggggtataggaggatgagctcaatttctaaatcaaaaccagtaaagatttttaagaagaagttcatgtgatgtgatatgtgactactttggctgttgtatggaccatgggttgcaagcctaaggctaggaggatatctcagtgggaaacaaaagaaagcaatatgtattttttgcctcaaatatggcaaataggaaagattatgagtaggccaagtagatgacaggatccatgtagtactgttttgcttttgtttatattttttagaactgaggtatctttcatgtatatgtaggctaaaataaaggagaattagataaggagagttaaagaagcagagatagaagagtaaagatacagaaaagtgtctaatgatctaagatccttgttgaggtgtctacaattaaatttaagaagtgctggctcttgtcaggccccatgttctattggagttgtctcaagttgggctagaaattggaaaaaaaatgcacatcatagattaatggtagagttttattgaaaaaaggagaatctggcatgactgggatcagcaagacaaagatgtaaaagggcctcttgactcattatcattctacagtgcagcatgccaggagcagggcatctgctggacatgcatgttttcattttggtgaaagaatacctcacctctgtgtgtctccccattaacagagcaagcatgagaagtggccttgacagtaagggaatacattggatttatgtcatcgggaaatctggattttgtgtgcttgccaattattaggaattctctggggaagctagatattctctatctaaggaaataggaatctgaaaggtctgagagattctctgattcaccctggctaagagaagaagtctttggttctgtggaaaggtggacttgggtatgtactgtaagttggaaaaaggaaaaactcacccaggtcctagcaagctcattgtccatgcaacccacaggaaacatctaaggtcatttttagatatttctgctaataacacagtagctctaaatgaaaaaagaggtactacatccaatactagagaaaataattatataacaattaaggtatttgtggtgagaaggtgacaggagaggaggaatgtaaataactgatgttctcaattttcccaatgaaaacaagcagcaaggttacttgctgagaatgggagaggttgtgtgggaatattgtggaagtttaaaattacaattaaaaagagaagctaagaaaaagtgaaaagattgatgaacaattccaagggcccacatgatgcacttttatttagggggagacatggtttatcaatgttaatggtattgacatgcatgtgtttatatgtagatgtgcatgttttcctttaacaacattaactctgtttctagaaatcaggtgggaggctatataattgatttatatttggaatttttctagttgtatgtggtagaaggatgggattcatggtattcataattgaggaagctggtgagaggttagtttagatgataaaccatacaccatggcacccacgcatcgtacgaaaaggatagaagccctaagggggctgacaggtcaagaggaaagtattcatcaaaaagataatattctctctgtttaagaagttccatggatcagaagagtaagagagaaggatagttagaggcttttgtcagactatggaatgctggtatttacattgttttaaatagagccatttaaggtgataaatagaatataacattattattttgttgccaaagtagactgagaatagcatggacattaagaaggtccaggattttctggtttaagagtattggataattcatttacatgaatcctgaagccttctaaaattatagtgggagttctgatggaaagaaagagtatgaggtctcccaaattttggcaagtttaagtaatttattgaaaattcaaatgattgtagtggcaaggaagtagactcatatgacattatggcatgactcttcagagaagataagacattataagagatgacagttatccaagagaatgcagtcacccctcttccaccatatccaagtggtacaaatgtgaggacaggtgtcacctccttaaagaaagaaaaatctgctcagctaatacataagataatttgaagatatagaggacaattcagaagagtttgagggaaggaagtcaatacagcaggaggaacaagcagcaaagtgtatcaaaagaatgagagctctggggaaagactggtctttagtttcgtggtgcggaagtactagggtggggagcagaactaactacctagctcaaatattttgatattggtctaagttatttggttgcagaactggctgagggtctcaggtaatatctggctgtgttaaaatgtgtaatagataatatttcaaagttgtggcaattgtctgttttgcagaaagaccattccgatttggaacagtgaataggctcctggtgaagccaggactactgtgaggattgtggtgtagctgtttgatccttcttctgggttgtgtggaatgtggaaaacaagggtgtagtagtgatgaagggagggtctcctggaaaatttgttttcatattgacttttattaaattttaaaaggaagcaatagttaatatatacacttttacaaataattaaaatatacattaatattcagtttttacacttctgcttatttttaaacaaagatttctctctttgtttaacagtaagaacattaaggttggtgtctaatgtagctcttggaaatacaaaatctctttcatttattaatgactataattaaggtacacatttgctaagaccaataattaggttccataatgaacatactacagtaatcgttagctgtgacataaaacatgacaagatgagggtttgcttccctttctctttccctccagtttatattctctctaataaaactcttaaatcttctgtgtctgtgtatgtgtgtgttttgcacctaatatggaagactggtgtgctggcaggatggtgaggagagccaatggtctcatttaatgaaattggaagcttctctcttcttttgtttttcttctctattcctcaccatgtttcttctatacccctgtacatttcactgccaaccgacaaggcaatgagatgaaaaatacaacagagactagccagaaagagaataaggagcattgtcccaaccgtctgctgagaaagaaatgcattcttcccagctacggcattcagtcaggttagtggttgagaactgaaattatttttgctggtataatttatatattttctttatgatcctaacataaaatcagcactatggataagattgctgagacagatagctttaatatggtaagaaaaggaaaggcaagcagtgaggggtcaatcctggaaactgcaccaaggtggctggatgacacgggtacactcagctgcaggcgacctgagggagttcaggcaagcagagaacacagaaagagataatacataatcacagtttcaggggtaggaaatcttcaacaagagctaaaatgggcctagcaacaggagttagaagcatggtaaagaggaggtggagaacagagatggtgagattcaggctgccaggaagacagttttcagttgttacaggaacctgataagtgaactctggtcttacagaaaactgttaggacaaagtagaatcacagaatgagaggaacttaggtgcttgaaatcatgtcaaggcaaagtaccagagaaaaagagaaggaccaggatactggaataagtatggaataacttaagaagaactgggactcaggagtagagcaaagttttaagggcctatattatactgaattgcttttgcaaatgaaaccagagtgtggcagaggaagctatttgtctctgacctgatgcaggtctaagttagtagttggaggctaagagactcagctttaggttaatcggcaaagataaggacaggaaatctaataggttattacaaccaaaatatctttttaaaaagtgattagaattgagtttgaaataaaggtgattggatgattacctggtagcagatgtatgtttatttgtgggaggagggtgcagggcagtgcattagttcatgagagaagagactgcaacttacagtgttttggttccagaacatgctaggattttttttctctcctggtatctggaacatttggtatccaaataattttaattctgtttaacttaatagctaactttgggtttattcattcatacaacaaatatttagcattttttgttttattacatgtaactaggcaagtcctatcatctctaggaaactgggacgagtacttaaaactaaacatgttttgtttctttgctttgatgcattgtttcatatgttatcttttttttttgagtttcagataacctgaaagaaggttatgaggtttgtatgtgaaaaaataaagaataggatttttaaaagattaagaaacagccttcaattcatagtctaaatttgggtaagaaaagaaatgaaagttataaaattgacttcattccatgacttaaaatttcctttgagaagttctgcttcacttaaaaaatgagaagccttataagaatgtcactctaacccctaatgaagagagcaaagaagaacagtgacacgataactttttctgaacccctcagagaactgaagtcacaaaaaaatagatgaactgaattccaaaggggccataaacaccttcaaagagaggcagggcacacctttagcagagcaatggagaaagagatggaaaccattaaaatgggtaagaagcaaagaataaacattttaatgaaatctcaaaggtcaaatgtaggctagtgtagcagaatagaatccctaggagtactggacataaggcacaaaagcacctccaccctccacaccagataatttccacagatttccaccatgtgctcaaaagaaaagatggagggcaggcgggagaccacagaggacaggcaagatactccacatgcttgtcacacccacctctcattgaagcaaaagctatcttctgctagaggaggacaggaagcactcctgtgccctggtccaggggaaaggtctgctgctattgggggacaggtagaagcaaaaattgtctgccaatgaaagaggagcaagaaacatgcccagttcagattcctgtgctgatacagaagcagaggcggtctgctgctactggagaaggaacttaaagggaaaaattcctttgagttcaaattctccagttttggaaattttatgcaaatggactcccatgagataaaacaaacaaaaaacacaaactctctccccaccatggcaagaagcacccacaacacacacacatcaaaaaatacaaaacagagtttagctgacatgaagaggcaggaaagaaattctgagaagcccatactctgaggttcagatgcacaggcctgtctaggatcggggctttgaaaagcagcagtcacaagcctgagacacagagggagaaagtgggtaggaggagacggaggtagggagagagagagatcggtagggtgagagagagactgaaagagagatgaattgattgattttaagaaatttactgacatttttatgggaacagtcctaaatttgcagatcaggctgacggggtagaaattcagggaaaagttcatgttacagtcttcagtacaaaatctgcaggctggaaacacaggcatggtttctaattctgcagtgttgaggaagaattgctgctgctttgggaaacctcagtctttactcttaagacattcagctggttggctgaggcccacctaattatggagggtgatctgctttactcaatgtctaccaatttaaatgttaattacatctaaaaatatacctttataacaacatctagatctgtatttcaccaaacaattgggcactatagtctagacaagttaacatgtaaaattaaccatcacaatggtcagtatcagaaaggatacttcagaaaaattattaagaataatagcccaagtgaagtggctcatgcctataatcccagtactttgggaagccaaggcgggcggatcatgaggtcaggagtttgagaacagcctggccaacatagtaaaaccctgcctctactaaaaatacaaaaattacctgggcatagtggcacacgcctgtaatcccagctactcaggaggctgaggcaggagaattgcttgaacctgggaggcggaggttgcagtgagccgagatcgcaccactgcactccagcctggtgacacaatgaggctctgtctcaaaacaataataataataataataaagagggacattacatgaagataagggggttaacttttcaagagaacataacagccttaaatatatatatatatatatccatagcttctaaatacatgaagcaaaaaccaatagaactgaaaggagaaatccataaatatacaattatagtaggagactttaacaattctcacccaataatcagcagaatatataaacagacgattcaaaaaatataaaaaacctgaatagaactatcaaccaacttaacctaattagcatttatagtacactccaacctacaataacagaataaataatcaagatattctgggcaatcaagtttcaataaatttaaaaagattgaaacaactgaaacatgcatgaatatgtttgcatcctgagagcattttattaagttaaagaagacagcaacaaatggctacatactatatgatttcattaatatgacattctagaaaaggaaaatctactgggacagaaaggttgccaggagccagatttgcagggaaggtaattgactgaaaagaacacaagggaatttggggaatgatggaaatgtcctatactatgattctagggtagttacaggactgtgtgaatttgtccaaacttactaagctatacatttataaagtatgaattttgttcaggtaaattacatctcaataaatgtgatttcttaagataaattcctttgagttcaaattctccaattgtggaaattttatacaattagactcccatgagattttttaataaaacaaaaccacaatagtgggttatcaaatacccaggtggtactcagggccaaagggtatccctttgggcccctttgtatgaaagccttgtccttcctttaactaccataatggcacatgttcactaactagatcaatttttatctcaaagtaaccacaaatgaaatgttttttaaaatattagatatgttcattaatttttacttattatacgtataacaattatttataatttggttctcattacctagagcacatttgtaacttttttcaatagtagaaataaatttacatgatattgactcataattgagggctataccttattttcatcaaaaatatacttagttggactgtaggctaattggaacaaagaattaggcagctcacatactcattaaatattctattgaagattaatatgcagaaatacacacaaaatattcaagctagatagattttcatgaagtaaacctagatcaagaaacaaaacattgtcatctcctggaatccttattttgcctccttgcagtagctaccaactccccatatcaaaggttcctgctgtttttgaaactttcataaatggaatcatacagtatatacttttttgtatgtgatttttaaaatagtattttgtgtgagttacatccatatcattacatgccgttgtagtttggtcactgtcttggctgtataagaatgcttttatatgaatgactacaatcattttcccattctgttgatgaccctattgattttgttttcagtttgcactagttcacagcttatagctatgaacattcttgaatatttcttttggttaaaatgcataggcatttctgatgggcgtgcttctaagaatgtaatagctagatcgtaggacatgcacatatatttagctttactctgtaatttttttcaaataaaatttatttttctaaatatgtcatttgtaataaagtgctaaattttcggcattaaaagatgataaattattacaaacaataccactatctatctgcttgacatcttatgagatacttatgccaatatccagaacatattttatatcttggtgtgataaaaagatagcctttacacatgtctcttatgcacatgattcctaaggcatattgttttctaggcctccagtgacacataactttgacagtgcatgataacaatgctatgttcatggattaaaaatatgcataatttcatattttattccccttaggaaatgttatcactgaacttacagtgaatgtagttgtcagtattccacctgtgaagcccaatattactgtaataaatgctctagaaatatgataattgacttctctgagtgccaagaagaatcagtagtcaaactagggcctgcaagaatgagcttcccctacagcaatgtaataaaattttccagggtcttagatggagtattttcttatagagcctgatattttaaaaggcaaacttataaaacagataaaaggaattatttttgtttatttaataggtaaaattacacagtacactataataatagttatataatgttccaaaaataatttgtcagtacatataatagtttttatttatttcttgatatttaacttactactttgtacaaagcatgcatatatatatatatatgcttatatatatatacttatatatatgatatatatatatatatatcacagtcagaatggctactattaaaaagttaaaaaacagcagatgctggtgagactaacagagaaaagatgctggtgagactaacagagaaacactatatacactgttagtgggaaagtaaattagtttagccaccgtggacagaagtttggagatttctcaaataatttcaaactaccatttgatgcagtaatctcactactgggtatatgcccaaaggaaaataaactgttctacccaaaagatatatatatacttttatgtttattgcagcactatttacaataggaaagacatagaatcaacctaggtgcccatcaacagtggattgaataaagaaaatatggtacatatataccatagaatactatacagccatgaaaaagaatgaaatcgtgtcctttgcaactggaggccattattccaagtgaattaacacaggaacagaaaaccaaataccacatgttctcacttataagtggtagctgaacactgggtactcaggggcataaagatggcaacaatagactgggaactactagagatgggaaagagggaggtgggtaagtgttgaaaaactactgggtactatataggctgactacctgggtggtgtgatcagttgtaccctgatcctcagcatcacacaatatacccatgtaataaacttgtacatgttctccctgaccctaaaataaaagttgaaattattaaaaagtaaaggaactggaaggcgttaaatgctgcctaactttgtaagcttctcttgtttcttccccatccccaagcataaagaaggactctctctgcaatttccttatctaagtaaacttctttccatgagaaatgcagtcctttaaagatcccctccataggaatctcatcaaattagcaggaaagtttaatcactggaaaagagaaaactaaaagctgttaccttgcgcagtagatctttcatcagttctttactcctggatattacctggtagagtttatctcataatatgacaaccattgttcacagtaaagttccacccctcaccttcctgccacctccctgggacctcagaggaactttatctcaggtcattgttttcttggctcattcatttctcctaaaaatcatttacttcccctgtaatgtttcctgaagtctctcactttcctgtcccctatgaagagtgtatatgagcctcaaacatctggctctgccttgggtctcatatttgcaggactgccaagtccatgtatatatgaataaactttgtatgccctttttttactactcatctattgttggttcattccagtgaaccctcagagatggtgaaaaggaagcattccctttcctacaaaggcatgcataaataaacatacattatatggtttggttctgtgttcccactcaaatctcatctacaattgtaatccccatgctttaagggaggaacctagtgggaggtgattgtaccatgggggtggttttcctgctgccattctcgtgatagtgagttctcatgagatctgatggtttaaaagtggcagtttcccctgtgctctctctctcctgccaccatgtgaagaaggtgcctgcttcccctttgccttctgccatgattgtaagttttctgaagcctcccccgccatgtgaaattgtgagtcaattaaacctcttctgtttataaattacccagtctcagatagtaacttcatagcagtgtgaaacctgactaagtattaaaagtgtacattcattcatctgtatgtttactcttttaagaaatactagttatgacttttatttcagtgaagtttctcttgaaggagtggaacatttctttataaaatagagctccaaaatgtgtagagatattgaataacattgttattttattcccatgattccttatttaagcaggccctacaaagtatagtatctgaacgcccaattccaatcagagagttttgcatttcttactattttcttcaaatgatattcaagctattttatttcctggaaaatgccaacatgaaaaacgtttggaagtttgaaagacttctctgataaaattctaagctcaaaagtggcactaattactagccaacattttatgtgtccatttgttaacttgtttatttgattattatctgtcttccttttcagaaggtagatgggaactattttatgttcactcttatattctcagttaatatcacaggtgttcaattaatatttgttgtgagagtaaaggaataaatgcacattctttgaaaactttttttttttcccagaagcgtctacttctgtcacccaggctaaagtgcaatggcacaattatagctcactgcagctttgttctcctgggctcaaggaatcttcttgtctcagcctcccaagtagctgggacataggcgtgcaccaccacactcagctaaatttgtttggtcttgttgttttttgtttgattgtttgtttggttggttggttggttttttttttgagacagagtcttgccctgtcactcaggctggagtgcaatggcacaatctcggctcactgcaacctctgcctcccgggttcaaacaattctcctgtttcagtcttccatgtagctgggattacaggtgcctgccaccacacccggctaatttttctaatttttcgtgtttttttttttttttttagtagagacgggttttgccatgttggccaggatggtctcaaactcctgacctcaggtgatccacctgcctcggcctcccaaagtgctgggattacaggcgtgagccaccgttgtttttgcttttatttatttttgagataggatctcactgttttgcccaggctgaagtgcagtagcttgattacagctcattgcagcttcaacttcctgggatccagggacctcctacttccagcctcccaagcagctgagattcctggcgcatggcaccacacccagctaatttttgtattttttgcagagattgggttttgccacgttgcccataaatagatatcaatgcctgtaaatagatgtaaatttatgtttgtatttctttattgatttttggtaaccttttttttgtgtgtgggaaactctttttattttgtcgtagcttacagattcttcagtaaacttgtattctttggtgatgggctccaagtattcaaattaggactggggtgatttttggcagactgcacaggaatagatgcttaaaaagtgctttttcagtttttataagcacaaaaaaggtagaaccttgatttgctgagaatgaagtgtgaaaaactttctaagaacatcatattatttaaattattttatgtctgcatttgtttttgtctacttaatctgttagtgactgcaataaagacttctaaataaattttaaatttgctatatatattttattctatcccatcagagatatatagatttatgatttaatatcataattatgattgtatctttcattaatagtaaatgacatttgtgaccatttttatctttttaatgtaattactaattgtataaaattagtactatcaacctaactttattttgtttacttatatgtataatgcttttatttatttttgcatgtaaataattattaaatgtgtactaagtttgcccattgggcaaggatctgggcataaaatgctccaaaaatataaacaactataagaaattcctttctgaaattctcataaatatttacttatctttttttcctccttaaaattcctgtattgcagttttttaataattaaaatacagacaaattttgttctgccggctattttcttttcctcagtctgtgaattcttgtcttttataggttgattaaatcttgtaggttcattcttctgtcatattgttttctatttttatgaatttgtgaaaagtattaaatttattttctaacttgtccttataaagtgttttcttgccttttattcttctccagtaaattgacaagcttatagcctctaattcttctggcagtttacgttgacaaaatattctttaacctatgttatttcatcaaaagttgaaagcaaaatgatgcaattttaaaattttattttttcataataaacagggattaggttgttattaagttcttttttaaatttttaattgtgtgtatagtaggtatacatatttatagggtacatgggatattttgatacataaatgcataagtaataatcacatcaaagtaaatggggtatccattctttcaagccttcatcttttgtgttacaatcaatttatgtatactattttagttactttaaaaagtacaattaaattctaattgactgtagtcaccatgttgtgttatcaaatatgaaatcctattctttataactaatttttgtaaccattaaacattaacctcttcccccacaaccacactacccttcctagcatctggtaaccatttttctactatctgtctacaagagttcaattattttaacttttagctctcacaaataagtgagaatgtaagaagtttgtctatacctgtcttatttcacttaacataatgacatctgggtccatccatgttgttgcaagtgatgggatctcatttttttgtagctaaatagtactccattttttatatgtaccacattatctttatctattggtctattggtggacacttaggttgcttccaaatcttggctattgtgaacagtgctgcacaaacatgggagtgcagatattttttccatatactgctttcctttgttttgggtatatccctagtagtgggattgctggatcatatggtagttctatctttagcttttaaggaacctccaaactgttctccatagtggttgtactactttacattcccaccaacagtgtatgaggggtcccccttcttcatatccttgccaccatttgttattgtctgtctttttgatataagccattttaactggggtgaaattatatctcattgtagttttgatgtgcatttcatcgatctttttatatgccagtttgccatttgtatatcttcttttgagaaatgtctattcaaatattttgcccatttttttgagtggattattagatttttcctatagagttgtttgagctccttctgtattctggttatttatcctttatcagatacagagtttgcaaatattttctcctattctgttagttgactcttcactgtgttgattgtttcctttactgtgttgaaacctttaatttgatgtgatctgatttgtttacttttgctttgattgcctgtgcttgtggaatattactttagacatctcttttttcctttatttcttctaaaaaaatgagatacatgtacagaacgtgcaggtttgttacgtaagtacacgtgtgccatggtggtttgctgaacctattgacccgtcctctaagttccctctcctcaacccccagcccccaacaggccctggtgtgtattgttccctctctatgcccatgtgttctcaaggttcaactcccacttatgagtgagaatatgcagtgtttcgttttctgttcctgtgttagtttgctgaggatgatggcttccagcttcatccatgtccctgcaaaggacatgatctggttcctttttatggctgcatagtattccatggtgtataagtatcacatttctttatccagtctatcattgatgggaatttgggttgattccatgtctttgctattgtaagtagtgctgcaataaacgtaagtgtgcatgtgtcttatagtagaatgatttatattcctttgagtatatactcagcaatgggttgctgggtcaaatggtatttctggttctagatccttgaggaattgccatactgtcttccacaatggttgaactaatttacattcccaccaaaagtgtaaaagtgttcctatttctccacagccttgccaacatctattgtttccagacttgttaataattgccattctgactggcatgagatggtatctcagggtggttttgatttgcatttctctgatgatcagtgatgttgagttttttgttttgtttttatttgctttgttttgttttgttttttgagacagagttttgctcttgttgcccaggctggagtgcagtggcgtgatctcggctcaccacaatctctgcctcccaagttcaagcgattctcctgcctcagcctcctgagtagctgggattccaggcatgtgccaccatgcccgactaattttgtatttttagtagagatagggtttctccatgtttgtcaggctggtctcagactccagacctcaggtgatctgcccacctgggcctcccaaagtgctcagattacaggtgtgagtcaccacaccacacccggcctgttgagctttttttcatatatttcttggctgtgtaaatgtcttctttcgagaaatgtctgtttatatcatttgcctactttttgatggagttgtttggttttattttgtgtaaacatgtttaagttccttgtaaattacggatgttaggcctttgtcagataggtagattgcaaaaattttctcccattttgtaggctgcttgttcactctaatgatagtttcttttgctgtgcagaagctcttttgtttaattagatccaatttgtcaattttggcttttgttgcaattgcttttggcattttttcatgaagtctttgcccatgcctatgtcctgaatggtattgcctaggttttctactagggtttttatagttttgggttttacatataagtctttaatccatcttgagttaatttttgtatgaagtgtaaggaaggggtccagtttcagttttctgcatctggctagccagttttcccagcaccatttactgaataggagatcctttccccattgtttgtttttgtcaggtttgttgaagatcagatcattatagatgtgtggtgttatttctgaggtctctgttcagctatactacaaggctatggtactggtaccaaaatggacgtaccttagacatctttgcccaatgcaatgacctggagagcttccccaatgttttcttttagcagtttcatagtttgaggtcttaggtttaagtctttaacccatttatattgatttttatttatggcaagagatagtggcctagtttcattgttctgcatatggatattcagttttcccagcactatttatggaagagattttcctttcgcctttgtgtgttcttagcacttgttttcaaaaatgagttcactgtagatatatgtatttgtttctgcattctctattctgttccattggcctatatatctttttatgccagtaccatgctgttttggttactttaggtctgtagtatagtttgaagtcaggtaatgtgattcctctaattttgttcttttagctcagggtagtcttggctattctgggtcttttgtggctgcacataaattttagaattgctttttctttctgggaaagtcattggtattttgatagggattgtataaaatccatagatttctttgggtaatatggacactttaacaatattcttccaatctatgaatatggaatattctttcattttttgtctcctcttcagtttcttgaatcagtgttctagttttcattgtatatgtttcacttctctggttaattcttagatatttaattttatttataactattgtaaatgagattactttcttgatttttttttcaaattctatactgttggcatgtagaaatgtagaaatgctacagatttttgcctgttgattttgtttcctgcaactctactgaatgtatcagttctaatggtgttttggtggagtcttggatttctccaaatataagattatattatctgcaaacaagtataatttgaattctttctttccaattttgaagcactttatttctttatcttgtctgattgctttagctgggacttccagcactatgttgaataacagtggtggcagtgggcatctgtgtcatattctagatctttgagaaaaagctttcagttgttcctcatttagtatactactagctgtgagtctgttgtatatggctttaatatgttgaggtatgttccttctattcccagtttttttaagatttttgtcatgaagagatgttgaattttatcaaatactttttcagcatcaattgaaatgatcatatggtttttttccttcattctgttggtaaaatgcattgcatcgattgatttgcatatgttaaaccatccttgcatccttgggataaatcccacttggtcatgatgagtcatctttgtaatgtattgttgaatttggtttgctagtattttattgaggatttttgcatcagtgttcatcaggaatattagcctgtagttttctttctttctttctttcttttttttttttttttttttttgatgtgtctttgtttcgtttaggtatcatggttaacagtggactcatataatgggttcggaaaaattccctcctcccctatttcttgggatagttttagagggattggtattaggtcttctttaaatgtttggtaacattcagcagtgaagccatcagttcctggcttttctttgctgggagagtttttattatggctttgacctcattacttactattggtctgttcaggttttggatttctttatgggttaatcttggtaggttgtatgtatctaggaacttatccatttcttctaagtttttgaatgtattggcatatagttgttcatagtatcctgtaataatccttttaatttctgtggtattagttgaaataactcttttttcatccctgattttatttatttgggtcttctctcttttttcacagtctggtttaaagtttgttaacttcgtttatctttcaaaaaccaactttttgtttcattaatcttttgtatttttttcctttcaatttcatttatttcttctatgatctttattatttattttattattctaactttgggtttggtttgctcttttgtagttctttaagatacatcatgaggttgtttatgtgtagtttttcttttttgatgtaggcacttatagctataaactttcctcttagtactgttttcactatattccatacattttggtaagtttagtttcaattatcctttgtttcaagaaatttttcaatttccttcttaatcacttccttgacccactgatcattcaggagcatattgtttaatttccatgtgtttgtatagtttccaatattcttcttgttattgaattgtagttttattccattgtgttcagataagatgcttaatattatttcaactttttgaatgtcttaagacttgttttgtgacctaatatatggtctatccttgagaatgatccatatgctgatgaaagaatgtgtattctgcagctgttgcatgaaaagttctgttaatatctgttaggtccatttgttctatagtatggattatcaaatgtttctttgttgattttctgtctgggagatctctctagtgctcaaagtgaggcattgaagtctctagctatttttatattggagtctatctttttatctctaataatatttactttatatagctgggtgctttggtgttgggtgcatatatatcatcatactgaattgatccctttatcattatatgatgactttctttgtcttttcttatggtttttttatgaaatctattagtctggtttctgtcggcatggaataactttttccatccctttattttcttcttatgtgtatctttataggtaaagtgtgtttcttataggcaacagattactgggtcttattttctcatcaatttagccactctatgtcttttaattggagagtttagtccatttatatttaatgttattaatgacctactctggccattttgttttttgttgtctagttgtttcatgtttttctcttctttccttcctctcttccttttattgaaggtgattttctatggtgatttgttttaatttcttgcatcttattttttgtgtactcattgtatgtttttagatttgaggttaccatgaggcttgaaaatatctgataatctattattttaaactaatgacaacttgacactctttgcataaataaactaacaaaaagaaaacttgtataagttctacatatactatgtcttgaaaagttattgtagttattatttttgattagttcatttttctgtttttctacttaacatatgagtaatctacacaccacaattacaatgtgataatattctgtgttttcctgattctttactattaccagtgacctttgtatcttcagatgatttcttattgctcattaacacatttctttctgattgaatgactccctttagcatttcttgtaggacaggtctggtgttgaaattccagagcttttctttgtctgggaaagtctttatttttccttcatgtttggaagggcctggctatactattctaggatattttttttttccttcagcactttaaatatgtcatgccattctcttggtcagtgaggtttccactgaaaagtctgctgccagaggtattggagctccattgcatattatttgtttcttttctcttgctgcttttaggatcttctctttatccttgatctttggaagtttgactattaaatgcactgaggtagtcttctttgggttaaatctccttggtgttgtataactttcttgttcttgaatattggtatttctctctagatttgagaagttcattgttattacccttttgaataaattttctaccccgtctctctctttctctctactacctcttttttaaagccagtgacttagatttgcccttttgagcctattttctaggtcttgtaggtgtgcttattcttttttattctttcttcttttgtctcctctgactgatgttttcaaatagcctgtctttaggctcactaatgctttcttctgttttatccattctgctattaagagactctgatgcattctttcgtatgtcagttgcatttttcaactccagaatttcttcttgatttttctttattatttcaatttctttgttaaatgtatttgataggattctgaattactttctgtgttattttaaatttcttgagtttcatcacaactattttgaattctctttctgaaagaccacatatctctgtctctctgggattgttccatggtgctgtatttagttcctttggtgaggttatgtttttctggattgtcctgatgcttgtggatatacttcagtgtctgggcattgaagagttaggtatttattatcgttttcacagtctgggttggtttgtacctgtccttgttcagaaggcttttcaggtatttgaagaggctttggtgttttggtccaagtttttggtcactagagccatatctgcattagggagtacccaaagccccgtaaagctgtggttcttgaagacttgtaagggtatcaccttggtggtcttggataagattcaaaagaatgatctggattgccaggtagagactcttgttccctttgcttactttctcctgaatagagtccctctctctgtgctgagctgtccacagctggaggatgggtgacacaatcacccctgtggctaccaccactgagactgcactggcttaaacctaaagccagcatagtactggttctcacccaaggcccactgtaaccactacctggctaatgcctacattcagcaaggccctgggctctaacaatcagcagatagcaaagccagccaaattcgcatccttcccttaagagaaacaagttctcctgggctctaactgggtccagagttgctgtctgggagccagggcctagagtcagaaaccttagaaatttccctgaaaccgtaagacaaagttcttcccacttttttcttttgtgaccccagaaagatgagctggtgtcatccaccaccagctcaggcccacagggagtaccaccagggcattgccaatgtgcacataaggctcaagtgtctcatcggtaagcctgtggtgaatgctgctaggcctaggactcgctcttcagggatgtgggctccctgttgcccctggtaggcccagaaaagccatctaagagtcaaggcctgaaattaaggaccctcagagcccacttggtgcccttccccactatggccaagcaagtacctaaggtgtaagtcaaagtcccctttactcttccctctgcttttctcaaacagaaagaatctttctttctagccaccacagctgtgaatgtgctggatcacacctgaaggcagtgcatctcagaatctcacccaagtcccacagtgcatactacttaattactgctgctgaatatttagggcccagggactatttcatcagtaggtaatgaatccttcaaggaccgggtccttcccttcaaggcagcaggttcccttctggcccaagatgtatctagaaatgtcatgcaggaatgacggcctagaataagggcctcatgactttacccagtgcattatcctactgcggctgagatggtatccaagttgcaaaacaatgtcccctttactcttccttctcctctcatgaagtggaaggaaggggtctcttttggagctgtgagctgcactgtctggggttgtaggaggggtggcacaaggactctcttagccaccatggcttgtgtctttactaggtcacacgaccccaagtccactggctccattgccagcacagcactagaactttcctaggagtttcagtctttgtggcctagactgcctttcaagtttatttggaaccccagagccgtttagccctctgtagcaaggcttgccgaaactgaagttccaaccagtgggatggcaatttctctgtggctagggctggtctaaattctccctccatggacatcaactgagttcttcctggtgttggcagcactgagttccaatgcaaaatcccaccactgtgtggtccctccctaaagcacacagattctctatctgggtcactcattcactactgtgggatgggtgaggggtagtgttggcaaatcaagactgtctaccctcttcaatggtctttagtgcctctttcagtgatatgaaattaaaaacaggtactgtaatttcccacctgatttttggttcttataaaggtggtttttttgtgtagttagttgttaaatttggtgttcctgcaggaaggataattggtagaggtttctatttggccatcttgctctgcctttctccagtaagttgttcttttattagtaaattattattttcatgtaaaatgtgtaattcattgtgaaaaattatgagttaatttttgtcttctattttggttccacatttacaccaactacttgacattatcctgtattggattttgctcagtactccctgaatctcatttacttctttcgaaggcccactttcagtccttttccatcacaaatttcccaaatctgaattcttttatgattcctattttgttgactgacaaatatttttatgcatttgtctttcgggacatttgtattataagtgctgtgttttctgaggttttgaatagcttatgacctatacatatcaatgatatatggtagaataagggtctgatttataactctttctcaaaattccttagttgttgctttattttattttaatttattgttgaaaagtgaaacatgactttttttttttttttttttttttgagatggagtcttgctctgtcccccaggttggagtgcagtggcccaatctcagctcactgcaaccttagcctcctgagttcaagcgattctcctgcctcagcctcccgagtagctgggattacaagcactcaccactgcatccagctgatttttgtatttttagtagagacggggtttcaccatcttggccaggctggtctcgaactcctgacctcgtgatccacccacctcggcctcccaaagtgctgggattacaggcatgagccaccacacccggctgaaccatgactttttatctttgattgcagctgatatttctccctgccaaaatgcttttcaattcataattcaggtgtttttttttttttaacctcatattttcagaggattcctttcttacatttgtgtcaaattagatgaagtcctgttaactaacattcaaagttcttcatggttgtcgttgttgtgttggtagtttttgttttattttacattcatttgtttgcttgtttgtattcagctcaggaaaattttcttcatttgtgtcatggattttcatttgtcttcaattctgcatgttcgtttttacaaaagttataacactaaagcctgcaaatccccttcccttatctccttgaactgtctcttcatcctaggagagcttatgtatgccacatcacctgtttggtattgtaatcataaatgacatttagcattttaaaactttacaatattaattaatttaatcctcttaatcatatgttgaatatgtgatgattcttaccccattttataaacagagacataaccaggttttataatttgctcactataatgtgactagtaagagaaaacgcagtcttgctccaaaccccatgctgttgaacactgggctatattgcctctgaaaaggaaatttttgcttttaattctctttatttttttaattttttatttttttgagcactcactctgtcacccaggatggagtgcagtggcacaatcttggctcactgcaacctccttccccccgggttcaagtggttctcctgcctcagcctcgtgagtagctgggattacaggcacttgccacggcgcctggctaatttttgtatttttagtagagatggggtttcatcatcttggccaggctgatcttgaactcctgacctcgtgatccacctcccctgtcctcccaaagtgctgggattacaggcatgagccaccatgcctggcacttttaattcttgttggggctcagaacacgataccccgaagtatggcaccttggcatgctgaatactttgaactgaaggacatcagaaggctttggaatcaatgtctttctgactttctcccgtcttcctgtctctcatccctctttctcccctgaagcaagtgacaaaaacctgaattcctccttctcactatgggtcatagaaagtacagtccctctccctcaaaggaagacataaaacctagaaaggtcactctcttccttctcccttcttccttgaagacctttattccagaggagtccagccctatacctaggagagaggaatcctacacagagaggccaagaagaattggaacagacagtccttgctaggttttcccctcagtctattaccaagagatcaaactattttgtccaatcacatttttacacaactgtccattcttcatcaacctaagcttaaagatagacagttttctttgggcctttggatcttcatttctgaaggccctcacgtatgtaaatcttcgattaaataaatttgccatgcttttctcttggtcacctgacttttaagagagtcagcatgaccaagtgataggcgaggaaaggtatcaaaccattccacctctacactatctctacactatctacaatgcaaattttaattctgctatgaaatttgtatatatgtttcatataatactttttgattcaaatttcctttgaatttcagtcttcaattactgtgctgccttctctttttcatatcgctgtgttcttccttcattttaattattctttctggaaaccacacttttaatatatttttgtatcctaagcattattctaatttctataatatattctcctggctctgtcctccagatattatccttcctcgcttcaaatactgttttctttgtcttgtagactgtaaatgctattgttgcagcaggtgttttctctctgctcattttcaaatgagtagagatccaccagactgtttcctaacatatatagtgtatgaattgtattaaccctggtataaccatattttatacctacaagtggagagcagaggcatgaggcatgtgtgtgaatgtgtgtgtatgtatgtatgtatctatgtatgtgtgtgtgtatatatatatattatatatatattatatataataatatatatattatatataatatatatattatatataatatatataatatatatattatatataatatatataatatatataatatatataatatatatataatatatatattatatatatataaaatctccttgacctaacttgttcagatgtcattttatgtgctcctgttgcactgagataggatcttctacccacgtggctatttctcagaaatgtaaactgatagaccacgtaaaacaaactattttcttttttttccaacttaaatgctcttacttctatatacatctcccatgataaatgtatcacagccatttcctctgtctcttcatagtaattcagacccattagttatatggggaagaaaaggcaataccttttcctctcccatcacagggtcatggcagacactcataacaaaagacagatgatatggtttggctgtgtctgcacccaaatctcaacttgaattttatctcccagaattcccacgtgttgtggaaggggcccagggagaggaaatcgaatcgtgggggctggtccttcctgtgctattcttgtggtagtgaataagtctcatgagctctgatgggtctatcaggggtttctgcttttgcttcttccttgttttctcttgccactgccacgtagaaagtgcctttcaccttccaccatgactctgaggcctccccagccatgtgcagctgtaagtccaattaaacctctttttcttcccattctcaggtatgtccttatcagcagaattaaaacagactaatacaacagtttagcaggagaaaagcataaaaattttatttagcaaagctctacatgacatgggagccttcagaaatgaaaatatgtagacccagggaaaatggtgtgtttttatgctaagtctgatgaaaaaagtagatagttgtgaagaagtggattaaacaaagagggtatgatctaatagtattaaactaagtggagtttagcaagctcagattcttcttatcctgtgtagcatttcttcctccctggtatgggccaagacccatctggaatgaggattgtatgactcactttcaggacagatgagtaagagagtgacctttctaggttttatggcttgctttgtgggaggggagttctagtttctatgattcccctcaggagagaggaattctggggtctatgacatatcttttgggagaaaatgaagtggaaagaggtcagagaaaccttgcttcttaggccctctcaatatcatgtaccgtactttggggtatcattttctgagtcctgacatttacagaatctgaagtaatgcagaaaaaattgttatttaaataacaaaggaatcatattctgtttgccttcagaaatagtaccctttcagaggaagaaggactgatagcttttgtcatctgtttctattcttgtggggttgggcagattaaaatatcttcccagattctttcggtcctaggttcttttattgggtaacattttaggttgcaaaatatatttgaactctatcccagtttcctgatctctggttgtaggttactgttagatttacaatagaatatttgggggagtttctttttctttactttgatagacattttagtgggaaatttaggaaacccaagtccaaagaaattttatcaacacacagacacaaagcttagagattttacataacttgctgcaagtcctaatgctgaaccaagattggaatctagaaatgtctgattctagtgccaggctgtctcctctcttgtatccatgttcgttatgccatttatagcctaaatatcattttcctttttgaaaaacagagttccatgtaagttacagagaattatctttgttttataatctaatataataaatgttaaatcacaatcccacactgcgagcttgtctcataattattctttttgagtggaatagagcttcaagaattgcacaaactactcaaccattgcttttgaatctaataacacttattgtgaactttatgccctggtcacatttctctagaatccatgctaacacattatggtctccctggttggatgtcctgtgtttaatctccctccttctaaggtttcattgtgtactataatcttttttcctatttgtcaagtgattacataatgaaaataatcccaatgggagatttatgctctaaaattttaacctccataattatataataatatgtactgatttggcatgttaatattgtacattctcactggaaaaatactctccaatttggagtttatagaataacaacccataactatgtgaatagttttccagttttcatattttccaatttgtactttattttaatatcaaaaggttatgatttcttattaaaagcagagtaagaatggaagtttgggcatgtatgtgacattttgacagattccattattctgtggtttaaataaaggaaattgaacctatacccatgtttactaaattctttgaaagtaactgtttgtatatgttgataagtggtttctttatatgagacaaattcagtggaaattgagttacccagtgataacattatctgttacctgtcactaaccgtatctagaagcttgagtggacacaatcaactggtaatactaattttatctctaataaccaattcaaactaaaaacttaaggaattttcattattcgcccccccccccatttcctatgtctgagagaataaaaacagttttgtggatatcagatgttataattacttcttataattttttttcctttagaggaatatccaggaatatgttaaactaaaaggaaaagtaaattttacaaagttttaaactaaatacatgagaaatatgctttagtggaaatttttagttctattgtctaagagaggtattgacaaattttcaattaatattttttatcaaactcaactatcaaaaacattgctgttattattttgcatttgcattggttgttatgatgctttagggttactttttattagtcttttatggtggcaaacagctatccaaatgctctttataaaatttttctttgccttttagcaaccctgatttttttaatgagacctttttccaaatcttaatacttttttattttttatttttttatttttttagatagtcttgctcttgttgcccaggctggagtgcaacgatgagatcttggctcctgcaacctctgcctcccaggttcaagcaattctcctgcctcagcacccactgagtagctaggattgcaggcatgtaccaatacacctggctaatttttgtattttcagtagagatggggttttgccatgttggccaggctggtctcaaactcctgacctcaggtgatcccccggtctcagcctcccaaagtgttgggattacaggcatgagccaccaggcccagcccaaatcttagtatctttatgcctccaacagtgccttctctctctctctctctcataaaaataaaacaaaacaaacatgcattgtttctctgggtcagcttcagggacatccctgctatctttgaatttatcagagactcctcattttaattccgcctgctcttgttgccaccatcaattcttttcttttatcatcctgaagattcctagtggcttccctcttttatgaataccatattataggaatgaaccatgaaatatatttatgtatccatataatactcctgtctttctggaggatcaccatgccagataatggttcagtgatgtgctagggcactaaataggagaaaattagaatctatttactatataggccttataccaagtataaaaggaattctttttgttatgtcccaacacatgttaaaagaaacatcatttacagcctgacaacctctatgctcttcataaatgaaaattacaaatgactcccaattatgccaaatggtccttgtgctatgcaagaatcacttttaaacatgcaaaagtcacttttaactcccagaatattttatacaattttaaaatgtattctttcttacagccccggtaaaatgttgctattttgcaactaagacatcgggctattttcatagcagtttaaattaccagcattttattttgcatttttgctgaaggtaaaaaagaatattgtattaggcagaataatgcaccccagcaaatgtccatgccccaaaacccggaatccataaatatgttaccttatatagcaaaaggcacttggtagatgcgattaagttgggaatattaagataaggaggttttcctggattatctgagtaaacccaatgtaatcacaagagtccatataagagaaagagagaggtagacgagtctaggaggtgtgatggcagaagcagggccagagccagagagaaactggaagaagatgctatgccactggctttgaagatgaaggaagggaccatgagccaagaaatgtagttcagaataattaagatgccaaagaggcatattttagggtgaaatattcctgtctccaacgtcatattttggggtggtatgtcctgagcctcatcagtgttttgctgccgttcttacggttgtaagatgtggtactgcatttctaggcatcatattcatgatcagcaaaggaaaaaaaaaagaaagagacaaatgacaaaaataaaaggccaaagagttttgtccttatctctgatttctttttttttgagacagagcctcagtctgttgcccaggctgcagtgcagtggtgtaatcttgactcaccgcaacctctgcctcctgggttcaagcgattctcctgcctcagcttcccaagtagctgggattataggcatgcgccaccactcccagctatttttttgtatttttagtagagacagggtttcaccatgttggccaggctggtcctgaactcctgacctcaggtaatccatccgcctcggccttccaaagtgctgggattacaggcgtgagccactgcgctgggccatctctgactttatatgcaggaaagaatgtacttccccaaaattgtagcctatacctcattgagcagaactctgtcacatcaagagacaaagttataacagatttaaagatcttaattagcttttatttatgattctagaattgggcaatacctttttctataaaataggatgaatgttccgatgaggtgatcagaggttttatagacagagaagactgaggaaagcagaaacagagcacaagaagctgattggctgtttcaaaattactttccttgtaaaggttaaagcaaaggaaattttcttatgccagctacaacaggctcatttgggggattggctattatctctcgctttcctgattttttgaaagatcagataacccacttagttttggcttggcaacatggaacagaagcatgaataactccattgtggtttgatcagttgcacctagtgtagaagctcagtccaaaccactgccctcttataaattttatttaacagtcacgtggttaccgttaccgtcaagacaatatagaaaggtgttttagctttccaaggtttgtcatagaaaaaaataaaggaagtgagattgtagatgattggaaaagccaatcctcagagactgtgaactacacatttaaatgcatgatttctgtaagatggatttgttaactcttttgtaaatatcaccattcttcaactgtcaatactatttaaaatattgagctgctgagtgcttctatgcagacagttatagtggaggatcaccacacttattaattattaattattagttgaatcttttgctctttgtattctttgattcaaaagaaaatacttgcattgtagaattttaatgaagttattaaaaatgtattttttcctctctacatatatgagaaaacatttttttatgattttttccatctcttccaaaaataccatgttagaatcacaaataaatcctatgaaactgtctaccatatcaatagactttccttatcacaagatcttaggagtgactgatttaaaataagtgatccttattatataggctaatcaagttgcaaactttgaaaacattttgagaagtctctcacatatattatgtagccaaaaacaacaattctaaaatgacatttttttttaaattatggaatgatagttttcttaaaagtgaacatatttcacagcctggaatgtgacattattgttgtacagcagtaaagttgacatgtacagtatgcagcatgcatactaccatgtaacccattgatgaaatttcagggtttttattatgctacagtacaatcctatagtggggaattactcacattttcatgagctaccgtttaaaataactttttgaaatgagatttatgacttcctgctaacagctgtagaaaggagatgaggagggggaaataaggggaaggctcttcctattacgaaaagaagaaacattaaaaaggtaggaaaagaacatttatattggcattctctggaaagagaaagccatgtgctcagcaagctttcagcattccagctttataattactcttgaatatcctgagggcttctaaagcaggccatttctgaaaagcagatgtatactttttgccattgtttcaagtctggataatcttttcatacttggaaattaggaatgcatgttaaaatgttgataggaaataaagagaaggaatttgtatttttaatcgttgactttaataataaccatatataggccaaatctctattaacctactgaagaaaagaactgtggcaattacattgataattgagacaaaaccatccagaagacattatactgttcagttagctggataagaggcttgaaattgatgatgctttctcagaaggcactcagccactcaaaattgaatagaaactttccccctcccacaatctcagacaaactctgacattagtttcccttgctatagaaatcatttaaaaagcaaatgagaaataaacaaaatatttgttaaactttggaaaattaccttgaattttagaaagttcgatcactgctaaatagtttgggaagaaaaaaaaatcctttcaaggtagagtaaggtaaattccataactgtctacatcaacagttcaaatctggaggttgaaatgtgggagacgaccagttagagaaaagtaggaagggcttcttggaagaggtcatctttgagacaggatttctaaatctcaaaaagggctaggattggttagtgagatgggggtggcatgggtcttctggaggaacaacctgtcactaggtagtcctagtgacaatggaagcagaacaaggaagtggaaaattatagtgtgtgttagtgtccttgtttgtgaactggggagtaatgcagtttcgtggaagaatactggaaactaagaccataagctaaaataataagcattataaatgaataaagccatgctgaggcctaagcacattgtaggtctttaactatttctccacacacagcctctgctggtgtctgaaatagacttcatggctctggagaagttcatttactgtcaactaatttatttaggcatatagcatttctattcctgcaatacacacaaaggacatttgttgttattatagtgcttttttggtttttgttttttgattggtttcccttaaaaaaatgagagggggaaagaaagagtatgttcatttgtatgtcacaacccacccctaaaaaaatagtcatgagcatgagagtagtgggttggtgcaatgaacacatagaaagacttaagttggcaagatcattttttcacttggtacaaaaccagtggggcatgacataagggtagtttgtacatggtagtgccaggaaaataagggtttcatattcatgttagacccttggtctacttaattgcttttgcattttcctaatgcatcttaatgtcacttttttttccagaaaaattctctaacttagtagaatgagtaaaagaatcactttaagggaaatagagttaaaaattgaaagtcacttaactgtaacaataatttacatagcgttagcattgttcttttcatgcttataattttgacttacttgttgatgtattttaaaggtttcattatttttctggtttaagatagatttatattgttaggttaatgtagtacaattagcacctttgataattaaggacatatttgtaagtacagggaagtctttcttgtagaccaattatagctgtgtttatagtatcaaattatacatgcattattagaccttcaaaacccataataaatactgtatatcaatgttttggggcttacacctagtggcacaaatattaatataactaaaatctaagttatatgtataagaatttttttttctgaatctctacattctttaggatctacatttcccttaattgtaagaagcagaatattttaacggcaaaaatgagataggatatatctaggggttgaaatcttcctactaaatgatttttaaatttgtaactaagcatttatgttcatttccacagtcttgtgaaacaggtgtgcatcatgtaaaccttgttagggttgacaaaataggaaagcattataacacttcatatgatcaatgaattaagaattgtgtattttgaattttttttccaaaggcaaaattttctttcctgaattcacaaagcttttacaatctagatctttcacatagagaagcatctactggattagtaatacaggcaaggaactaaaaacttaagtctaataacatatcgtagcagatatattgtgcacttttatttgtatattttgaacataggttattttcttggcagtttcctcagaaaaatttggtgtttatcttctgttttattttcacggttttaacagtaagaaccaggagtagtaagaaatagaatgtgtatatgttttataaaaatttatatacatatatacaattcatatataagtagttgattctattggatataccttggcacttatataagtttactaagaagtgaatttttttaaaaaaataggaaatgattatattagatttaatttattttttgccaaactaacattttgtttgttttgttcatatcatcttaaactagttattgtggctatcagtgcattgaaaaatgaattactagtgtaatatgttcatctccttctgcatatgaattgtccttggatgtaagttttctgtatttccagagtcagctaaaagttaaaactaatttacctggaaaaactatgttttaggtgctattattatttttatcatttagagacaggatcctgctctgtcacccaggatggagtgtagtggcagcatcatagctcaatgtaacttccagctcctagactcaaacttcctcctgcctcagtctcctgagtggctaggctacaggcatatgccaccacactcagctaatattttcactttttgttttgtagaagcaaggtctcagtatgttgcccaggctggttttgaacacctatactcaaatgatcctcccactttggcttcccaaaatgctgattacactacttcccaaaaggattgcagaggtgagccaccgtgcctggcctttaggtgccattattgtagacatcttttttttttttaattatactttaagttttagggtacatgtgcacaatgtgcaggttagttacatatgtgccatgtgtaaaaagtaaaatcttaacttcttatatattttaagcaagtttattttttaaataagcagtaccagaggaatgctgatttttgtaatttaatgtttcatatagtttgagaaatggtctcatgaagccagtcatacagaaccgtacaatccacagtgactaatctatgcacttggttcatgttattcacaactttctacaatcctataaaagaagcagctaacccaaaagtacaagacacatcaggagctaccaaaaaataccaagatcaaatccagccccaagattatgaaagccatattattttagtctttcaaatgccagtgtttgtcttttttctcaagtttttctaatgcagagagtcaataaacacccttctaggccgggcgaggtggctcatgcctgtaatcccagcactttgggaggctgaagcgggtcgatcacctgaggccagaagtttgaaactggccttgccaacatggtgcaaacgcgtctctactaaaaatacaaaaattagctaggtgtggtggcgtgtgtctgtagttccagctacttgggaggctgaggcaggagaatctctagaacccaggaggcggaggttgcagtaagccgagatcatgccactgcactccagcctgggcgacagagtgagactccatctcaaaaaacaaacaaacaaaaagaaccccttcttttttggtcaagagctcactatgacctaagttaggattattgtcattatagtaatataatataaaacttataaaaattttaattatttaggaccatttgcaaaagctgtagattgtttatagttcagattggcaagtatgggtggcagtaatgttagaaataagaaagctaaaacctaaaggtcaaaaacctagttgccttctcattattgtcctcatgtcttcagattgtcagaggacagagggttagaaccaagaacactcagcttgcgtaaaggttttctacttcacttgacatttccagtaacttagcagcatgaccaatgaaacctgaagtaatgaatgggaaaagttagcggggaaggaatatccaacacaaaagttttatctcagcctaattaacattcagagatcagatggaaaagatggagtcaagaaggaggagaaaagttactgggaaaatatcataattggtaaaaagggactataattgatagaaaggaagaaaaacagtgatttcggttatctagcagactgaaggatgttaagcaaatgattagggaatttctaacaggtaacagatgattaggtcaataaattaattcatgtgtaatttgaaaaatataacatttcacataatattcataatattcaccatttttcagaaggcaaaattaaatacttcagattataaatctaacgacacagaaaagacattttatgttcttgttttttgatttacgaggacttggacttataatagtcaataaatgctaactgattattaataaggtgtagggtctaaggagcataaatttttttaaattagttttaaatattcatagttatagccagttttttactgtctttaccaatgaaaggaaacaatgtcataaagtaactatttttaatgtttttagtcattcgtctttatgtaacattactttttgaaattgatttgctttccaaattaaaggttgtcgtaggataatggtaaaattattttgcatacatagcaatacaaataaattggaaactgaggatatgatctaaaaatacactaagtggcagtgaagagtgaatctggaattcaacatttttcacaatgcatatgtaacatggtatatttggatgaaacattattcaaatgggcaatctcttctggctccattgtcttgtgactgtgattctaaatgctgtcatttctaaagtaacttaaatactttctcctgagaaaattgtcattaaaaacaagtgcatataatatctaataaaaagtttttatattattactattttgttttatatatctagtgttcttttttttttttttttgagacagagtctcgctctgttgcccaggctggagtgcagtggcacagtctcggctcactgcaacctccatctcctgggttcaaatgattctcctgcctcagcctcccgagtagctgggactgcaggcatccgctaccacgcccagctaatttttgtatttttagaggagacgaggtttcaccatgttggccaggatcgtctcggtatcttgacctcgtgatccaccctcttcggcctcccaaagtgctgggattacaggtgtgagccactgcaagcggcccttgttcttaatcgtaatgaacatgaacagtattaataagttcaaagcaatatgtacacgaagaatttcttctttcaacagcaataaatgggtaaaataagtacagaacaacttttatgatacagtgttataaaatgcatgtgtatcagttacctttcatcaccttaattctttgttaaaaacaaaaacaaaatgccataaaacctcagtggcacacaatagtaaggatttgaatgaagctcaggcatctgatacaatcagctgggccattctgctgtttgtagctgggctcaactggttggttattctcttcttaactgaactcactcagatgtgtggatcagctggtttggtttgaggtgaaaatcaggacatttttactctgctccatgtctctcaacctccatcagactgggacaggtagatatcttctcatgatgaaagtggggttggggtagcagtgggaaagggcaagcctaattatacaaatacttttcaagtctcttgagtgtgatacatttactagcatctcattggctagtgcaagtcacttatcagtcagataatttgagataaattcatgtgccttaattatttttataacttaaaacataccaacaatgatccaaaatattttttaaactactgtgatttttaagattgttgaaaattgttttgaaaattagtttcacatttatcttttagggaaaaagagtttaccattgataatccaaaaatctgataaaatcagttgaagcctgtttagaaagattgagaacttataagtacatacataagtataaattatatataatgtagtatattatatacatgtgtatgtatatatccctgctgaaattacctgccagtagtacctgaagaaactcctcttagaataagatgtattttaacatttcattgtaatggaagtagcttattttactcaccttttttgactacagtttttccgactcaattacagtgttcctgtgtggttcaaaaccaataaaaatgtcattagtaaaaccagtccatgtcataaaattgtattccatctagttaatttgacacaaaataatataattataaataaaataataatggagttatttttataggcaacattctaatacagtgagacccctttatcttatatttaaaatattagaagctataatttcatattccatgtaatatatgtcttttaatttaaatttaatttcctttgttactcactgctagactgtatctgttttctattgctgctataagaaatttgcaccaatttagtgacttaaacactaatttatcgcttcacagttatgtaggtcagaaatctgtgcaggctcaatggcttctgctgcttagaatctcagcaaaatcaaagggtcagcaggtctagtctcttatctggaggctatgaggtagagtgtgcttcccatctcgtccaggctgtgggcagacttcaggtttagtggttgtagaactgagcttcctgcttccttgctggctgtcaggtggagtacttgtcaatttccagaggacatcctgtttcatgactcttgccaacattccttcatcttcaaaataggctaggcagattaagtttcctcatgctttgagtctctctgacctaccctctgtctcatttaatttcccttgctcatagggactgctgtaattagactagacccacccctcaggataattttcctattttaagcatattcacaggttccagaggttttggcatggacattgtgttatgccattattgcactgctatgaagaaatacctgggtattttataaagaaaagaggtttaattggttcattcttctgcaggttttatgggaagcatcgtgctggcatctgttcagcttctgctgaaacctcagggagcttttaatcagggtggaaggcaaagaggggctggcatatcatatggcaaaagcaagagcaagagagaaagactgaaggagggaggtgtcacacactttgaaacaaccagatctcatgtgaactaagagggagagctcacttagcaccaaagggacggtccaagccattcctgatggacctagctccgtgatccaaacaccctacaccaggccccaccttcagtattgggattacatttcaacatgagatttgggtggggacaaatatccaaaccatttgattcttgtgcattcttatgcctacataagttaggtagtgagaggacaacaggatccaggcagagtttaaacaagcagattaaggagagagaaacactacagcaaacacggacctctccttgttactcttgcagtgagattctctctccttgataaggataacaaaatgttgtaatataaacaaatgacacacacacacacacacacacagacatataatacaaaaagtaactggaggcagtgccgtatgttatagaggaagctttgggtaattttgagaggggtatgtgctgcagacattcagcactgaaataaggcaagtaatttgagttatttattaaaggacaggtgattaagctgtgtgattgagagacttgggaatggtgcataccttttatttatttccctgaatttggtaaaactcagtgtagataataaattatgcaactgaatacctgtggagtcactcctgtttggcttgtaaaaatggaagctctacgtcttgtctggattgtagcaagttgctgtttagatgctccctctgtgctcttttcctacccacagtgagtagatgggagtcaatagattatctctttatttttgcttggtttcacgtgaattagaagaaaaaagatgtcagcagaatttaagatgcagagataactgcatggaagtaagagacatctgaagtggtgtcctactgcatcacagattatcaggactcatttcaggtctgttgcttggttttcttaatttgtcattgtttgaacccatttctggatactaagcttccttttttggatttatgtctcacagccttatatgttcattaattttcaccttggctgaattggccgcccaatccttccccttaaacatgtacttttcattccatttatccattgtagttatatctatctggttgccacccctgaattcaagttatttgtgttcatggagtaatttttaacaactttatcaaagcgtttttataatgccagtttatacccctgttcccttcgtcccatccctatatcctttctcccatctaatggaaactgatgcaagttatcgccccttgcagctcttcagcttccccttgccagcatctcaaattacatatagtgagtgccaaacccagacatttgatctattcctcttgttcacaacagtttctgcttgtggcctatgacgcaactgaaatatgataatagaaacttattcagtcttaggaatttttttagtgtagaaattgagactcagattgacatatatatataacttttgttaatttcaatatgtgcctcaaattccaaaccttatgggtttgtgttgctataaagcaatacctgagggtgggtaatttatgaagaaaaaaagatgtatttttctcacaattctggatggttggaaagttcaagattgtacatctgcatctggcgaggacctcaggctgctgtcactcttggcatagggtgacagagagccagcttatgcacagatcacacggcaggagatgaaacgagaaagagtggggaggtaccaggctctttttaagaactagcccatgcaggaactaatagagttagaactaacacatcaccgtgagaatggcaccacgacatccatgaaggatccacccccatggcccaaacacctcctacttaggccccacctcccgacaccaccaaactggggataaaatttcaacatgagatttgttggaaacaaaacatgtccaaaccatagcagtttattttgtgaaagtgctgaagtttgatgagtatacttcaatgataaaaaaattaatattggctttctaatttatttataaaatagatacaaaaaagtcattatttatatgtcattacaataatcacattggcttggtggtatctaataaattggagccacattgaagtgaattctatactatacctcagcatgtaaatttacctgaattttatgtcttcagttgtaattcttccagttatttctagactatatgtagtttatatttctagatattctcctagaaaagagatttttcatgttaaagtccttaccataaggaagtttgactgtcattccaaagaatctactctctgtcattaatataataaggagatatgaaatggaacattttacattcataacaacacaaaattcttataaattgctgaaacatgaaataaccaaataaactttattattgaaatgggtttctttagaacataaatgtgtaatgtatcttctcaaacttgttaaatcataaagaagtgcggtgatttagtaacatgaagcacagtatatataaaactatgtagcataaaatgttcagctgctaaggtagcaggaaggttccaggagatattttcataaatctggaagtagttcacctgtttcattgattgtcctcatttcatttacctaaatagtgggtcgtgattctcctgtctttggagtttacaaatttcctttagttgaatctgtgtgttttgaaatggtatttctttcacgtattagaaagttgaataactttgaagaaaatggaaatgacattgtgtggattgtcggaaaactagaaagatgtgatacctttctttataagggtcaggaccagcactactataacaaaggcatgttaataagagaaaagcaaaacaaatttgtttaatccaagttttacatgacacagaaaacttcaaaaatgaaaagctaaaatccagggaaaactgtctatgtttagatttgatgaagaatggacagtcgagtagaaatgtgattggacaaaaggctgtgctgtagtggtaataaactggaaggggaaacacagagaggcctgatggttcagattcttctggcctgcctgtatggcatttcttctttcgagtacagggcaggacctctctggaatgaaggtctttaaggaaaagaagagaaggttttatggcttgctttgtagcagatgggttctagtttctaagactcaccttcgagaagagaaattctgtttttttttttatgattttcttctgggtagaaaatgcgatgggagacaggagggcaagagaatgtgtgtcgatgaggtttggtcagtggtgacttaggaaacattattaggctgcttatttgcttatatgttgactttccataaatgatttttgagttgaatgttataaaatgtaaatctttatatttttattttcactttggattttttttctcataacataccagtctactaattttcaaggaacattcttattagtatatttaaaaggccaaaatagtattactcttatttaataattaatttaatcacagttagctaaaatttgactttatccaacctgaagacttttcctagagaagtgcttatattcataattaaactaaaattttagttcagaagtataaaatgttgctgtctaatttaagaataaaatacaagtttttagaaagttgtgtggaaagttttacattggacgagaaagaccaaagaattgatacgatgtttaaaaagatttgggttgaatctataaactaataatatgggccagcgtggtggctcacacctgtaatcccagcactttggcaggccgaggcagattatttgaggtcaggagttcgagaccagcctgaccaacatgatgaaaccccatctctactaaaatacaaaaatgaggcgtggtggcggtgggtgcctgtaatctcagctacttgagagtccgaggcaggagaatcactttaacccagtaggcggaggttgcagtgagccaagattgcgccactgcactccagcctgggtgacagagcgagactccctcttaaaataaaagtaaactgataatttggatgaatgttacaatgttctataacatgggtgaattttaatcgcagtaccattgagtatctattaggtctaagtcactacataaggcctttccctgcatttgagccagagtagatattccagtctcggctgcctcttaccttgccaatgattgggattagcactaccagccaggtggcaaggcatatacaatatgtataaggttggaagaacattgaacaagaaaagaaaactgaagctttagcttttatgactaccctctagggcattattaataagtccacaaactgtgaaaaaactgtaagaatgctccactctagtaaaaaatgaaaggacagtgctactttccagatcctaatgatgtaagtcctgctctgctttgaagaaaacctataatttcacaatatttaaaacttaaagtgctagggaagtattaagatttcatctttttcacatttacttagctgtcttctgaaaatgaataagatccactatcttattttgacagattttaaattattgtgttttgtatacacatttgttttgtgacttttattgcatttgcatttcaccttggcactttttaagtacacttaataaatatgttttaatgatgaggacaactgtgagttgacctttcctgaaggtagtggtgaaaataccaatatacaaaagcggcatctgccatgatgatgaggagccgtagtttaaatagatctgggttgctactgtactctccaagttagtgtcctagtttcttctcttgtttcttactttccattttccacagagcagctacagatatctttttaaaatatattaatcatatataattctcctacttaaaaccgtgaaatgatcttaggagaaatttagtcgtctttcttcagtctaaaagccctatatgactttggtactcgccttcctctcgctccctatccatcctcaacacagtcctccttgcttgttctcttcagtcacctcggctttccttctgtcccttgagtgcaccacctccttgcagccttagcacttttgcacttgcagtcacctgtgactgaaaccatctgcccttagaccatcctaaaggtacttcttgcttgtcattctggtctcagctaggaggtcatgttttcaatgtgggctcccctgaccacctcatcaaaaataacattctcccccaaattattatatcactttactacattttctttatagctgacttattttcttcagttattttgtgatctgttctcccctacacataagtaagtttcctgagggtgatgcctctgtattgcatgctacatcataggctataaacacatatttgctggaataataaaaaaattccatgtgaaagtactttatataaatgctaatgcacatcacgatataagatgcagttactagctaagcaacagtcagacaactcctttttatgtatttgttctggcaacctgaataaaagcatatgtaatctgtgagtgtgtattgtctttaaggacaggtaggtaagtggtcatctaatgttcacggggcacacattttgatacggatttattttccacccactgtgcatcttctgctgtggcaataattagagcctgtgaactgaagtgaaggaaacatttacaatgttgaataacctaaagggaagacaagggtatctaattagtctttcttgtgacaatctttttttggattaatattcttttcttttgaaaagtctaacagtggattcttatgtcactgactctactgataattaatagtgttcaccatacacctacacacactccctccaaaatatcctctcgtaatgccactactggaaagaacaatttcaattagaaaggagagcttttgaagtatatatcatgtggtctattataagaaatgtgtcctattataaacgaaaaaaatctctgccagaacataatattttatgtaacatgcctggtatattgtttaacaaaacattttatggatacttcattagggcatgacttgattaagaagcaggactagcattcacccacattgtcttttcttgaatctgtaagatgtgttcctgtacgattttcaccctacttataagcttattaacttaggaatgttgtgacagagcctttatttttgaatcttgtaattataattaatagtaagttaaagggaagtagaaagcttatattcaaagtttgaagtaaaatgactttgtggcacttagggcaggtgccaggaagaaattaagcaaaagcttattattcttatttattagaactttgggatgacatctttgaggatgatagtcattttatggttacaagagggagacctatttgtggacaaagcttgaggaggggtatcctgctatcttcagctccgcatgcccagggtctaaaatgagcttttcccccaagattagcaactactttgtgctagttgcatatgtgcaagtaaggataggagtgaatgtgtacatactctccactacttccctcagtgtgttcctgaaatccctatcatgaaagaaacaaccacaaaatttccttatattaacttgtgaaagtgttatttatgatggctacatttttgccagagagtgacttaacatcatataaaacacagtaatgtacgatgtttatcaaaactaagagaaaacatcgtttaattgtaaatatctacagttttaagtagggaatgtcctacccatggtctttaaaagaaaaaagtatgaatgatagatgttaactatatgaagggccaaattacaaggaagttcaataatgttgaataatagtaataatagttgacatttgtggaaagctgacaaatgttcagataattgttctaagtactttacatatatcaacttattttatactcaaatgccctgatggatcagtatttttaccctgttttcacaaataaaaaagctgggctgtacaacataatcagctagtaattaagttgtgggccattcttcaaatctaggcaggcaggccccagataccctgtctctctgtgctgtgacaatgttcactaaattttcactatgtgtctagcaccattctaagtcctgtacaagtattaactttaaaaattcccataataagcttatgtgatcaatcctacagtagtcccatttcttcaggtgaggtacctgacaaaattcttgataaggaatttatccaagaatgtctagctagctaacactggaacaagaattcaaactcacatcttacttcagagccaacacttttaaacattagtctaccccatgtcatgcaaatgtttagggatcagcaaactatggcccacaggccaaacctagcccacaaactggttttgtaactaaagttttgttggaacacatccttaatcattcgtttatgttttgtctatgtctgctttcatgctacaagagcagagctgaaaagttacaacagataacatatggcccatagcctaaattatttactctctggtccttttcagaaaacgtttgccaacctctgctttagaccatgagtgtttctttagcaattatctttgcttgatccatcccaccaccaccctgaatctagacaattttcagaaaatagcaagtgacaatagttttaactttttacacatggttagaaaatgacaaaaaagaccagttctttagaaacttcaaaatgcatctgaataagtaccctagacacacataaaacaacattctctgctcttgctttcatctaaaaaaggaaaagtcaacagaggtgttgagctaactctacttaaagatatggacttgagacagttcactcaagttcatgtattctggctttaccacttcctagctttgtgacctcgggtggatcacttaacctctatgtatcccagttcctccacctggaaaaatggggatagtggtaaacgtaactcataggagaacaggaatatctcattttatcgcatttcactttgttgcatttcatagttactactttttttttctaactgaagtgtattggttaatatgctgttataaagacatacctgagactgggaaatttatgaagaaaagagatttaattgtctcacagttctgcatggctggggagaccgcaggaaattcacaatcatggcagaaggcaccccttcacagggcatcaggagagggaatgagagcagagtggagggggaagccccatatgaaaccatcagatctcataagaactcacttactgtcatcagaacaacatgggggaaaccacccccaggattcaattttctccacctggtcctgcccttgacatgtggggattattataattcaaggtgagatttgggtgggtacacagagccaaaccatatcattttactcctggtccctcccaaatctcataacctcaaatttcaaaacacaatcatgtccttcccagtcccccaaagtctcaactcatttcatcattaactcaaaagtccaagtccaaattctcgtctgagacaagttccttctgcctatgagcctgtaaaatcaaaagcaagttagttacttcctagacacactggggatacaggcagttggtaaatatacccattccaaatgggagaaattggccaaaacaaaggggctacaggtgccagacaagtccaaaatccagtagggcagtcattaaacgttaaaattccaaaatgttctctttgactccatgtctcacatccaggtcacattgatgcaagaggtggactcccatagccttgggcagctccacccctgtggctttgcaggatacagccccctcccagctgctttcatgggtattgagtgtctgtagcttttccaggtgcacagtgcaagctgtcagtaaacctaccattctggggtctgaaggacagtggccctcttcttacagctccgttaggcaatgccccagttgggactgtttgtgggggctccaaacccacatttcccttccacactgctctagcagaggttctccatgaggaagccaccctacagcagacttctgcctggacatccaggcatgtctatacatcttcggaaaccttggcagaggttcccaaacctcaattcttgacttctgatcccccacaggcccaacacatgtaagctgccaatgtttgggccttgcaccctctgaagcaaaggcctgagctgtatgtttgcccctgttagtcattgctgggatgcagggcaccgagtcccaagactgcacaaagcagcaagtacctgggcctggctcatgaaaccattttttcattttaagttttgaggaaagaagctatctccataacataaaagtatggtgaagcaacaagtgctgaagtagaagctataacgagttatccagaagacatagctaagataatgaatgaaggtggctaaactaaaaaatcatcagcataggatgggtggctcacacctgtaatcccagcactttgggaggccaaggaggatgggtcacctaaagtcaggaattagagaccagcctggccaacatggcgaaaccctatctctatcaaaaatacaaaaactagccaggcatggtggcgggcgcctgaaatcccagctactcaggaggctgaagctggaaaattgcttgaacccgggaggcggaggttgcagtgagccgagatcactccactgaactccagcctgggtgacagagagagactgcatctcaaaaaaaattattcagcataaacagccctttattggaagaacatattatttaaaactcttaaatctagagaggtaaagtcaatgcttggcttcaacaactccacctgacaggctgactttcttgttaggggctaatgcagctggtaactttaagttgaagccaatgctcattgaccatgttgaaaatcctaggatctttaagattatgctaaatctattttgcctatgatttataaatgtaacaacaaagcctagatgacagcccatctgtttacaacatggtttaatgaatattctaagcccacctttgagacctactgttcagaaaaaaaaatgattctttacaaaatattacttcccatttaaaattcacctggtcactcaagaactgtgatgaagatgtacaaggagacaaatgttattttcatgcctgctgacagaacatcaattctgcttcccgtgggtcaatgagtaatttcaactttcaattcttattttttaaaaactatattttgtaaggctatagctgccatagacagtgattcctctgatggatctgggcaaagtaaactgaaaaccttctggaaagagactttcatgatttataggaagagatcaaaatataaacattaacagaagtttgaaagaagttgatgcaaactctcatggatgactttgagaggttcaagacttccctggaggaagtcacatcagatgtgatagaaatagcaaaagaaccataattagaagtgcatcctgaaaatgcgattcaattgctacaattttatgataaaacttgaatggataaagagttgcttcttattgatgagcaaagaaagtagtttcttgggatggaatctactcctgggtgaagatgctgtgaacattgttgaaataacaatgaaggatttaaaatatttcataaacatatttgataaagatgtttgagagggttgactccaattttgaaagaagttccactgtgggtaaaatgctatcaaacaatatcacatgccacagagaaatctttttgaaatgaaaagtacatcaatgtggcaaacttcattgttgtcttattttcagaatttgctacaaccatctagccttcaggaaccacaactctgattggtcagcagccatcaacatcaaggcaagaccctccaccagcagaaagattatgactggatgaatgttaagatcagccccattttttagcaataaagtattttttcattgtcagtttagacataatactattatatacttaatatactatagtatagggtaaacataacttttatatgtactgggaaaccaaaaagtttatatgatttgctttattgtgatattcactttgttgagattgtctgaaaccaagattgcctgatacctggagtatctccaaggtatgcctgtattatagccattgaatgaatttatgtatgcaatgttgggaagaggaactgaatcctataaagtattagttattactcctattcttcagcttcttcaaaagactgattcagaggtaaacagaatggtcgaaggtgagccctaagtataactgggtaaatttttaatgaatgaaaagcctgtggaatcaatgattattaagtattgttctacatttatttttagagacctctatgaaaataaaaaataaaaagtccgccaggtgcagtggctcacgcctgtaatcccagcactttgggaggccgaggtgggcggatcatgaggtcaaaagtttgagaccagcctgataaacatggtgaaattccatctgtactaaaaatacaaacattagccagacatggtggcacgcacctgtaatcccagctactcaagaggctaaggcaggataattgcttgaacttgggagggggaggttgtagtgagccgagatcacaccactgctctccagtctgggcaacagagcgacactccgtctcaaaaaaaaaaaaaaaaaaaaaaaaaaaaaaaaaaaaaactcaatgtcctctgacaacttgatgtataataccggacttctactattagcacaagaaaatgaattaaagatcttaaagatcttggtaagtgcagcatgtacatctgcacaaaaacttatgtagacagattgtgggagaggctctcctcccttggtttctctggcagtaccagagcatattaactgtaaagaacaggttcttctaacccctctaacactattgtgtctggtggtacccagctctgatacaatacactggcaatttctaaattggttctttacctcagggcttaataatgactaaatgacttaagcatttactgggaatgataatagttacatccaagctctgtaacaggaattattgatatttatagtacacatagaaataataaatgattgaagattcatactaagctggagtagctaaaattatgagtcttaaagccaagccatcctgggttcaaagttggcttccgttcactaccaaatgtaagcttgggcaatttatgtggtatctctactaactctgtttacaatggcataaaataataatactgatagtaccaacatcagtcactaagtcatgtatttgatgaatgtttattgaatagctactatgtgccagctactattggggttgagcatacagcaaataatacagatatgaaccccagctcttttgagctttcatttcacttgtgagaactaagcatttagtaccaggtatggggcacattaaattttcaaacaatgttaaatatcattaccattagttgatgatgatgatgatgatgatgatgacagttatgtctcattatggagttgagaataacacaatttctgtacgtgggaaatatttctggtccatagcccttaaactgcttccctcccacaggagtgatttgaactgagatttggaactcctccctgggggtctttatcgctatgtcccagtatttgctgatgcacttattccataataattcaaaaccaggtatttattaatatattatcaaagcattaaattcctttctatatatgctgaaaatatttctattcagctaaagaacattgtatgccttgctgaaatgtgtgtagaattacccacaaaagtcatttacagatatatatatatatatatatatgtgtgtgtgtgtatatctataaatagacagatatttatacatatataaatatatgtgtgtatatctatatatttatagatatatgtatatatatacagatatatctatctatatatatatatacacacatatgtgtgtgtacatgtatgtatctatgccagtgttagaaaaggaatatatggacaaatcagagtgtgattaggaggatcagttcatgtggaataggagtccaagttgtttaaggtgtcacagaggaggccacatagtggaggggatgagaagagtcagaaaaaagtacttccaaatctgattagctatcagtgggtttgtatttatatttttgccttaacttctacaaataattcctctcacaaaagtcattttggaaacttatctttcaaagttcgtaaaaacatcaatgattttagttatcttcacttaaagagggtaatttatcatctggtcaagggtgcatgtgtctgccaggaaagctgtgagccaacatacatcatactcagtagcttcaaggattcagtttgccttcttgtgtgtatttgaatacagaattcattttaatctgacattttttacctctcatcatatttttcttctaattaagttctataaatgtatcttctatccggtttgagctgtaataaattctttacttgaattggccttctgaaagtcacaaaccaacattatgatgaattgcaaaatgaataatttcccttccactgtgtttattttgagcagcaaaatgctggagaaaaatgaaacaatgtttcactagaaagaaggccatgcccatagtggttacatggctttgacctgaatgctgctaatgctgaagccagtagattcccaaaactgtgtaggtctaatttaaaaataatttttcagttgataattttagagtttaatgatattaatgtaagatataaataatgagaaatgttttgctctcatataagcctggagttagctagccatgttggtgtggactagagccatggtttctttgggaaatgtgtttcttaaaatccatattgcagaagaaaagaacaaggccatttatagaatagactaagggaaaaatgaacatgtgatcgctgttttttaaatcatcatatgtcttaccgcaccacattggcaagtaaatgtattattgtctttgaatttagatggccaaattgaaattgaacaatttgttactaatatttaggttggaattttaataggtgcttaacattggacacatctgttcccattacattgtaaggcatagatgaaactttatacaaataagattaaagcattgccatagctaaaatatcaggcattaaccttgtagacttttgattttaaaatagttgagctccagtattaaaatagccacagtgatcagagtccagttcaaataatagtgcttaatgtgttaatcattaatcttacatacttctttctcatttccctctatgcctttatagagtgggaattgccttatatcttgaattcattactgtaatttgtgtactgtgcattgactgaagccaatttaagtggtaatgtaggatagaattttagttccttcactttgtgtagatagtgggccatggagttaatgtttcatttatagtatttattacagaactatgataatgtggttatgattcatgatcttttcctggataatggctgatttaagacatattatagtttgaaaacaatgttgatgttctatagtaaccatgaccactggtccaaatatcccaacataaaaataccattggcataatttttcttcccttaaagaaaaaccataattactcttttcaaaccagaattagatatgcacaatcacctaaaccaactactttgtcttgcaaatgaggaatccgagatccagtgaagctgactagattgatggagatcagaaagctactagtgttagagctatagcagggatgcagaacctgcttcctcttattttggggccagtactctcaaaactatcctgccttgctaaaatcggataatcactgccatttcatttattcatattctgaaaacatttgctattatctccccataactcttttttctttctcctcgcgcagtgtctccatgcaaccccacaaagacatcctagtctcctgtggcgaggaccgactctggaaggtgttgggccttccaaaatgcaatgtgcttctcacgggatttggccacactgactggctttcagactgctgcttccatcccaggtcagtgcacaggacccctagaaatagcctaatctctctaggaatgtgctcctttactctgtctgctcactctgctgtctttgatgatgtttttctttctgcaacaacacaccctgcactgaatttcaaagtgtatagacaaattcccctttggttttcagtatattgacttctgattgtttttgatatttggtacatgtaaaacttagtccacatgcttatgcatttaaccaaagtaataagcttctcaggacaagcattattaaaattccttgtgctcacgagccctgacaaggcacagagatttctagtcaataatgcatgccagaatttacctttgttaatctttggagttttccttttagaattaatttatgtaccaaaaaggatcagatagctgcgatcaatttctctaaaaattcagtgacacacaagatattaaaaagaacaaagcaatactgagaacactgggccctgtaatttctgaaattcactgaacctaaattcatttgtacctaaaagaccaagggcacagaagggagatcattcttaaagacacagatggaaaactgcccatagttccttgtggcccattgctactgccaatcctgttttctgctcatcatacttcttggatctgcttcgttctaaaactctctggcctgattacttttttaacccatagttcttggtgcttttctaaaccattcttttggaaattttgttcttgggaagatttcttatgatttattttcatgttttcactaaactccttttttaaatcagtttttattttatctttgctatgaatgtctatgaaattagataaaaaaattttatttaaatttagaaatttgtaagttaatgacaagggtaaactaagtttgtttttaacttttgaaaatctttccaaaatataatttatctttagtactagatgtttgaccctactttatgaacatgcagtgtattccgtatccagtatataaattaaacagagccttgccaccctctcacctcttaggaacataaaacccatgttgcaagcagagacaatacaattagaagaatagccaatcgcttatgtagctactgggcatactaatcagattttgataatgccctgttaccatgacagccagtgactcagagattttctcattagtgtttgaccagcaatggtccttttaatagatcttcctgttttcccattcaattactgaaattaatatgaggtgagatacatcattattcactcataatatgaatttacatttagcactttcttacggcagaattgtagtaaaatactgctatactgtttgctttttttcagtgcatgagacaaatataaggggagaaaataaatataaccataagtgtttttaaatgagagatattgaatagcaaatgttctttttgtagaattaataaaaaagaaaaaatgatcattagaaacaacaacaaaaaaagctctattttggtttatttgtggtgaaacacattctgaaagagtttatatctcagaccacaaacattttataatccttgtatgcaaaccaacactaaatagcaaatgaatatgaaaaaatatatatgtacctacagatagtgttgatagattaaaagttgttggaatttatgtttcctggaatttaaatttgtaatatttgacttttgctttggcttatgtgatttggtaagaaaagatagttaattaatgaagataatatatttcctatctcatggtatacttcatctataatttaaaatcaaacctaaaataagtttgatttaaatatgatactctaatctgtagttgattttttaatgaatacagttatagtcttcagagtccagctctgggctctggttgattctgctttcttgggagaggcctagggtggacacagtatatactaacatttactgtcctcctatgctcttcacacaagacacatatactttttcttatttttttctttcctttgcttttaacatttcctttatttttaatttcagttgcttctagttgaatattttctctaactgttagctggatgtattcctgactacaatggtagctgacactgtcaggcactctatcttctgcaatgatgacatatccaaattttgtttgggggtcaattattcttgacatgattgtggtttaccttgactgaccccaatcaatcttctttgtcctatttctcgtatcatagcagacatctcaagtgcctaaataataaatacaatagacatagtaatactcatatcagacaaaagaagattaataggtaaaaaaataaactgaggggataactaacacttgagaatccagctaatatgatgtcgaaatatataaaacaaaaaatctcgtaaaacaagatgatagtaaaaaaatgtaataatcagaatcaaagacttcaaggtatctctctcaacttttaatctgtcaagtaaacaaaatttgtagtggaattagaagaattaacatggtagtataattaacagtatatatttacctctgtacaaggagagaatataaattttttgagttcatttatggttcaattttcaaaaaggcataaattctttacccaaaatctagcataaattcctcatagtataaattatacaatccataatttatgaccaagattcaatgataaaaggaagtgatatgaaattaataaccatgaatgagattaatcacaaatttttaagacacatgtaaatgaatactgagtcaaagaggaactataaactttcattacatagttggtaaacagttaacaactacaacacttacgaagtttatgagatgtatccaaagccgtattcagagtaaaattcatagctttaaattctttatcattaaataagaaaaaaagaaaataagtggattatgaattcaaattgaaaaaacaatgaaataaaaaatgcaaaagaataaatcaatgaaaattagaaattaataatgagaatagaaaaaggatgtatatttatgtatgttatatacctatgaaaacttctgaacttatatatatataaaatatataaacatttgtatataaattttttatatatttatatacatataaataatatacatatatacatgcacatatatgtgtaaattcagaatttgtctgtcctcaaggggaaaaataatgaggaggtacaatacattagatatcctggaaaactgctgaaaatatattaataagtaagaaaacagtaatatacatagcaacttggaaggagatagtactatatacacagaaacttatattatatatatatactatatatatatgtgcttaaattttttaggaaataataaatctctgtgaaagtaaacattctcaatgctaaatcaagatggaagaaaaacctggactagattaaaaactgttgaagaaactgagttttaaagttttaccttgcatgcccatctttagcagttttatgagtgagtttttagaaacttaccaaaaagaaagaaagaaagaaaaaaaagtgttagaataaaacaggtaatttttagtttcattacctagcccaaggacagaaaaaataaaagggaaattcattactggttttaaaaataaagcataaacataattttaaacctaacggatacagtactcacatggtaacagagacccatttcactattttgaatgcaaaactttaaaaaatgatatagaaaatgaaagcagttgtatgtttaaaaagagcaatataccatgaccaagtaagaattgtactaggaaagcatgaaatatataaatgatccgactatgaggacatcatataataaattatacttatagatattggaagttactttaaaaagtggcataaatctagcaactatacctgttaacacacgtttgcatatattgttaggtcccatgtgttgaaattgattaggggaatggattttggaacagctaaaactcttaataagatctgccaggtgaatgtcaaacctggatgccatgaagcttaatgagtcaaaagcagaatggtgcttacaggaaatagttcaagaggggaacataaaaccaaccaggtaaaaatgtagacaatccccaaagtcaaaacaggagcaagggtccaagctaacatctgtctatggaagcttaattacttctccagttggtgtttactctctttaaatgttgactacatattttatttttttcccttaataataatgactactttttgttgaacactaacaccgtctaacatatttataactcaaaaaatgaatgtggaaatcctttaagttttatacaaatataatgcagactatacaaacagaaggcatttaaaaattgcaagtcttcaaaatactgcattgcctcaaaataataactatacacataactgattatttctatctattgtttacagtggaattggttctgtttttatctaagtttttaatttcctcagtaggacttgtctgtccagatcttttttaaggacatggataactttcgtcacagtgtaactcatcattattacatatttaccactagattaaggtcatatattggtaagataaagcactctttgcatttacttggtagactgatggaaatgttggtagctgttgaaagtgattcatcaatcattgaaaatggtaaatgaatggatcaatgcagggaatgtgcattagcactatctttgtactactgaaagaagaaaatgtacattgccaaaaagtgggagcataaacatacccttgtgcaaggtagaggtcatacgagtggctcgttttagaatgctagcctcaccattgccagtcttttcaggtttctcttctgcaaaatagaaagaataatgatgcctactttatagtttgattgtgaagactagtgttataatatctgaaaaacacaaatacggttgctaggcacacatatgttcaataaatgttagctatcatcatatttttcattgatagaaattttgagaacttaaaaagatagctcggccgtgttcagtggctcacgcctgtaatcccagcactttgggaggccgaggcgggcggatcatgaggtcaggagatcaagaccatcctggctaacacggtgaatccccgtctccactaaaaatacaaaaaaaaatagccgggcgtggtggcgggcacctgtagtcccagctactcgggaggctgaggcaggagaatggcatgaacctgggaggtggagcgtgcagtgagctgagatcgcgccactgcactccagcttgggtgacagagcaagactctgtctcaacaaaaaaaaaaaaaaaaaaaaaaaagatagctcaaacgttgttataaaactgtcagccacacagtgggctacgaagggaagaggcaattgtgttttctggattataccaaactctgttggaaaaatgatatgcaaccatcaacattagttggtaaaatcatgtctaaaattcatacccagtaaatgattaagatagttataaactgaaaaccaaattcaattgcttcaaaatgtatgttatctaactcttctcagctcataaaatgtaaatgttactttaaaattgtgccaaactcatcctatttttttttataaaaatgagaattttttttttattttagattttagattatgttttagaaagaaaacaaacttggccagaaacatcaacagaattccattttaaaatcatctttttgatttgtttttttgcacaatataaaaaatacagtggttgaacttccttatccacaggcaggttctatttttgtcccatttagaccagctttgggcaacaaaaacacagagttacataatcaatattcaggttaataatgttatatcagtaaaactcatgctacattacttaataatatattaattggtctttacctacaccagacgactgcttcataatagtaacataattttgaatgtaaatacaatgtccagttcaccagtgcttggagttgcattttcttctgtatgaccacagcttattatgtgaaacagcatgtaactcctcacatatctctataagtgaaagcagtgggattagtggtttaaacaatttcacagtgccacattttatcctgagttccctgcctgaggcagaaatagagctgacagcatcctgttaaacagaacttctacccttaggagctgattcatgaattgtgaataaatggacctctccaaaatacctcatgttctctcttcactgtacaggctacctattcacatatttatgtagtgcctaaaaccatagtatgaaaaccccttgacgagtacattatttagatttttaaaaatatatatacatgggactgggcatggtggctcacacctgtaatcccagcactttgggaggctgaggcaggcggatcacctgaggtcaggatttcgagaccagcctgaccaacatggtgaaacctcatctctactaaaaataccaaaaattagccgggtgtagtgacaggcacctgtaatcccagctactcgggaggctgagacaggagaatcacttgaacccgggaggcggaggttgcagtgagttgagatcgcgccattgaactctagcctgggcaacaagagctaaagtccatgtcaaaaaaaaaaaatatatatatatatatgtatatatatatgtatatatatatataatatgtatacacacacacatgcaaaactttttatttggtgtaagctggaagttaagagtacaaatttcaaattatttttaataatacagatattgatatactgtctctctaaaaattatgatgtcctctttcttcctgagctgcagaagtagctgttttcataatctggaaaacatagtagacttttattaagacaattttgacatgcctctgttaagtaataatattcaactttatattctttgcagaggtgtatattatgcttctgttcttaatatagttatcacctttatgtgaaagggctaagcattaaaaataacagcatactgctttgagtagtttttttttttttttgtctaattccaaaagtaatacaggatcatcatagagaaaagtgttaaaaagaaaataaatatttctcacagtcctacaactcaatgaaaaccacattttctttgtaaaaccaaccttgcaagtattaattttagctttatacacatttacaaatgcccttataataatgtccgtacgtatagtagttacctgcttaatatttaatcaactaatgttaaggagggaaatttggaatggagaggatctttagacatatctgtattggggaaggcctggtttgaatgttgatggcagttaccttttaaacagcaactaccatatgtcaagtattgcaattgtacgtagcaattataatgctatgtatatttatgatgctgctttctcttcctcagtttatagaaatactacatcctctgtgtcgtttgtattcatagttaaattgaggccatataactgatctctggccagcgaaatgtgaatgaaagtcacattttcagctgttgcacattgaagagcaaagtttacctccttcaggctctcttcccttctcttcagaaccacatagctttatacaaagacatagctttataatggcataagactgcttgctttctgttgaaatgggattataaccaagacaaatcaagatatctttgttatattaagccttataagactggacggcttgtctattgtggcttgctagtgttaactatcctctgaatttatgtattatgtattatagataaatttatgtattatagataaataaataaatttcaaggcactgcccaagcgctttcctccacgaagtggcagaatctggttatacacaagatgcgacttttaaaatcagacttattttccagtatgggtgtggaagagtatttgctctgttattttacttaaactcccagcacctcagttgctcatttgaaaaggatggtaatatatatcaaaaggttttcatgaatgttccacgagaaaatatatataaagcattcagcacagttctgatctcagaatcagcatttggtaaaaatagcattattatggttgttgttgtttggcagaagtaggattctaacctaggtctggtttgctgtaaaactagtattgcctctaagtctattggcctgtctctctttttgtagaaagaaaataatttttaaaaaacccataggaatgctataagctctttaagggcaaggtctagatctcacccatctttgtatccctgggacacagaaggtaaactgaaacattatagagaatgagaaaatatttgttgaattagaataaacagaattgaagatgcgagaccagaaatgtagtcactttctttcatgctcccagaaggtattatgtaattttagggacatactcacaaatatacacatacacaaacacacacacataccattcattatttctgaaatcactttatcagaagaacctacaacctagtattagtcctgcattggacaaaaaatcctaaaatacaaaatcttctatgaataatattacaccaagaataaatttcagtcaaaacccaataatagaagcacttccagaatggcagaataaggacgttcaaaaatatattccttcataaaagcagagagaatatggggggagaggagggaatgttaaaatccacttttttggaacacaggaacttaaccaaaggcttacatcaactcaaggagcacttattcaagaaaaattgctgaaacttactaagaagagtgaactcttttatgttttaactttctccagtcctaaatagaaaagctggagagtgaaatgtccaaaggggatttgaagcacactgacatatttctaagactatggaaggacacatacatgcaagcggagggctgtgcacatgcataggaaagacttgagaagggtctaatctcttgcatctggttgacctcaaggacttgcacaagcaggaggtaaaggctaaggctaagttgtaaacttccagaatgttaaagatgtgtcctaacatgcacacagagacacttgccaaagattgggtgacttactggttcaaagcatttaatgaccagttgaccaatcattatttggctattaagctaatctagaagaaacttctgtgaccacaccaaacatggaatacagactttactgaattacctcaggaaattcacacacacacacacacacacacacacacacacacacacacagagagagagagagagagagcaaacagcagtaaaaacaaaccttagaaggaagcctgattttcagaaatttcaaattatttaaaatgtcaggttttaaacaatgtcaaaaaatagaaaacatgaaaaggatcaggacaaagaacaaaacttatgaatatgtcatgttatatgacaaagtgccattaaagttgcaggtgtgatggaaatctgtaatcagctgactttaagataaggagattatctttgattatctaggttgacccactgtaatcacaaagttcccttaagtgtggaagatgaaggcagaatggtcagagtaagagtgatgtgacatgaaaaagggattctcccctagagagacaagagagaaccagctcttataacaccttgacttcaatccaatgaaacttattttgtacttatggcctccagaactgtaagagagtaacttcatgttatgttatccactaagtttgtggtaatttgtcacagcacaaaaagaaaacaaatacactattcttccacaactatagttgagttttctatactaacctcctgtcaatatacaactttgatgagctcatttattaatttaaaaaattttagtatattttttagacttctctatatacaagatcatatcatctctgaagagagatcattttactttttcctttctcatctagatacctttgattgtttttttgttatcaaattgctctggctcgaacctccagtgcaatgttgaaaagaagtgacaaatgaagacatccttgtcttatttttgattttaggtaaaacgtgatcagtctttcaccgttaagtatgatgttagttgtgggatttttgtagatgcttttattaggttgaagaagtttatttctatttctagtcgaatatgttgatcatgagaggatgttggattttgttaaatgctgcttctgcatctgttgaaatgatcatttggtttttatcttttattctatcagtgtggcctattacattgatttttgtatgttgaaccaaccttgcattcctgaaataaatgctagttgcttatgatatacagtcatttatatatgttgctggatttggtgtattagtattttcttgatgacatttttatctgtattaataagagacatgggtgatgcctttttcaggttttggtattagaacaatactggcctcacagaataagttaggcagtgttccctcctgtcctattttttggaagaatttgtgaagtagtagtgttaattcttcttaaatatttgggaaaattcatcagtgaagccatctggtcttgggcttttctttgtggaaaggttttgattactgattcaagtacaagaatttgtctactctatccaggttatctaatttgctgccatttttttctcatatttgttgccatgttgttaacaatttcccttataaatcctttataattctgtaaatctggtaatgatgcctttatataattattgattttaataatttgagtcctctctatttttttgttgctcagtagagctaaagtcaattttgttgctcttttcaaaaaatcaacttttattgttgaattttctatatatttttaaattcttttatttatttacattcaatattattttcttctgcttgatttggatttatttttctcttctttttctacttgcttaagatagaaggtttggttatgatttgagatatttgttctttttaaatgtaccatttacatctgtgaattttctttcaagcaatgctagaattatcctataagttttcatatgttgtgtttttgttttcattcatatcaaaatattttcagatttcccttataatttcttttttggccgattggctattttaaagtgtgctgttccatttccatatatatgtcatgtgctgcttaatggtgaggatacatttgataaatgcatcattaggcaatttcatcactatgcaaacattggagcgtgtacttacacaaacctagatggtatagcctactgctcttccaggctatataccatagactatacagactatagcatattgccattgctattgctcctatataacaaacttatatagttactgtactgaataccatatacaattgtaatataacaatattttatatagaaacacagaaagatatagtaaaaatacagtataaaagataaaaagtggtatacttgtttagggcatttaccatgaatggagctttcaggaatggaagctgctctgggtaagtcagtgagtgagtggtgagtgaatgagaaggcctaggacattactctacactactgtagactataaacactgtacacttaggctatactgaatttgttttaaaatcatttttcttcaataataaatcaaccttagcttacgtaaccttttactttataaactatttaattttttaactttttgattattttgttaacagtttgaaacacaaactgtacagctgtacaaaaatattttgtgctttttctataaatttttctctattttttattttcaaactttttgttaaacacaaagacacacacattagcctaggcctacacagggtcaggatcattaatatcactttggcccacttccacattttgtcccactggaagttcttcaggggcataataatatgtaatatacccttaaacaactagcagtgcagtagatttgtttacaataacatcaccacaaacacatgagtaatgtgtagccatatggcattatgaaggttatcatgtcactaggccataggaatttttcagctccattataatcttatgaaaccatatcatatatgcagtccatcactgactgcaatgactttatatggcacatgactgtgccttattccattggccaaagctcagagggagggattgtggggactatgaagctacagggttaagggcttggatgcaggaagaagtggagaattaggaccatttttgaactctgtcatttatatgcatgggatgaccatacatctaggtttgcccagaaaagtcccagtttattcctgtcatccttatagaaatattattttttaagaaagagaatcttgctctgttgccctggttggagtgcagtggtgcatcatagctcactgcagcctagaactcctgggctgaagcaattttcctgccttactctccatacgacctgggactacaggcacatactaccacatcaaactaattttttttttttttgagacagggtctcactttattgcccacgctggtctcaaactcctggcctcatgggatcctcccactttgaatcacccccttgttactctaaaaagtgtcccaattttaatgataaattatatgggaactctacatttggagggttttaaatagaatggatgcactcattgaaaaaatctgtgaagtaagcagaagaattaagataagtttagagtccatcaaagaggttccaggaagcaagagatgagccaaaacagaatgggtctgaagaagcgaaaagggatacatgaaagagggctaaatgagaaggtcaacagcatcaaggcatagactatcaaatgaatgtgtctgttgtgtttgtcaactagaaagttttttactgactatgatgagaggcttcataggagtggttgcagtgaattaaagagtcaactaattcttgctctcacactgatttaaaaataaaactttaatttcactcttttgggtcttacatttaaaacaaaagggaccagactctgcggaattgagatcctctgagtgttaacattttcaggatctgaatactaaatacagatgccagactaaaaccaaatgtgtaagaaccaagacctgtagcttacatttattctctatccatcatttttgacactaaataaaaatgatctggtgtgtattcattgggaattattctgattttattttattacggctgtaaattcattttccttcacgtatttgatgtctttgattgatgcaaaactcaataagacttactgtagttacattaaatattaaccagaacattattttgaaacatttgggaagctgtgacatctcaacctgatccaaaaccttagtatatatattaaacacagcaactaaaagacttgccaagatatgtttgacaattgtcctaactttgatgaagaaaataagaaaataccagtttccccagtagagagtttactgtgaaaagcattgcagatttgacattgcgtgaaagtttccaactataagcaaatgcagacttaatggcagtaaatgacattaaattttttaaatgacaaaacctgcatttgaaatgtaggtacataacttttagttatttgaaacttcaaggatagctaattggctaatacataaggggacagaaaatctgactagtattaactttgaaccaaaaaaaaaaaaaaaagaagaagaaaagaaaagaaaaagaatctttgtgtagttgaatccttatcttggctgttacttacacattgcaaacctattttgtatgagtgcacatcaaattccctttgggattctcaatttcatttattttatcaataaaaagagcctccttgtggagaaaggaataagtcacatataaatgaagtagaagagattacaccagtacctgagcttttactttgactaatccaatagctttggccaaatatctcaatgtcaaaagcattataagtattctacgacgtaagtctggaaaagagaaattaataagaaagtattggattgattaaaatgtttacttttcccctccatccttccccttctcaagcttaatggctctttctcataccaatctgatctttgttatggttattggctggccttgtttcttgttataactccacatctagaactcatttctgcatcatatacttttctgtctctccataatttcagtattagggtcctcgctcagatgcatgtcctttgtcactgaacttgacgacaggctttaaagagattttacaagtcccatttacacaaattatttattttggtcttcaacaatgttaaaatgcatgatgtaatttttatagaagagaaaacatgcttagcaagataattctgccaaagatttctctgcttaactatatagttaagtcttttcaactattttgctcatcaaagatcttgtacatcatagaagattctagaaaagtgaccttgatatttatcttgcacctcagtgcctttaacatgtactttttctgcttagaatataccccaaactcttttcttcatcctttttaatgtgtcttcagggctgagctttcaaatccacttattaaggatatctttccccaacccttaaattattatttaagataatttcccagataagtttttctgtttatatgtctttatcagaattatgatacatgggtttttttgtttgtttttatttttgagacaaggtctcactttgctgtgtagtcaggagtgtggtggtgtgatcttggctcactacagcctcaacctcccaacatcaagtgattcttccacctcagctccccaaaaagctgggaccacagtcacacgctaccacacccaactaattaaaaaatcatattttttgttgagatgagatctcactatattgtgcaagctaatcccaaactcttgagttcaagtgatcctgctgtcttagcctcccaaaattctgggattataggcatgtgccaccactcccatccacataaggcattttttatgaatgcctgtgttctctactgggttgtgaacttagggagaggatgaggataccataatatccacttatgtatttccaacaccttatggcactgaaaaactattgtcatctgactaatggtctagttgccattttagggcctcatgatctcatttatgaatcatgacacaaactgccttattttccatgtgccaatctcaattccatattgtccaggcctgactgatttgtgatcttaaaacatggattttatcatgttacattctgcaaccacactgtcactatctgttatttatggaaagacaaaagtgatactcagtgtatcattcatgaccctccatagattgacctagatcaaatttctgaccttgtcataccctcttctctccaacacaagcactttgtctttgccatagtagctgatagaatggattcagaatacttcttcctgttcatctttattttgactttctacttgtgttcttactcattttgaattctctctaccttcttactagtttatattattgatataataatttcttttcatttgggtagatacctagtagtgagattgccggattgaatggcagttctatttttagttctctgagaaatcatcatattgttttccaaagaggttggactaatttacattcccaccaatagtgtataagcatttcttttccttcttatcattgccaatatttattttttgacttttaaataacagaccttctaactagtttaagatgctttctccttgtgtttttaacttgtatttgtcaatatgctttttggccacttgtctgtcttcttttggaaaatatctattcattttctttgcccactttttattggggctattgggaatttttgttattgcggagttttttgagttccttgtaaattctggatatcattaccctgtcagatacatagtttgcaaatattttctcccatcctgcaggttgcctgtatactctgttgattatttatgtttctgtgcagaagcttttcagtttaattaagtctatttgtctagtttggtttttgttgcttgtgcttctgaggtcttagtcataaattctttgcctaaaccaccatccagaagagttttctctgttttcatcattttaatagtttcgagtgttacatttaaattcttaatccatcttaagttgatttttgtatatggtgggagataggggtccagctttattcttctgcatatagcaatccagttttcccagcaccatttttgaaaagggtgccctttccccagtgcatgtttttgacaacaactttgtcaaagatcaggtggatgtggatgtgtgatttaatttctgggttctctattctgttctgtcaatctgttgtctattttgataccagtacaatgctgttttggttgctgtagctttgtagtataatttgaggtcaggtaatgtgatgcctccaaatttgttctttttgcttaggattgctttgtctatttgagctctttttttgattccatatgaattttaggatttttttttctaattctgtgaaaaatgacattggtattttgatagagattgcacttaaactgtagattgctttggatagtatagtcattgatattcattcttccaattcatgcgcatgagatggttttccatttgcccgtgttatctataatttctttcatcggtgttttgtagttttctttgtagagatgttttacctccttggttaaatatatccatgggggtgtgtgtgtgtatatacatatacacacacacacacatatttgtagctattgtaaatgagattgctttcttgatttaattctcagcttgatgattatcagtatatagaaatgctactgatttatttttaatttcagcttttattttatacatagggagtacatgtgcaaggttattgcatgggttcattgtaactaggttgtgagtgtagtacagaacaggttgtttttcaaaccatgaccttctccctccctccccctccttgtagtctgccatgtctattgttcccatttttatagcagagtgtgctcaatctttagttcctacttataagtgagaatgtgtggtatttggttttccattcttgcattggttcactttggattatgacctccagcttcatgcatatagttgcaaagaacatgatttcattcctttatatggctgtgtagtattccatagtgtgtgtgtaccatgttttatttatccaatccaccgttggtgggcatctaggttgattccttttctttgctattgtgaaaagtgcagcaatgaacatatgagtgcatctgtctttttggtataatgatctcttttcctttgggtatatacccagtaataagatagctaggtcaaatggtagctctgttttaagtttttgagaaatctccaaactgatttctacagtggctgaactaatttatattcccacagtgtataagcattcccttttctccacaacctagcaatagctgttatttttttacttttagtaatagccattctgaatggtatgaaatagtatttaattgtagttttaatttgtatttctctgatgattagtgatgatgagcattttttcatgtgtattggctccttgtatgtcctcttttgagaagtgtctgttcatggcctttgcccactttttaatgaggttacctgttatttgcttgttgatttgtttaagttccttgtagattctgtatattaaacttttgccagatgcattgtttgagaatattttctcccatttctgcagattgcctgtttactctgttgatactttcttttgctgtgcagatctttagtttaattaggtctcacttgtcaatttctgtgtttattgcaattgtttttggcaacttagccaaaaattatttgccaaagctgatgtcaagaatggtatttcctaggttttcttctaggatttttatagtttgaggtcttaacatttaattctttaacacattttgagttaatttttatatatgatgaaaggtaagggtccagtttcattcttgtgcatataactagccagctattgcagcaccatttattacatagagagtcctttccccatcgcatatttttgtcagctttgttgaaaatcagatggcagtaggtgtgtgactttatttctgggttctctattttgatgcattagtctatgtctctttttgtagcagtgccatgccatttggttactgtagctgttcagtatagtttgaagtcagataatgtgatgcctcaggctttgctcttctttgtttgaatgacctgttaaggctcttttttggttccgcatgaatttttgaatagttttttcctaattctgtgaagaatgatgtttgtagtttgataggaatggcattgaatctgtaaattgctttgggcagtatggtcattttaatgatattgactctcccaatccatgagcatggaatgttactttgtgttgtctgtgatttgtttcagcattgttttgtagttctctttatagagatatctcatctccttggttagctgtattttcctaagtatttcattttctttgtggctattgtaaatgagattgtgttcctgatttgactctcagcttgcacattattggtgtataggaatgctactgatttttacatattgattttgtattctaaaaccttactaaagttgttttatctatcagttctagcagccttttgacagtcttcagattttcctatatgtaggatcatatagtcagtgaagagagatactttgacttcttctttttctctttggatgctatatgtgtctgtttttatactgctataaagaactgcctgagactgggtaatttataaaggaaagagatttaattgactcacagttcagcatggctggggaggcctcaggaaacttacaatcgtggcagaaggtgaagaggggaacaaggcaccttctccacaaggcggcaggaaggagaagtgccaaggcagggggaacaaccccttataaaaccatcagatctcttgtgagaactcaccatcccaagaacaacatgggagaaactgcccccatgattcaattatctccacctgatctcttccttgacacatggggattatggggattacaatttaagatgtgatttgggtggagacacaaagcctaactatatcagatgccttttatttctttctcttgcctgttttcagtactatgttgaataggagtgatgagcataggcatacttgtcatattccagttctcaagggcaatggatccattttttgtctattcagtatgaggttggctgttggttcatcatagatgattcattattttgaggtatgttcctttgatgccttgtcttttgagagtttttattataaagggatgttggattttatcaaaagctttttatgaatccattgaggtgattgtgtgatttttattttaattctgtttatgtgttaaattatatttattgatttgcacatgttgaatcagccttgcattacaggaataaagcctactacatcatggtttgttaatgttttgatgtgctgctggattcagtttgctagtattttgttgggaatttttgtgtctatattcatcagggatactgacccaaagatcctttttttatttttgtttctctgccatgttttcatattaggctaatgctagcttcatggaatgagttagggagcagcacctggtcctcaatttttggaatagtacctgttcttctttctatatctgttagaattcagctgtaaatataacttatccatggctttttgggtttttttctgtattcaatttcagattttgatatttacctattcaggattttaatctgttcctggttcaatcttgggagattatttggttctagtaagatatatttcctctaaattttctaatttgtggaacagaattactcacagtattttctgaggatcttttgtatttctgtgggatcagttgtaatctcatatttgttatacctgattgtactgatttgtatcttctctttttttgttaatctagctagtggtctattcatctaattttttcaaagaacaaacttttggtttcattggtcttttgtttgcatttttgctttgcaatattatccagttcttctctaattttaattgtttcttttcttctgctagctttgtggttggttgtttctttgtttttgtttttctttttgtttttgtttttttgagacggagtctcgctcctcttctcccaggctggagtgcagtggcgcgatctcggctcactgcaagctccgcctcccaggccattctcctcctcagcctcccgagtagctgggactacaggcacccaccaccacacccggctaatttttttgtatttttagtagagacggggtttcaccgtgttagccagttcctttaggtgcaaaggtagattgttaatttgagatctctctaacttcttgatcaaggtgtttagcaatataaactctcctcttaacagactgcattagttacatcccagagattttggtatttgtttgcctattttaattaatttcaatacttttttatttttgccttaatttcagtgtccacccaggagttattgaggaccaagttgttaaatttccatatatttgtgtagttttaagagatctttttgatattgatttctatttttattgctctgttgtctgagagtgtgcttgactcccagatgattttaatctttttttaattgagacttgcttcatgaccaattatgtggttgatcttagagtatattccatgtgcagatgaaaaagaatgtgtatgttgtggttgttcggtagaatgttcagtagatgtttattaggtccatttgcttaagtgtcaagtttaaggccagagttcctttgttagtattctgccttgatgatctctctaatgcagtcagtacagttttgaagtctcccactattatagtgtggttgtctagaccttttgatatgccaagaagaacttgttttatgaatctggatgctccagtgttgggtgcatatatatttggggtaggcaagtctgcttgttggattgcaccctttatcattatgtaatgccttccattgcccttttaaatttttattggcttaaagtctattttatcaggtatgagaatagtgactcctgtacttttatgctttctgtttttatagtagatctttctctgtccatttactttgagcctgagtccttacatgtgtgatatatctcttgaagacagcagatggttgggtcttctctttttatccagcccaccactctctgccttttaagtggggtgtttagcccatttacattcgggattagtatggatatgtgagatttttattctgtcatcatgttgttagctggttgtcatgtagatttttattgtgtgattgtttcctagtgcctatgggctatgtgcctaagtgtgtttttgtggtagcaggtgtcattcttttgattccacatttagctttcccttaagaacctcttacaaggctgatgtagttgaaatgaatccctcagagtttgcttgtctgagaaagattttatttctccttcccttatgaagattagtttggtggaatataaaattcttggttggaatgtctttcctttaaggatgctaaaaattgtcccagaatctcttcttgcttttatggtttctgctgataggtctggtgctagtttcttccatatgtgatttgacccttctctctagctgcctttaagatgtttttctttttcattgaccttgatgaacctgatggctatatcttagtgatggttgtcttgtgtagtatctacgctgttctccatatttcttgggtttgcatgtcaacctctttagtgaaattagggagattttcatggactgtatactcaaatataatttccaagttgtttattctctctccttctctctcaggaatgccaatgagttatagactctgtctcattatataaacccatatttctcagaggttttgttcatgttttaaaattgtttatttttatcttactgtgttgatttgaaaaactgatctttgagctctgagcttctttccttagcttggtctaatcttctgttagtacttccaattgtattatgaaattcttgtagagaatttttcagctttagaagttcagtttggttatttcttaaaatggctatttcatctatcatttcttggatcattttactggattccttggattgagttttacctttctcttgaatatcaatgaccttccttgccatccagattctgaattccttgtttgtcacttcagtcatttccaactggttaagaatcattgctggggaggaactggtagactcctttggaggtaaggagaccctctgtctttatgaattaccagagttcttgtgctgatttttgtacccttaactgtagtttaaatatagtcagttggtttcatttctggatgtttttagacagccaatatgctctctgtagggtctttatctgtggctgatttcttgcctttgtttcacagaagggtatattagcaaagtatttttggtgttgtagtttgggctttcatccagaagatagcatttattagtaatgaccagtagatatggttatactcaactgcatggctcctttatatttcctagtatttgtagccatgaactatagtgtgttgggaagagagttcacctcctcaccaggtccattcttgggcctttgaggagcctctgctactgatttgtgcacattgattttgtttccttaaactttactgaatttatttatcatatctactagtttatcagttacaaaaattaattagttacagttggtgttcttttccgtgagacttttctttcatttataactggttttcatttcctttctaatttaaaggagcatatttaacattccatcttaaggcaatgtgatagccatgaggtctttgtgtgataatggtaaaaaggaagttaatctataatggaagtcaacagtagataaggaaggagtattccttggtacccttccatcatttacaacgtttcacaaaacaattcaggtaagaaaaatggcttaatctatgagataaaccttacagtatccatagttacacatacctgtcatgtgattcagaccctgtaattcacattcccttgacgctcaaaataattcagagatccaacagctgagattctgaattacatatttttacaggattatagttttacatgacctggaagtcttcagaatgaagaccaaaatatacaggagaaactctatttttatgcttagcttcaataaattatagacagccatgtaaaaatatgattggataaaaagggtatgatctagtgctaattttctaagtagggaaacccagcaaagcatgcctgttttggtttttcgtgacctctctgtgcagcatttcccctttctgggtatggtagaagattctgtcaggattggaatcttatgacctacagtcaaacaaggtaggtcagataatttctctgtggccaatttttacacagaaaggctaggagaaaattagagtaatatttttaggttttgtggttggcttttgagaaaagacgttctggtttctatgtcctgcctccatggggaacggatattcagaaactagaatccctttggcctgggcaggaggagagtggtggcgggtagaatgagcagctagagaaagaggggcattaagcaggaataggtcagagaggactattgattctgaggctgtatttgaggactgcattttaaggtgtcactttctgatccccaacactggccttgttgaaaaaacaaccacagcaacagtagcagcagcagcagcaaaaacatgagaataaaatccacccaaacaaatgatgaattgagatgcagtgacgaaaggattggtgtaatgcttaatgccaaaaaatatgagaggagtgccaacaaacttctgaggggaaacaagcaactatcacagcaacaagtagatctcaaatgtattagaacttgagggcatatgacttataaaccgtttatgaaaaaaaaaacttggaaatcaaatttttccaaccaaaaaaaatgaatcaaaataacacaggtgaaagaaactgtggataaaggactcatgaagatgactaaaaccatttaaaattagaacaatggacactatgctggtatatatcataacagttggagagaaatattaaaattatcaaaatctggtaaggagtagaagtttaacaattctgatttttatgtgctttcagagctgggagttggaagaaatgttataaaagtgaaatataagattttttttctatttttaaaactttaaaattttgttaatattttagacctacataagagttgtaaatatagtacagagagttctgatattgtcttcagtctgtcttaccctaatgttgacatattacataaccacaatacaattaacagaataagaaattaacactggcatcatacttttaactaaactatagacttcaatcagagttctccagtttttccattcatgttgtttctctgttcctgaatcctatcaagcatctattgttgcatttaatagtcatgtttctttcatctccaatctgtgacagttcctccattgttttttcgttttgttttgttttgtttttgacaatgttgacatttttgtagactactggttatgtatttcgtaaaatgactctcatatcgtattcgtctgatgttttctcctgattaaaattagagatttctgagatgaataacataaagatgatgtgtcttcaatacatcctatcaggtgatgaaacatgtaatttaaaaaatattaactactaaatgttttcataatttaaaactggaggggaagaaaaatgcacttgttcaaaactttctgcagtttaatttaccttttttcaggtgaattcagatcatagtaatttttagcaaaatattgtaaaataatatagagtatgactaattttaataaaaatttttaaaattatatatatatgttttctatgtatatatctacatctatttccagctgccaacatgtaaagaaacaattctaagatccattttaggaaatattgattatagatattaacggatggtagagtttgttatgtattattaaattgtactttatcttttccactttttctatttaggttgttgcaaaggtaattgcgacagttacttttgcaccaacctaatatgtacttttctgttctgatttattttaatttgcttttagaaagatagagttattgtttaaacaaaaattcaatgtttttgagcatatattatttattttgcatttttatttagtttgtatttctttcagaaacacaattctggaaagatacaacagtgtttaccttgaaggagcaagaactgtggatgctttgaatagacttatgttttcttatttgtgatgtgaacttttctacaagggaattatattacctttcaaataagctacatatgttactgtttcataatttctttatttttccatggaaattatttaacattttattttctgacaaagctcctgtttataagttatattttctgacaaagctcctgtttataagttagagcattcagagatttacttagaactatcctcagcttggccacttctatatggttttgagaaaagttaggtacattattatctcttaaaaaacttaaattagaccacaagctagttttgaaataactcaactgaggttattctttgatgactgacagtacaagagaattgtcatacactcagttattagttctttagacaaataaatatttaataaataaatatgttatatattatacatattaataggacaatgtaagtacacatgaaagttggtggtggaaaaattgccattgttactaatgctgtctcatgtctaataatgatagagctggaaaacagatgtttttctaaggcaaagaatttactcctaaccttttcttttatattgacatcatattgccattgtatgtcaggtaactgagtggaaagagagaatagagctgagggcacatacaattcatttagaattattctagtgagatgctcattagactagaaaataaaaacatatttggaggaaaacatttcttccctcactcctacaagggataaaaatgctaatatagttctcaatgcacagaacgtaatcaaatctacttcatagaactgatatactactggtatgaatgacctgtgatgatatactgaatttttgctttaatatttgttcttttcattgtttactagttttaaaacaccataaaatatttattaaaaaacctttaagggatttttttaaaggccatattgtaaatgtctttgcattaaacatttcataaggtatatttccaaatcttaaacaactttgctgtttgagtacaatatcagtaaatggcactttaagaagatagaaagccatctgcatccaaaatataaattaaaattatatgtaaaataaatcattttaactttagatagaaagtaacaacttaaatcaccttctatatagtgtataaatatatcatctaaaagatacctaaattttgatgtaaaaatgttctcaatatattttaccaggctgagaaaatcttacaagaattatctaggtatgtaatcattatattaaaatgccaaagacatattagacttgtggttatatttccttgggcaacaaaatagattttttttttaaatctatgtgtcttttaaggtaggggaaatagtaatgctgacaacaaagttttctcactaaatatatctgttcttctttgttaatatttacagtcaaagggggctgttctctggccaacctgcacccaggtgaaataaacagccttgttgctcacacacacacacacaaaatatatatatacatatacatatacacacacacatatatacatatacatatatacacacatatatatacatatacatatatatacacatatatatacatatgcatatatatatacatatatatatacatattttttaaccgcccacctatgtaaagtactctaccacatctgacaagttgagaaaaatgatgacatcaaatgttgcctatgggaagcctctaatcaactaaatatctcgacttcaacactcaaatatactgctacagcattgtaaagtgttttgtaccctctgaatataatactgtaaaatgttctacattattatttgaagaaaattgttgaggaataattttacagtgtgtaaggtggtagatgcagatgaaataattataatatgaaaatattgagatcataaagtaatttcccttgtagttacctttatgaaagttgtacgattgagtttaatttcaataaagcaacatcagccataatttagtgtcctttaagtgaattaagcaatttcaagccttataaacatgttcaagttcagtgagaaggacactttttagaaaatttctaagctaatgactttagtggcattggtaaatatccagagactgtgtgaggaaaacacccgaatatagaactgtaaaatctaaatagagaaaccattgtgttaaatctgaaaacatattagtaagtgacattttcctttaagtaatcttattgtatttttcgtgacattcaattatttatttgcaccaagaaatattgttcaggacttgaagactgagtaaatgtgcgtgagctacacaaaatatattttgttattagtaaatcatctattataaaactgagaagtctcaaaagtaggtaatgggaaaaaagtgtttccattgtttgctttcttatttcaaatatctttatgaaaaattcagcattttaataataaagagcaataattaaagatgactgttatttattattttggtagacagaaaggatggtttcatttatatttgttcaattattttctttaactcttattctatatataggccagttgtattttttgttttgttaattagctgcctattaagttttcttgcataattatattcagtttgtatgaactagttataaatcaaatatatttctttttatttataaaatagcagggtgttgctttgctcatctatcttttcattagttaaattttgatgtgttaaagtttggcatttgatgtagtttaattgacatcattttgaggaggtggggaatgaagagatttttctctatgagcatacagcttagaaagtcatcattccaacttaacacttgattaatattcaatcacttttttaatgttattttaaaatcatgttttctttgaagactttctgaactttgaaatacaatttttaatttagaaatcattggtatttttctttttgttttaatttttacactttattaaacatcattttataaacacagaatatacattaaaaagcataataacaattttactatggttatttctgtcattaatgggtcgctattaagagtttcaggtagtgctaatataattacaattcttaagtcaattgatggacactttgaatagagatttaaatgaagaagtttatcattggcatgcatgctgtatagtcccaaatatctcaatcctattatattaaggatgagtattatattggagtaatattttatggctttcaaaatatgttttaaattgttacttttagagataccaaccataatacctaatacctaagtaggcagagctgtagatacaatcattctgaggtgatctgaccctacactgacaataacagttgtcagtagagatcattgaaattcatatttttctactttagatgaaatgtattttgaatgtcttagctggtattcaaagaaaaaagaaaagatgattaaaagcaatacaatcataggaggcttccagttccaaaattgtgatgtagatggaacctggcttcacttcccctaacagaaagccgaaaacaaatatacaatgccaagattatcaccagaaatatcccagaactcaaataaggaaatgagaattcctggggccacaaagaagtgtaatattaataactctaaggagatggtaagataataggacttccacatctgcaatatctgtcccctcattctgcctgcctccaggtgaagagaaaaatttttcccaattcactgtttctgcactggcaaaactgagatcaagatggacaaccatcttccccatcatattgggtagcctggcaggagacatgtttctgtttttactcacagaaagcattacaagtacttaaagggataaatatcactgagaatagccagtgacaaaggatggaggtagaattatcatccccagacctggaaaatgtaatctgtaatttggagatgtaatttgccaaaggagatgccaaatcagaatgactgtatagcagcaccacacgaaaggaggttcatctaataggtccctagaacacaaaaccctagacagccttcctccctgccaggacatcccctttaggaccttctccacttgggaaaggcagcactttgagcttttactagagccaaggcaaacctgggctgaaggctaccacccagagctgaaaaggaggtgatgacctagcagtaaaaatctgtgaggaaatgtatccaataaaaatcaaaacaagcaagacagagaagactgaaataaatacctaatctttcaatgcaaagacacacatatgtgtctacaagaaataatagcaaacaggaaaccatgatttccccaaacataaaaaacaaggaattaataagtgactccaatgagatggcaatatgtgagctctctgacaaagaattcaaaatggtagttttaagaaagctcagtgatctgcaagataacacagaaaagaaattcagaaatatatcagaaaaatttaataaagagattaaaataattaaaaatcacacagaaatcgtagagctgagaaatacataagctgaagtaaaaaattcatcgaagactctcgatagcagaatgaccacgcagatgaaagagtcagtggactcaaacacagcctacttaaaaatatacagaggagaaaaaagtctaaagaccaaaaaagatcacctaaaagatatagaagagtacctcagaagactaaatttaagaattattagtgttcatgagaaagttgaacaatagcaagtggcagaaagcttactaaaacaaaccagcatatttttccaaacttgtgtggagaaaacacatgcatgtaagttacatccaagcacacataggcgaacaacatcatacagatttgacaaacaagactacccaagacctatgataatcaaactctcaaaagtcaaggaccaagagtgaatcccaaaaacagaaaaagaaaagaaggaaaataaaaaggagttccagttcacctggaaacagacatctcaacagaaaccatacaagccaggaaagagtagaatgacatttctactaaagtgctgaaagaaaaagaaaatcaccatacaagaatactgtattcaacaaagctgtccttcagctatgaaacagaaaaattctttcccagacaaacaagagcttaaaagagttgatcaccaccagatatgtcttacaaaaaataccaaagagagttcttccatctgaaagaaaaaaaaatgtgaaggaaacaaacaaaaacatctgaaggtataaaacccactgttataattaagtgcatggccaaacccagaatactgtaatgccgtaattgtggtgtgcaattcactcataactctagtatgaagcccaaaagacagttctatcaaaaacaataatagttacaggaacctgttaagagatatgtaatataaaatatgtaaactaacacaacaaagagccaaaatgtatgtgtgtgttgtggggatggagttaaaatgcagatttttcctgttttttttctttgtttccattttttctttgtgatctaagataacttgtcatatctgtaaaataactttattatatctataagatatttttgtaagactcatggtgaccacatacaaaagcctataatagataaagtaaaaataaaaagcaacaaattaaaccatactagcagagaaaatcaaaatcttttaactacaaaagaatacaacaagaaagaaaggaagagatgaattacaaacaactaaaaaacaagcaacgaaatggcagtagtaagtccttatttacagtaataacactgaatgtaaatgaacttaattatccaattaaaaggcatagaatagctgaatgagtaaagaaacaagactttatgctgcctacaagaaacttcatctgtgaagacatatatagcctgaaagtgaaaagattggaaaatgatattctatgcaactgaaaactaaaaaagagcagaagtagctatacttatatcagataaaataaactacagattaaaggctataaaggaggccaaaagtgcccactgtataatattagtgaacagggtcacaaaaattctcaagaaaatattagaaaacttttgtcaagaacacattaaaaagatcattcactatatttaagtgggattcatctcaggagtgcaaggatggttcagcatacacaaatcaataaatatgtacatcatattaacataacccagaacaaaaaccatatgattattttaataggtgcccataaaagcacttgataaaatttaaatcactttataatgaaaaccctcatcaaaatggatgtagaaggaacatgcctcaaaataataaaggctgcatatgacaagcccatagctaacactttactgaatgggggaaaattgaagacctttcctctagatttggagaaaaagacaaggatgcccacttaccactttaccactcttattcaaaacagtactggaaaccctggccagagcaattaggtaagaaaaggaaatttaaaagtatccaaattggaatggaataagtcaaattagccttgttcacagaagacaagattctatacttagaaaaacctaaagacggcctggcgcagtggctcacacctgtaatcccagcattttgggaggctgaggcaggaagatcacgaggtcaggagattgagaccatcctggctaacatggtgaaaccacatctctactaaaaatacaaaaaattagccaggcttggtggcatgtgcctgtagtcccagatacttgggaggctgaggcaggaaaatcactgaacctaggaggcagaagttgcagtgagctgagatcgtgccattgcactccagcgtggcaacagaacaaggctccatctcaaaaaaaaaaaaaaaaaaaaaaaaaaaaaaaactgaaagactctaccaaaaaacagtaagaattgataaatgaattcagtaaagttacaggccacaaaatcaacatacaaaaatcaatagtatttatatacactgacagtgaagaatctaaaaaagaaatcaagaattcaattccattaacaatagctacaataatataaaatacttagcaatcagtttaaccaaataagttaaatgtctgtacaaagacaactataaagcattaatgaaagaaatcaaagaggacagaaacaaatgaaaagatatttcatgctcacggattggaagaattaatacttttaaaatgacaatactacccaaagtgatctacagattcaatgcaatccctatcaaaataccaatgccattttcacagaaatagaaaaagcaatcataaaattcctatggaactaaaaaaggccctgaatagccaaagcaatcctgagcaaaaagaacagagctggagtcacactacctgacttcaaaatttattacaaagacatagtaaccaaattattgtggtaaaaatagactcataaaccaatggaacagaatagaagacccagatataaatccgtgcatttgcatccaactcatctttggctaaggtgctaagaacataatggggaaaggatattctacatatgttctcactcatgtggaagctatatttaataaatggtactgggaaaactatataattatgtagaagaataaaactggatccccatcttttaccacacacaaaaataaaaatggactaaagacttaaatctcagacctgaaactatgaaactgctagaagaaagcattgggtaagcaccccaggacattggtctggacaaagattttgtgtttcatactgtaaaagcacaggcaactaaagcaaaaaataaaaaataaaaaaaaatgaaaagaaaaaccaggattatatcaaggtaaaatcttctgcacaataaatggaattatcaacaaagtgaagagacaacccatagaatggaagaaaatatttgcaaattatccatctgatggaattaataaccagaatatataaggagctcaaacaactcaatagcaaatgaataaattgtccagtaaaatggcaaacagacctgaatagacgtttatcaaaagaagacatacatatggccaaaaggtatatgaaaaaaatactcatcactaatcatcagagaaacacaaatcaaaactataatatatcaatcctgcacctgctaaaatggcttttattaaaaggacattataaaaaagacagatgctggtgatgatgcagagaaaagggaactttcttatactgttggtgggaatgtaaatttgcatagctactatggagaacagcatggagatacctaaaaaaaaatagaactacatatgatccagcaattccactactgggtatataatcaaaagaaaggaaatcagtatatcgaagagacattacactctcatgtttactgcaacactattcacagtagccaaaatgtggaagcaacctaagtgtccatcaatggttaaatggataaaatgtgatatatacacacacacacgcacacacacacacacacacacacatagatatgtacatatatatgatattctattatgtgtgtgtttatatatacaattcaccatatatacatatatatgatagaatatcatttagctataccaaaatgaaattctgtcatttgcagcaacatggatggaactggtggctcattatgttaagtgaaataagcctggtacatgttctcacatgttctcactgtcttatgttaaagccaaacacatgttcttactcatatggaagctaaaaaagtgaatctcataattaaagggagtagattggtcattaccagagagtggtgagaaggggaggggtaaagggaggatgaagagaagttgattaatgggtacaaatacatagtttgatagaagtaataagacctagtgatagatagacttgtacagtgactatattgtacaacaatctattgtatatttcaaaatagctagaagagaagaatttgaatagttccagcagaaagacaagacaaatattaggtgatggatatcctaagtacactgatttgatctttaccaattatatgagtgtattaaattattatttgtaccctgaaactatgtacatatgttatgcatcaataaaaggtaataccatcatgtataatttgatgtattgaacagaaaatcaacattgatgcatctttggctatgacttacaagtatgagtttattttggaatatcaataccccttcaaccttcaataagtatattataataattctataatgagatactagtctttatgctgcttattgtgcagactgggtttcttcatgtttttctttgaatgttgcaatatattttaaacttcattactttcttgacactttatgattttgtatctatgactttattgttttcttggatatattttaaaatgtgttttttctttatgtttctacatccacccatatgcatttccttatggtttcatctttaagctatcttattttctagagattgtaccctcctcatctgcctatattggtctcagggcatttcttgtgcatagctcgagtgggtagcatccccagtcactgagctcatcacacgcggtgctaatctataccttcagatgatgtgcatctaatttctaattccagcttctgctatagctaactgttccatagccagtaatttagtccttacttagagtgattgcccagtggggttcacatttattctgctcataaaatcccatcttttctgcaagaaaggactgacttcctggaagatgaaaacaatagcaatcatcctcctataaaaaggatttcctatctttgggttacttcttttgtaaaatttcttcaaagcattgggctccaggcaagtgacaatttttaaaaaactattatatgaagatggacaaattttatctcttagtacccacaactgtgttgtaggttatattttggcaaacggccttagtttgatctaccctatagaatcacagtaaggagatctcattttttccttttattgatgagaatactgaaaaactaagtgtgtttcacaaacaacagaaaggtccagaaagactatgtatgtttcagaaacaaagcttttaaatggcaaagatgtgataagaacatgaacgttctgatttttcctgatgttctaatttatcttatttccagaacaactaagagccattgggcacttgatttgtatacctaaaatatcttatttacttaatcttgtaaaactttgggtaaggaattcacacagaaaactaaatgcttacctgagggttatcaattccttggtgaatagtacagtcctggtgaagtatatctgatctatagagacatgtgaaattcagatgaaaactgtgatcttttctggagtttattagaaacgtgatggagaatctgctggggtcatgactgttgctcccccactgaatttatggtggaacagatggttctcccagaaagaccaacaaagttttaatgattataaaatctttgtcagaaaattcacggacttggttatgcatgcattgttatcactgcttctttcttttatttatactttaaggatgaagagcctgatttacacagctggattttaaacatggtttaaatgaataaatttggatttctgaaaagtgacttaataaactgaaatactcagttggattcttgagtaggaatacagtatagctcaaaatattagagacggtcttacttgtcctgaaataaactgatcttatcaatagaaattcaacctgaatgtgagtctggttattaggaaaatagtatctctcatggaaaggaaaatagcaatttggaaatgaaacatgagaggtaattagtcaaaggataagaaagagtatctgttgccgcagggaatgaaaactaagtaaagtgaatctcatatttcagtgtgtgaaaatacatatgatcatatattttcttaccaagacttgaagggataggataccagattagaatagaataatggaaatatatgccttattcaatataaataggccagttgtgagttaggatagtgtggatgtgagctgcttagaacttggtgtacttgtaaagtggaaatggcctgaagaataatatttgggtgataaaggagatgaacggagtgtctttgtaggacatgatagctttcctcctgtactctaaaggctactgagtgaaagaggaattatttgaattctgaataatgccaaggatgatatcccttatatagaagaaaaacatatcaataaaaggaagactttctaacagagctacttgcaaccaaatgaactgtgttccctcttactagaagttttatatagagactgcatgataaaattataaaatcaatagaatattagtagaaaaaattaaaatgagagatccgtgattagattaaatggatttaaagcctcttccaggcttgggattctagaattctgtgatacatgacacatgaattcagtttcaccatgctagatttaaatgttttcaaattgtcactataatattctataatatgaccattgatggaaaacaaccacgtttatatgagaaacagaggcactattgcttccagaaccatagagctatcctgctcttcctcatcctagggccttcaaatagtgtggctttgtcaggtgtgcaataactgaaaaaatctgagccttaatattgaatgcttcttctcaaatatgcaataaagaggtttttttctatttttaccttccaaatgttatctagagaataattatttaaaaaatattgacctgagttttacttagaaccttcacaagtttgtgaaaaacaattctcttcactatccttgtcttgatgcagctttgtacaactcttagtaccaaagcagagattgcgaagaaagtattgcattccatatttagtcagagactacagatgatgacaaatatattctgcctttgttgacctagaatgcatcaacaaatcaatcctccttagacttgaactcagcatcacactcacatattttggttaccatgtattcctaaaatgcagaaatgggtacactgacaaattttgcaattcaagatttttaccagttcagctcagaggtcaaaagaagacagagaagcagatgcatcacaggggggatttttcactgcaagaatggcgtgtctccatttgttacaagttagacttggaaaaatcctttagttaaatgaaaaagacaaatgtgagacagactgcctcgagaatcatttaccaatatctcggaacgactgtgattatacaaaacaccgatattaaaataattaagttcaaaaactaagtgcaaggttgtaagataaattgttagcaattctttaacataatttctgtcctctccctgcaacaaaccgggtcttcatcatgcccctggagttattctaaaattaatacacgattatttttctaactccgcttaaaattctttcatctctcctcttggcctacagattaaaacttctcaggactgcctttcctaagcccttttattatttgactattgcttatctatttagactaattgttctgttactcttctcttcctgaatgcaaattacttaaaaatttctgaatgtaatgtccacatcctggacattcatcatttttcctctcctatttttacattgtgaacacctactcatatgtatagattttgttcagatgtgttcatcattttaaaggccatagccttcataaccaccttttaggcctagagaattgattacattctgctctgtcccataactatatcctgtgttttcatatattaaaatacacatgaaaatattacaattaattcattctaaggcagagtttattcaatcatctgtatatttctagaacattgtacaacttctaaattttaaatattttgtatcattcattttccaaagaaatttagaaggcttgatagcatgtatgttttttaaagaaataattgctgtagaggataacataggacatgtaaaataagataaagctaggagtcagattaatatttaaaatgcatgtaatatgccttaaatattttctactttatggatattcattaattaataaaagccaagagttttctaaattaccagaggagggcttcagtttgggcctaagtatcgtagcagcctacaaaaagaaggaggcttagtcagctatgtgattttcattgtcattgaaagaaatggtctcagactgtcagcagctaaataattatttttgctagtaaggcctgaacgcatttcaccctggtccattttaagagtagatgatactcttatttaaaacctattgagcaatagcctcaacaacaacctttcagtaatgcccataagaccatgtcttataacttttgttattgtagtgaaaaggaataataccactggtaattcagtaaaagtaattctatgctggtgaaggtgaggaggaaaaaatgatctctgaatgtactgccttctaattctcaatatttagtccaaagaaaacatgtaaacttgtacaggaatgtatgtatttttatatttgtcccacttattgtagtgaatattaaggaatggaataaattcataaattaaaaaatacaataatctatagcacagcatctattggaagatacatacccaagcagcagacaagaagttgagttgtagaattttctcagttgtataagcagactcagtgatgtgcagggccaaggttgagtgtaaagaatgcctggagtatatggttaaaaaatcattctgaatagagtggctttcttgtcctatagaaccatgtgaacacagggtgagaaacagacaaggggtttgtaaatggagagctcttgcctctggagctatcacaagctctggatcctggtctgaatgaaaatgaggcatctcctagagtctcgtgaaaaacaggtataacagctgggttttcatatttaggcccagagatctggtaatttaagactttgcaagaggataagattgaagctttcaataaaaaatatttttctgtaagaactggattcaggcagaaaatggagcctaagttaaaggcatttattttctgtggatataccaaagaataaagaagtaggtaaagcagaggcccacaaaactgtgggagcttgaggaaagcaaataaacaagaaaaatcagtaaaatacatagtacatttatgtattagtctgttttcacactgctgataaagacatacctgagactgggaagaaaaagaggtttaattggacttacagttccacatggctgaggaggcctcagaatcatggtgggtgctgaaaggcacttcttacttagcagtggcaagagaaaatgaggaaggtgccaaagcagaaacccctaataaaaccatcagatctcatgagacttattcactaccattagaacagtatgggggaaccacccccatgatgcaaattatctcccaccaggtctctcctagaacatgtgggaattatgggagtacaattcaagatgagatttgggtggggacacacagccaaaccatatcactctacccctggctcctccaaatctcacgtcctcacatttcaaaaccaatcatgccttctcaacagtcccccaaagtcttaactcatctcagcattaacccaaaagtccacagtccaaagtctcatctgagacaagcaaagtcccttctgcctatgagcctgtaaaatcaaaagcaagctacttcttagatacagtgggggtacaggtattggctaaatactgctgttccaaatgggagaaattcgtcaaaacaaagtggttattgggcccatgccagtctgaattccagtgaggaagtcaaattttaaaatgtcaagatgatctcctttgactccaagtctcacattcaggtcatgctgatataagaggtgggttcccatggtcttgggcagctccacccctgtggctttgcagggtacagcctccctcctggctgctttcacaggctagcattgagtatctatggtttttccaggggcacagtgcaagctgtcagtggatctaccatgctggggtctggaggacggtggccctcctctcacaactccactaggcagtgcccccgtagggactctgcatgggggctcagaccccacatttcccttctgcactgccctagtagaggttttccatgggcatcccacccctgcagcaaacttctgcctggacatccaggtgtttctatacatcttctgaaatctaggcagaggttcccaaactccaattcttgatttcccttcactcacagctcaacaccacatggaaactgccaaggcttggagcttgcaccctctgcaagccatggcccaagctctacgttggcccctttcatccgcagctggaacagctgggatgcagggcaccgagtccctagactgcaaacagcatggggaccctggccctggtccacgaaaccattttctcctaggcctctgggtctgtgatgggaggggctgccatgaaaacctctgacatgccctggacatattgtcctcattgtcttggggattaattccgctccttgttacttatgcaaatctctgcagctggcttgactctctccccagaaaatggatttttcttttctatcacattgtcattttttgaacgtttatgctctgcttcccttataaaactgaatgttttttaacagcacccaagtcacctgctgaatgtttcgctgcttagaaatttcttgctccatatactctaaatcatctctctcaagttcaaagttccacacatctctagggcaggggcaaagtgtctttgctaaaacataatagcctctttgctaaaacataacaagagtcacctttgttccagttccccacaagttcctcatctccacctgagaccacctcagcctgaaccttattgtccatatcactatcaggcttttggtcaaagccattcaagtctctgggaagttctaaattttcccacatgttcctgtcttcatcttagccctccaaactgttccaacctctgcctgttacccagttccaaagtcggttccacatttttggttaccttgtcagcaacgtcccactctactgataccaatttactgtatcagtctgttttaaagctactgataaagacatactggagactgggaagaaaaagaggtttaattggacttacatagttccacatggctggggaggcctcagaatcatggcaagaggagaggggaacttcttacatagtggcagcaagagaaaatgaggaagatgcaaaagcggaaacccataatgagaccatcagatatcaagagacttattcactaccattagaatagtatgggggaaaccatccccatgatgcaaattatctcccacttggtccctcccacaacatgtgggaattatggaagtacaattcaagatgagatttgggtggggacacagagccaaaccatatcaattaataaggataaattttgcaaaaaaaaaaaaaaaaaaaaacaaagtaggtaaagggcatagtgttagggatgagactggaatttagataggcctctcttctctgatgtgtctttctgtaaaggtctaaatgaagggaaggggccttgtcattggttttctgggaaagaacatttcaggaagaaagatagcaagagcaagtccttatgtggctagagtagaaggaaatgagatgagtagaaggagaagaagtcagagtggtaactcggtgggtggtaggcagattgggcagtgctttatttcgttgttagggtcttgttgttagggtttttaggtcttactgtgagaaatgagaaaccattggagagttttgagcagacaagtggcataaaaaggattcttcaggtttctgtattgaaaatagattatagaaagcaaaagcattagaatgaagaccagtctggaagctacttgtacaattcagatttaatgcttggaatttggtccactaacatgattttgtgaaatatcctattgtgatgatcaaaagactcgatggatttgacatttcactggtaaaagaagataagacatatgatttttacagtttattttatgggagcaaattgtttattcattaaattcatttatgtcatgcatctatccaaaaaaaaattatgtggttggggatatgctatttctcaaggttatgtgataatatcttccagcatagtcagatattttatacgtataataactcgggcaaaattcaaaagcaaatagtttaccatgttatgaaataaagcttctgtaagaaaatattcaaattaaatgtccagtggcaaatggcacatacaatccactggcatacatctttcttaatatttataaaacttgaagaagtgtttgaattatctacttaaaacaggattttagggaattcaatattgtgtttcattcatcaaatcattgattcaacagctgtttattgggagtctctgtgtgcaaagcagcatgctaggctttggggaaatagcagcaaatttaaaaatttcctgccccctatgtattacattctattggcagggagagagacaataaataagtgctatataattccttagatggtagtaagtactatgaagaaaaataaagcagggaaggatggcagggagagggcaaatgttgggaagataaattttaaaggggttataagcgatgcccaccctccaagataaggtgaagttagagaaaatgtcttcactgaagtcatgggcaagccatgggaatatcctagtagcagaggcagagaatgtgcctagatgttctgaaggaagcatgcttggtgtgtttgagaaacacaggaagatgctgggttgagttgtctagcacattgtaatcaactttgagatgaataaataaatttcctgtcttgaaatatcttagcacctacgctaaattccaaatatcttaccagcaacagacaggaaggtcttatgtgctttggcctctcatacttcagagacctttatttttaaccttccccactctatgtcccacccccacctccctgccacattcacccttagctccttgagcaagtcatgtccacctcagcagcctttctatgcaccaataatgaaccagctggaaaagaaatcacgaaagcaatcgcatatacaatagaaacaaaataataaataaatggataagatacctaagaataaccaatgaggtaaaaaatttttacaatagaaacctcaaaacactgatgaaagaaattgaacaggacacaaaaaatggaaagacatctcatgctcatggatgggaagaattaatattgttaaaatggccgtaatacccaaagtgacctacagatttaatgcagtctctatcaaaataccaattacattattcacagaaatagaaaaaataatcctaaaattgcagagaacacaaaagagcctaaatagccaaaataattctgaccaaaaagaacaaagctgaaggcatcatactacctgactgcaaaatatactacaaagctatagtaacaatgacagcttgatattggtataaaaccagacacattagaaaaatgaaacagcttagagagcctggaaattaatccacatatttacagccaactgattttcaacaaaggcacccagaacatacaatagggaaagggcatcctcttcaataaacagtgctgggcaaataatatccatttgtgaagaataaaactagacttctatctcaccacatataaaaatcaactcaaaatggattaaaggcttaaatataagacttaaatctataaaactactagaagaaacataagagaaatgcttcaggacattattctagacaaagattttgtgggtaagacttaaaaagcgcagatgacaataacaaaagtagacagatgggtctatatcaaactaaaaagctttggcacagcaaaggaaacaatcaacagaatgaagagataacctgttgaatggaagaaaatattttcaaactattcattcaacaatggactgatatctggaacatacaagggattcaaaggactcaacagcaaaaacaacggcaatgacaaaacctacaagcaatcccattaaaaagtgggcaaagatataaatagacatattttaaaagaagatgtacaaatggcctgatagcatatgaaaagattctcaacatcactaatcctcagggaaatgcaaatcaaaactacaaagagatattgtctcaccctagttagaatggctattatcaaagagaacaaaataaaaatgctggtgagaatgcagagaaaaggaaatttatacatgatcaatgtgaatgtaaattagtacagccattttggaaaacagcgtggaggtttctcaaaaaaaaaaaaatctaaaaatagaactgccatataactcagcaatcccactactggttatttattcaaaggaagtaaaagcagtatatcaaagtgataactgtactcctatgtttaatgcatcactattcacaataaatcaacctaaatgtccatcaatagatgaatggataaagaaaatgtatatatacacaatggaatactattcagccataaaaaagaatgaaatcctattattcacagcaacatgtatgagcctggaggacgttatgtaaagtgaaataaataagtcaggcacagaaagacaaatggtgcacattctctctcatgtgggagctaaaaaaacgttgagcacatagaaatagggagcagaattatggttattacaggctgagaaggggagggagaggatagaaagaaatggtacaaattacagctagaagaggaataagttcttgtgctccatagcactgcagaatgaatataattaacaataatttgctgtaagtttcaaaaatctagaagataggattttgaatattcccaacacaaagaaatgataaatgcttgacgtggtgaatatgctaattaccctgatttgctcacttactgtatacttatatattgcagtatcactctgtagcacataaatatgtacaattattatgaatcaactaaagataaaagagaaaataattcagttgaagatgagtaagcaactgacccaggtgaccatggagctctacacaatgcatccatccaagaagaggtaatagttctggcacaaggcatgggagaccttagtctggaggttcactctttttctgtgctgttctgcacatcattctccttttgaactccacctgccctgtttggggcatttaaaggagacatctagagtccctctgcaagaaaactcattgcaaagttattacaaatattcttagagctttcttggccatcgtgcaaatatttttcaggtttgtgtgtttctctatttctttcttgggttcagtctccctctgtgatctcactgaacttctttaaactactcaggcagtggctattctttccttaacgctgaaatctacctctctcattcgacgagaattcataatacctatatatagtgctgtcctctcagctccttttgtttgtgattcttggttgattctagattgctaaacaaaggaagagtatagtattttggagtgaaggcaggaacacttggatatagtcactgattacttcaggaaaccaaccaagatcattctttttttttgtctttttttttcctttttttaattattattatactttaagttttagggtacatgtgcacaatgtgcaggttagttacatatgtatacatgtgccatgctggtgtgctgcacccattaactcatcatttagcattaggtatatctcctaatgctatccctccctcctcccccccaccacacaacagtccccagagtgtgatgttccccttcctatgtccatgtgttctcattgttcaattcccatctatgagtgagaacatgcggtgtttgtttttttatccaaaatcaatgtacaaaaatcacaagcattcttatacaccaaaaacagacaaacagagagccaaatcatgagtgaactcacattcacaattgcttcaaagagaataaaatacttaggaatccaacttacaagggaagtgaaggacctcttcaaggacaactacaaaccactgctcaatgaaataaaagaggatacaaagaaatggaagaacattccatgctcatgggtaggaagaatcaatatcgtgaaaatggccatactgcccaaggtaatttatagattcaatgccatcccatcaagctaccaatgactttcttcacagaattggaaaaaactactttaaagttcatatggagccaaaaaagagcccgcatcgccaagtcaatcctaagccaaaagaataaagctggaggcatcacgctacctgacttcaaactatactacaaggctacagtaaccaaaacagcatggtactggtatcaaaacagagacatagatcaatggaacagaacagagccctcagaaataacgccgcatatctacaactatctgatctttgacaaacctgacaaaaacaagcaatggggaaaggattccctatttaataaatggtgctgggaaaactggctagccatatgtagaaagttgaaactggatcccttccttacaccttatacaaaaattaattcaagatggattaaagacttaaacgttagaccaagatcattcttgatgtgggcttgtacttactttactttgtgcgagtgccctcactttctaccctcaaaccctcatacagccagaagtgctgtatcaaggctaagggtttaaagaaacttgcatgaaaacaggccttttatttcaactcataaagattggagggttttcacaaactgtacattaaaggtatctcaaatatgccttaatatttttatgtaatctaaattctaagtgtttttctaatataataattttatgactcagtgaaaccaaaatcataccttttacttatacaaatacaatgcaagaagatatttgagcttaattttattagattttggttgtatgtaattctgctgcatgaaattaatacatacatattctatggtaacagaacattgtgactaatagcctttttatgaattcaaatagttctattgaatagatagacacaggtcaatgagactacaatataacgatagtaatttattttattccactagttacggaaatagtgataaactattctacataagaacttatattctgacttctcttcagatcatataaatctattactttttactgaagattttctaggagaggaacaactcatttcagcaaacaaaacaaaacaaaagtcttaactagagataacaagagaatttttacaaaataatcccaaatttgaaaggtggaaataattaaaaatttgcttttgtaagaattcttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtagttttagtagagacagggtttcaccgtgttagccagaatggtctcgatctcctgacctcgtgatccgcccgcctcggcctcccaaagtgctgggattacaggcgtgagccaccacgcccggccaagaattcttttactagatctacaaaacaatcattaaaagtatatcaaccagaatttattatccatatttccaaataaagacagtaagtttcagagatggtaaatgtaaatattaaataaactgtccaagatcatgtggggacatttatgcagagccagaatgagaagccaaccaagtcttcttgcttctacactttccacttcctacttagtgatgtaagaactattgagtcctcctgttccaccccctctcataaaaacacttcagtacatttctttaaaaaaaaagtgattaccatcaatctggcacctgtaatatatttgattttcaaaactaaagtcattttcaatagaaacaagtttttgttttgttttgtttgagacagagtctcactctgcccaggctggaatgcagtggcacgatcacagctcactgcaacttccacctcccgggctcaagtaatcctcccaccttggcctcccagtagctatgactacaggcacacaccacttcactaggctaatttttgtattttttctagagacgaggtttcacagtgttgcccaggatagtcttgaactcctgagctcaagcaatctccctgccttggcctcccaaaatgctgggattacaggcatgtgccacggtgccctgccaatagttacaagctcttatgtttctatagttatgtaaagtctgaaaaatgccaagaatgcacatgaagagcatgtaatacgtgtaatgaaaccattataggaaatactatgtgttgctaaatataatgcttattatttgcaaattataattttggttgtcccaaacttgatgattatttgtatatttttcataaactgcaaaaagaattttcagaggacttagtgacaaacaaaaggtatgatataaagcacacaaaaacatattctccatggaaagaaaagttggaattgagaggcctaggagaggcagcctccatgtattgatgaaattacagttaaattagaaagcagagaacaattgagtaggtttgaaaaatgagaaacagttagcaaaaaaaaaaaaaaaaatacacacacgcacacatatatgtatgataagaagttttaaaaatgattaaaagaggtatccatgaagagatgaacacaatttgaatatgcacttagcacataaggatgtacaatcaatatgcaacatagtgttttgaatcctaactgataataaaataactacaaaatcctgcaaactcataatatttagctaggttattctgtaaactgtattttactgataattaaaagtaattttagtgagaataatagtgtgtattttatattatcaataatttgttttccttgcttatttctctttgctgcaaaatgggttagtaaaatactttgggcgtcagttaatgtacacttgaaaatgcttttagttttattctgaaaaagaaatgatatcaatatacatttataaatgttatgaatagttatacactttctgattaaacaataaaatccaacatctttagctttctaaatggtgctttttcttgtacgtatctatatttaatttttgtaagaaatatttgctatataagagagaaactatgagacatttatgtaatttataaataataaaaattaaacaaatagctgagaaactctgcctataattagatcaaaattatttttgtaaattatatggctcttcaaaatatttcttcctcgcttccttactttcctggaaatagtgtgctttcccacccctagaatttctgtttgtgcatttgacttgttttggccagtggatattaaccaatatcaagcattccaaggcttgctatgtgcattcggtgtagagcttgctgtcctgtgtttcctcaatgttaaaaatagccattgagtagttactgtgccttcagactcagccccagaatgtacctgtgtaggacagagttgctctagcagacctgaattgagaagcaattctaccccgactaccacagcctgaagctaagtggcccagctgacctacaaatcataaacaatacccccaaaaaacaaattatcatgttaaatcactgaaatttgaagtcatttgttcacaatagacttcaaatttcaaatagctaatcaatagatttaatcatttataggatagaaatcacctacctatttgacccattcccctacttagcacctagagacaatcaatcaacctgaacattttgaatggcactatctgtttttctaaacataattttatgtcacatacatgtattcacatatataatgatatatatagtatatctgaatattttatttttacttcattaagatatgtcagaatgtatatggtcatctgagtcttattttttcctcaatatagtgtctctacattttatccacattgttatgtgcagctgtagtatattcattttcactgctctataatatccattatgtgacttttcccacatattatttatccatgtttgttactaacatgttatttcgatgattttcattgtttgctaatacaaacaatgctccaaggagcattctgcatatctggagattgtatatgttgaagcacatgtgtaaacgtttctctagggcatcagttctcaaacttttggcctgaggatctgtatttgttaaggtttgccagagaaatataatagaacgaatatgtgtgtgtgtgtctgtgtgtctgtgtgtgtgtgtgtgtctgtatgttgatgtgtatatatacatatgtattgtgtgtatctctctgtgtgtgtatatatatgtacatgtacatatatgtatatgtacatgtacatatatgtatatgtacatgtacatatatgtatatgtacatgtacatatatgtatatgtacatatggatatatatgcatacacatacatgtgtgtatgcatatatatacaaagagatacatgcagagacagagataaagagagagagaacagactctctttggctcacatgattgtggggactgttaagtccaaaatttgtagggcaggtgagcaggctggggatccagggaagagtagatgtctgattttgcagcttaaatctgaaggaattccatcttatttggggaccttagtgtttcccttttaaggccttcaactgattggaagaagcccactcatgttgtagagaataatcagctttactcaacatctactgatttatgtgtttatttcacctaaaacatacctccacagagatatttagactgatgtttgaccaaacattgtggtagcatagcttagtaaaactgacgcataaaattagctatcaccatacccctttattaccttaaagattattaagtaccctaaagagatttggttaggggcttatatctattgatgcttattgtattataaattaaaacttagaaatcttaaagatatttattaatttaaataactatagaaagttcattgcatgttaactaaacattttaatgcaaaatcaatataatgcctaaaacaaaaaaattaatgaaaagtgtgacattattttatacttctgtaaaaatctttgtggcacctggctcaataaattgccagtagaggaaaatttttctgttcttgtcaaccttagcagaaatttatttattttattactcttcaaagaaccattttggtctttgttgatcttccattctattattctatcatatatatagtatacgctttctaacctcaaaatatatgcacagcacaatgattttaagtctgttctcttttcattataaccagttaaaattaaattcccttcaaaatactgatttgacttcatgtcagagttttgatgtgttgccattcagttctattttaaaacatttcttctcttatgtatgttatttaaaactgttttaaaatttgcacaaatatactttatcagcatatttgtatactgatcgatgagtgatattgatctttatttcataagcttgttggccacatgtatgtcttcttttggaaagagtctgttcttgttatttgcccattttaatggagttgtttgttttttgcttgtaaatttgtttattttccttacagatgctggatattagaactttgtcaaacacatagtttgtaaatattttgtcctattctgtagtgtattagcctattctcacactgctgataaagaaatacccgagactaggtattttataaaggaaagaggtttaatgactcacagttccacatggctggggaggcctcataatcacggcagaaggtgaatgagaatcaaagtcacgtcttacatggtggaggccaagagggcatgtgcaggggaactccccccacctcttttttttttttaattatactttaatttctgggatacatgtgcagaatgtgcaggtttattacataggtatacatgtgccatggtggtttgctgcacccatcaacccatcatctacattaggtatttcttctaatgctatccctcccctagtcccccacccctcagcaggccccagtgtgtgatcttcccctccctgcgtccatgtgttctcattgttcacctcccacttatgagtgagaacatgcggtgtttggttttctgttcctgttttagtgtgctgagaatgatggtttccagcttcatccttgtccttgcaaaggacatgaactcatactttttatggctgcatagtattccatggtgtatatgtgccacattttctttatctagtctctcattgactggtatttgggttggttccaagtctttgctattgtgaatagtgctgcaataaacatacatgtgcatgtatctttatagtaaaatgatttataatcctttgggtatatgcccagtaacgggattgctgagtcaaatggtatttctggttctgaggaatcgccacactgtctttcacaatggttgaactaatttacacacccatcaacagtgtaaaagccttcctatttcttcacatcctctccagcatctgttgtttcctgactttttaatgatccccattctaactggcatgagatggtatctcatagtggtttagatttgcatttctctaatgaccagtgatgacgagctttttttcatgtttgttggctgcataaatatcttcttttgagaaatgtctgttcatattcttcacctactttttgatggggttgttttgttttcttgtaaatttaagttccttgtagattctggatattaatcctttgtcagatggatagattgcaaaaattttctcccattctgtaggttgcctgttcactctgatgatagtttcttttgttgtgcagaagctctttagtttaattagatcctattagtctattttggcttttgttgccattgcttttggtgttttagtcatgaagtctttgcccatgcctgtgtcctggatggtattgcctaggttttcttctagggtttttatggttttaggttttacgtttaagtctttaatccatcatgagttaatttttgtataaggtgtaaggaagggatccagtttcacttctctgcatatggctagccagttttcccaacatcatttattaaatagggaattctttccccattgcctgtttttctcaggtttgtcaaagatcagatggttgtagacgtgtggcattatttctgaggcctctgttctgttccattggtctgtatatctgttttgataacagtaccatgctctttgggttactgtagccttgtagtatattttgaagtcaggtagtgtgatgcctccagctttgaaattccctttataaaaccttcagatcttgtgagacattcactatcttgagaacagcacaagaaaaacctgcaaccatgatttaattacttcccacctgctccccccatgacacatggggattatcacaattcaatgtgagatttgggtggacacacagccaaaccatatcatataggttgtctgattactctgctgacagtttcttttgctgttgagaagctcttaagtttaattaggtcacacttgtcaatttttgtttttgttacaattgcttttggcatttttgtcacgaaatctgtgctaaatcctacatccagagtgatatttcctaggttatcttccagggtgtttagaattttatgtttcacatttaagcctttaatccaccttgagtttatttttgtatgtggtataagggaggggtccagtgtcaatcttttgcatctggctagcacattttattgaatagggaatactttccccattgcttgtttttgttaggattgttgaaaatcaagttgaacatgtgtggcattatttctgggctccctattctgttccattggtctgtgtgtctgtttttgcaccagtaccatgctgttttggttactgtagtctagtagtacagtttagtcaagtaatgtgatgcctccagctttgctattttttcttaagattgccttagctatttgggctctttttttggttctataggaattttaaaatattttctaattctgtgaagaatatcattggtactttgatagaaatagcattgaatctataaactgctttgggcagtatggccattttaataatattgattcttcctatccatgagcatggaagatttttccagttgtctgtgtcacctctgatttctttgagcagtgttttgtagttcttgttgtagagacgtttcatttcctgggttggctgtattcctaggtattttattctttttgtggcaattgtgaatgtgactgtattcgtgatttcactctcagcttagatgttgttggtatatagaaatgctagtgatttttgtacatcgattttgtatcctgagactttgctgaagttgtttgtcagatcagggaacttttgggccaagattatggggttttcaagatatagaaatacatcatctggaaacagggatagtttgacttcctctcttcttatatggatgccttttctttctttttctttcctgattgctatggctggaactttgaatattttgtagagtagggatggtgaagaaggcatacttgactggtgctggttttcaaagggaagacttccagcttttgcccattcagtatgatgttggttgtgggtttgtcatagatggctcttattattttgaagtgtgttcttttgatgcctaatttattgagggttgttaatgtgaagatgtattttatcaaaagacttttctgcatctattgagataatcatctggtttttctttttagttctgtttatgtgatgaatcatatttattgatttgtgtatgttcaaccgagcttacatcccagggataaagcctacttggtcatgatggattagttttttgatgtgctgctggaattgattggcaattattttgttgaggttttttgtatcagtgttcatcaaagatattggcctgaaattttattttttgttgtatctctgacatgtttttgtgtcaggaaaatagtggcctcataaaatgagttgagaaggaatctctcctcctcaattttttggaacagtttcagtaagagtgataggagctcttcattgtatacatatggtagaatttggctatgaatctatctggtcctgggtttttttctggttgataggctgatatggtttggctgtgtcctcatccaaatctcatcttgaattatagctcccataatttccatgtgttgtgggagggacctggtgggaggtaattgaattaaggcaggacttgcctgtgctgttcttttgttagtgaataagtctcatgagatctgatggttttataaaggggagtttccctgcacaaattctctcttgtctcctgccatgtaagacatgccttttaccttccaccatgactgtgaggcctccccagccatgtggaactgtgagtctattaaatctctttttctttataaatacccagtctcaagtatgtctttatcagcagcatgaaaatggactaatacatagactttttattactgattcagttttgtaactcattttttttgtctgtgcagggattcattttttttcctgggttcagtcttgggagggtgtatgtgtccaggaatttttccatttttttctagattttttagtttgtgcatagaagtattcgtaatagtctctgatggttatttgtatttctgtgggttcagtggtaatgtcaggatcagtgtaatgccctttgtaatttctaattgtttttatttggatcttctttcttctttatcattctagctagcagtctctcttatttactttttcaaataaccattgattatttggattaattaatcttttgagtgatttttcatatctcaatgtccttagttcatctctgattttggttatttcttttgtgagttttggggtcagtttaatcttggttttgtatcttattaagttttttaaattaccattgattatttggattcattgatttttttcagtggttttttcatatctcaatctccttagttcatctctgattttgcttatttcttctgttagtttttgggttcagtttactcttggttctctagtccatttagttgtgatgttaggttgataaattgagatctttctaactttttgatgtgggcatttagtgctataaattttcctgttaacactgccttagctgtgtcccagaaattttggtatgttgtgtcttggttctcattagtttcaaataacttcttacttcttgatttctgctttaatttcattatttactcaaaagccattcaagtgcagctattcaatttccatgtaattgtatgtttttcagtgattatttcagtcttgatatgtaattttattgtgctgtgatgcaagagagtagttgatatgattatagttctcttgcatttgctgaggattgttctgtgtctcattatgtggtagagtttagagtatgtgcatgtggcaatgagaagagtgtatattctatttgttttgggaggggagagttctgtagatatctatcaggtccttttgatccagtgctcagttcaggtcctgaatatttttgttaattttctgactcaatgatctaatactgtcagtagggtgttgcagtctccactattattttgtaggagtctaagtctctttgaaggtctttaagaacttgctttatgactctggttgcttctgtgttgaatgcatatatatttagaatagttaggtcttctcatcgaattgaaatctttgccagtatgtaatgctccccttttttcgtctctatctgtttaaagtctattttgtctaaaattaggatagtaacccctgcttttctctgttttccatatgcttggtagatttttctccatccttttatttttgagcctctgagtgttactgcatatgaaacaggtctcttgaagacagcataccaatgaatcttggttctttatccaatttgccactctgtgccttttaattagggcatttagcccatttacatttaaagttattgttgatatgtgtgaatgtgatcctgtcatcatgatgttagcttgttatgcaagcttgtttgtgcggttgctttatagtgtcactggtctgtatactggcaggttaggatgcatgcacacacacgttggcatgggggaaggtaaaacccacccacgtacacacatgttggcaatgtgatatatgtggtggctctgggcctggaggaagctgcagtgggggtagggaataggcaggctggtgtgtggccatgggggctgccccattggacctctctgccagtcaggcacagttcaccactgcaggagctattatgtgggctcccagagcacctgcttgttctacaagcaggcatggccaggctggggccctggaagaggccagcagaccaaggggtgctcaagtcagactagccccatctgatgggcaagaccaccatgcagagttcaagtctgagagtttccctagggataatgtctcctgtggtagcatgtcgagcctacagggatggacatctcttgtcatactctgccacgagtgcttaggcaccaaatccttttggctctgcatcagctggcatgctgcccctaccaattctctaagcagctctttgttccaactcaagtatccgtcatagtttaggggtctcctcctgccaagattccagaggcctgtggcaagagtaggttgatccttgtcagttcaattcacccattcctttggagttgttggagggtaggaattagtcccctgcctggtagcctcctgtagggttcccagcttcctcccacttgagcacagcttttgtatcttccctccatccactctcacaggcttccctctgaagctctgtcaggagtgtgccaattttcttggtcccttggtggcagttgttccacctggttgtgtcaagttggccatcttctacttaatcaggtcttcttgttgaattgaaactattgccattatatagtgctcttctttagcttatttggtctttgttggtttaaagtctgttttgtctaaaactaggattgcaacccctgcatttttgtgtttgttgttgttgttgttgtggtggtggtttacttggttgatttttccccattcctttattttgagcctatggatgtcattgtatgtgagatgggtctcttgaagacagcatactattgggtcttccttctttgttcagcttgccattctgtgtattttaattgggggattaagctgtttacattcaaggttactattcatatgtacgaatttgatcctgtcatcatattgttagctggttattatgcagacttgtctgtgtggttgctttatagtgtcactggtttgtgtacttaagtgtatttttgtagtggctgataatgatctttctttttcacatttagcactcctttcaggaccacttgtaaggcagttctggtggtaatgaattcattcagcatttgcttgtttgaaaatgatcttatttctccttcacttatgaagcttggttgggctggatatgaaattcttgtttcaaatattattttaagaatcctgaatataagcactcaatgtcttctggcttgaagagtttctgctgaaaagtccagcctgatgggattccttttgtatgtgacctgtctcttctctctaattgccttttacattttttcattcatttggaccttggagaatctgatgattatgtgtcttggagatggtcttcatgtataatatctcacaggagttatatgcatttcatggatttgaatgttggtctctctagcaatgttagaaagttttcatgtacaatatcctgatatatgttttccaagttgcttactttccccctgtctctttcagggacaccaatgagtcatagttttcatctatttacataatcctatatcttttggagattttgctccttccttttaaattcttttttctttatttttgtctgactgagttatttcagagagccagaatttgagctcttagattctatcctcagtttcttctatcctgctgtttatacttgtgatttaattatgcaattcttgtagtatgtttcttatctctattagatgagtttggttccttttttataatggctattttgactatcagctcctgtatcattttactgtgattcttagcttccttggattgggttttgctgtttccctgtatcttgatgatccttgttcctgttcatattctgaattctatttctctcatttcagatatttcagcctggttaagaactcttgctggggaaatagtatgattatttagaggaaagaaggtactctggcttttcaagttgtcagagttctttcactggctttttctaatttgtgtgggctgatgttccttcagtctttaaagtttctgtcctttcaattgatttttttgtttttttcttcattgatgcccttggggattttattatgttataattgagtttggttgactggctttgattctagtacactactgggtcttggtggcaccctctatgattactgtctgcatgcccgcatttcttctgttgggctttctgatctattgagtttcctcaggcaagggctgcggttgacagacaagctgtattcttgccaggttggccttaatttgatgtccatgtgctccctggggaaacatggggttgcacttgcctgcagagttcaggcagaagtgggacctctgggttggaagctctagcaggtgtggtccatctggctatgggaggcaggggtgagtggagttgcctaccctgacctcctggtgtttccagggcaacaggagcctgcctgcacccctcagcaaattcagggaaaactaggactgttgggccagcagccctatcagatgtggctcacctgtccaccagtggcaggggttggtggggatgcttgtcctgctttctgggagcttcctaggacaataggagtctacccactggttgagttcccacagaagtggaactgctgggccaaaagctccagcaggcattgcctacctggctgccagtggcagtgtcaggcagcgtcgtgtgccctgctgtctgggtgtttcctgggacaacagaaagctgccccctctagatcagtccaaacagaagccagactgctgggccagaagccccagcaagtgttgcctgccttgcagggtcagtgggatcacatgccttactgtccaggtgtttcctgggacaacaggaggcttgtgctcctcagctgagttccctctgaagcaggaccactgagccagaaactctatcatgtgtcgcttgcctggctatgagtagcagggatggatggggttgtctgccctaccagctgggtgttttcagggcagcaagaggctgtgccctccagctgagttcaacaaaagtaggactgctgggcgggaagctctagcacacattgatcacctggcaaccagtgatgagggcaggtgaggtcacatggtgctgtgctctctgggtgtttcccagggcaacaggaagctgcaccttccagctgagctcacatagaggtgggatgactgggctggaggctctagcagttgttgcccacctggctgtccatggcaaaagtgggtggggtcatgtgcagcctcctgccacctgagtgtttcccgggacatcaggaggctgtatcctgcagctgaatttacacagaagtggaacaactgggctggaagctctagtaagcattgcctgcctgcctagcagtggtgggggtgggtggagtggcaggccaaattcaggctgaagtgggactgatgggctagaagctggtgctgagccccatctggcaagggggtgggtggagcaatcttactgctcccaggcactgcaactatgcctttattcaggtgatggcactggtgctggtctgctctggggttaaaggcttgtagtccccttggacttgatagttgcccctgcaaaatgtctggatggctctctccctcagtttggaagcacagctgggggccaggcagattttcctactcccagtcttgtacaggtctctgcagagagcatgaatctcctggggagctctcactctctcaccctttcccatttttgtagaggttcttctgcgccacattgatcccagacagatagctttgctcctctctgttctctgtgttctcctgctgccttcatggatcccagcatggtttctcagatgattggcctgcagggtcagtgttgactagccttttagttcctctctgtgagagcagcacatacaagctgcttctcgtctgccatcttggccctatccctcatctttattttcatttcctttggcctaggtaactttttttggtactttttcattttgctttgctttgctttgctttgtttactctcaatctttgtatctccttagaagtttagtgtgcctcgtgtaaaaatcatatagctgaatttgtttctttttagccaaactgaaaaatctttgtcttttatgtcttttagcttccactttagtctatttgtgtttgttggatttgttcatatgtttgtatttctatctaaaaacttatttttaaaattcattttctatttgtatcatttattctagtgcttttttcctcctttcctattttcttttagatatattagatgtttataattgtaagtttttcttacccatttctttttttcttatactggtttggaagtcatatgctctattactattcttatagtgctcactcttaacattttaccatgctgactgaatttagtaaagcctaaattgatcaaggttttacttctcttcttaatagcacatgaactttattaatactatatcattattgtttttttttatttttacaagcatttttgttttatttttgcaagcattttatttatctacacaaatatttctatatacttacatgtttaccaaattgtttgctcactatttcttccctttcagatcttctgtccctaaaatatatccttagtaatttctgtaggagaggactgctttgtttagttggaacattaatacttgttcttgtttcttttcttccttttttttttttttgaggtggagtcttgctgtgttgcctaggctggagtgcagtgtcacaatcttggctcactgcaacctctgcctcctgggttcaggcaattctcctgcctcagccttccaagtagctggggctacatgtgtccactaccctatccggctaatttttgtatttttagtagggatatggtttcaccatgttggccaggctggtctcgaactcctgacctcaagtaatctgtctgccttggcctccgaaggttctggaattacagacatgggcctctatgcccagccttgttcttgttttgagagagatttttgataattccagagtaacattattttctattagctctttgaagaaatttcacccctgtgacttattttctctgtgatgttgtttaagtgttttagagataatgtagtcatcttatgagtcatagtgaagatcaaatatatataaagagcttattagtgtttctaacacatatttatcactatataaataaataaccttatttttcttttttccctcctttttttcttataattcttattattgccaatgctgctcagcaattcactaaaatgcatctaagtaaaaatttctttttattgacaccactgtttatcctgtttggtatacatttttctttccaaacatgtggttctaggtcttaaattttctagtttctgtacattctcaacccttaattctttgaatgttacatctatcttttatttccattctcttctggaattttgattaggaaaatatacttttttattgtatcctttataattttaaccacctatactgtgttcagttcctcatctgtctatagttgggataattttttcaaatatgtactttatttatttttattttttatttccataggtttttgcggaacaggtggtgtttggttacatgagtaagttctttagtggtgatttctgagattttggtgcacccatcacccaagcagtatgcactttacccaatctgtagtcttttacccctcgccccacttccattccaccctttcctccaagtccccaaagtccattgtatcattcttatgcctttgcagcctcgtagcttaactcccacctgtgagtgagaacatatcatgtttttcattttttttccggatttatttcccaattcatttactctgaattttgctgtttctcatatgctatttaacccatccattgatttcttaatttcaataattttatttttaaaatttctaaatatatatttttttcagatttgcagattcatgttataaccttacgtcgtttgatctttttattgtagctgttatttccttatatactttacttatagttatattttgtaccctttaattataacaactagtgtccttcagggtatttgttaattttattagctcatcctcagtcatggcttcttatttcccattatgtgtttgagaataattttgtaagctcatacttggttgaattttatttgcagaattttgagtagctaatttctaataacttgggctgtataccaacagcgtggatctacattattagtcagctcagtctgccataacaaaataacagagactgggtagctcaaataacagaaattaatttctcacactcctggagcctagaagtctaagaccagagtgccagcctgatcaggttctggtgagggcccccttcttgccttgtaaatggctgccttcttgctgtgtcctcacaatgcagggagcgagttaactccagtctctttctctgattataaaggcactaatcgtattacagggttcccgtgctcatgaccttgtctaaacctagttatttctcagaggccctacctccgaatactgccacattggaattagggcatcaatgtacggatctgggaaaggagtggcacagtcagtcagtccataacattcacttgtgctctttttgagagctttggttccttctatttgtgtggagcccagggaaactctgatcttttgcatctcttaaaacacacttttttgattttagtgtaccattctttttctctctcttgatttctctcagccctcagaaatggcctttattttttcatgaaccaaagttatacagttttccatatttcaggccatgtttttgaaaggcaaaaccatttcaaaagaatgttcagaaatttatatttgatatattttggatttagtatatgagctctgactctatatattaaaaacttatgggaatattgtttatatttattgttgactaaatatcagttacagcactcacaaagaaataatactgcttcattctagttgtaattattccagtgtgatttgttttttttgcctggcacatggtttaaaacacaaaataagcatataaaacttatatgagagggtttttcagccacaggcagaaacataccacaataatttttatcctatgctaagattttggtccataataacatgatacccattggaaagatagatttgagaaagaagcatgcttaaataatttttaaatttttttacatgcatgtttttggataagtgtattgttcaatctttaatattaaaaactaaaattctgaatgacaaacatatgtgcaaaccaactattgtggcaaaaacagtttttgttggtgaagggactagctgccatttggtgatttttcagatagtcaaatttgaaaaatcaattggatcttctcttctcttctcttttctctttttgagatggagtcgcagtcccccaggctggagtgcagtggcatgatctcggctcactgcaacctctgccttccgggttcaagtgatttcctgcctcagcctcccgagtagctgggattacaggcacacgccaccatgcctggctaattttttttttttttgtatttttagtagagacggggtttcaccatgttagccaggatggtctctatctcctgacctcatgatctgcccccctcgacctcccaaagtgctgggattacaggtgtgagccatcacacctggccccttggatattcttttctaactcaaatgagaatatcctcattatataatccaccttctctccagaaacttcaagctctttctctctaatggtggctgtttctacgctgcagatagaaattacatttccctcttagctgaaaaatacccaagcctatgagcaagaaaacaaaatattttttgattctactattccctctgtcagagatgccagaaactttttcttcttcatttatagcataatttcattcatgcttgcatgcatttctatatttacttactctaaagcatttactaagcactttaattggtcagtcatgaggcttggtgccgtagaaacagagatgaaatgcaattctccatcataaaacagtctggcagggaggaggaggataaataagtggtatattacaattcggtgagagaaagtacctaagagaacacatttaaaaagcatgcaatgcagaaggatgtgtagaagatgatggaagtaaaattttcttgcagctgatgttacacacacacacacacacacacacacacacacacacacaaaaccaactagatgtttctgttggtgtcattgacacctacccatttcttttcttttctttttttttttttttttttttttttttttttaagactgagtcttactctgttgcccaggctgcagtgcagtggtgcgatctgggctcactgaaacctctgtccccggggttcaagcaactctcctgcctcagcctctcgagtagctgggattacaggcgcacgccaccatgcccggctagtttttgtatttttagtagagacggggtttcaccttgttggccaggtttttctacaactcctgacctcaggcgattcgcctgcctcggccacccaaagtgctgggattacaggtgtgagccaccgtgcccgagcctgacgcctacccatttcttaaactagcttttgtgtccaccacttggaagccactgctttaagatctactgattaccgaaatgcaaaattgaatgagtcatgctcaaccacccagcacttaaacatctctttgatctctcatgatctaactcaaaggtatctcattcctgattcacttcttccttcatccaaactgcactcctgaagcatttaattaatctaaacataagcaatgctgacttactgtttcatattgtattatgtttttgaaactgatttagcccatgtctgaatctttattgttctgaagcccgatcatccagagcctaatatatacaacgctgaaccaaacaaacacatgataacaaaaacactaatttagtgaattaatctagaagaatctagcagaattaatctagaaactgcacagcagcagtttctctcttcagcttgaattactaagcaattcaagttagcaattgtgtagacccaaataagataataatatttagtcatttagatatgccactacaagtaaaaataaatcagatacatacacatacacacaaattactcatagaatgcagtattcataaaaattatgttactttttaaacaagctgtctttttatgtttttgcaaatagtggcgacaaattggctacttcaagtggtgacactacagttaaattatgggatctatgtaaaggcgattgcattttgacctttgaaggacacagccgcgcagtgtggtcctgcacatggcactcctgcggcaattttgtggcttcctcctcactggataaaactagcaaaatttgggatgttaataggtaagaagtactttaaacattactaatcctctgtgctgatacatatacgtgggtaaagtggtaaagttcttttttttttttccttgatgctaccccagggaaacattaaaagaaactgttagttgataagattatagagagctacttaaataatctttgtgaaatccatttctaactccattaatctttgttgattaataatttctttctaaatgtaagtatcaagatcaagcctatgtaataagattagaattgcttcattggaaagctgtttgtttcaagcaggatagaaacaaatacttcttttaaagagttggatttttagttccgctttccacaggcttgttattgctctgtactattaaatgtaatagttcaacgaacgtaaatataacagaaataattattttctttatgcttaatttgttatgtcgtgatattcttgattaaatgtttcttgtcgattcacaaattgtaggaaatagtatactgtattgtatgtaaaatcctatacatatcatgtggatttggaagttttatgttttgattttaattcaaggtagacaaattcattatgtttcaaatattgaaattactatcacccatatatttttggatgctcattaccttctgttaggtttgcagatatgatacaaagaggtaaatttagctactatcaaatatgctaattccttcagctaaggggttatatatcatccatcaaactttctcagtagtctgtggtcctagctctggaaggacctccatccaccagaggaacacccataacagcagagaagtgccctctcctcggaggactgaggttccgttttgaaggtcctcccttcaagggtctaagttttaatattctaccttattccctgtgttcgctcagtcctaggggtggtagctctttcttgaagttgttatctccatgatattttaatgttcttttcccttttttagttacttagttagcaactttattcagtttttaccatcctgcatgtgaaattattattgttacaatgataggtgcaagttccgtttcctgacaagtccttgaaagatccagggcattagtggataaggagcataacccacctgagttataaagctatagctaaataaaattagcctgccccataggagaaaacatgactgtgaataacatattttagacctatgtctatctgaaatagtgacaatttcagatagcttttaattctcagatgggtacttactatttatctggaatatccaatcatttataattctttattatatttctataatgtgtgactggatttcataaatatttttataatagattaatggaattttagcactagtatttaatttgaattttgtatcacttttgacttggttgaggatcgtaatagaaaacagtgatcttttctaaaatgtaatatgtctttagaactcttaactacccagggtgtttaaaagcaaactatggttaaaaaactcagtagtctcagccctacttggaatgatttcaaacactttgacttgacaacttttctttatgaccctggtatctaaatactgacttccaattggtgcccagtaaatcttgatattacagatcaaaattgcttctgattgatgccaaaattctttaaacttcaagtttcccatcactgtcaagagttcactttcatcatcaaggacaaaataaattgtactaattttggcattgaggtggtggataagtattgacaaataaagtagaaattgattgtttctatagtggctattgatatacctttcagagtcacaatcaaagtaccaagctctaatttataattactctcagatcaatacaatatagatatgtctaaaactagtgtctttcttcaaaatttcatagattacttgaactggcttagttacttaaggcaagagattatttgccttggtaagatggatggtgctggagctatgtatgctgtgtcatatattcttggcttgatactgcatatatatatatatatatatatatatatatatatatatatatatatatatatttgttgttgttgttgttgttgttgtttttaagactgaatcttgttctgtcacccaggctagagtgcagtggcacaatctcagctcactgctctgcaacctctgctttctgggttcaagcagttaacctgcctcagcctcccgagtagctgggactataggcacgtgccaccacacctggctaatttttgtatttttagtagagacggggtttcaccatgttggccaggctggtctcaagcttctaagtgtttgagaaactcccaaagtgctggggttacaggcgtgaaccactgcgcctggccatgctgcatagttcttaataaataccaaatttatattggtagacagtattagtcaccagagaaggaagagtttagaatacattcttctcttttcacacccgtcctttccttcaagcttctggctcagtcttgaacagccttgattggtgttctatctctagctctgcagctgtttctgaattgggcaatacttggtaagaccatccatttagttcctcaccaaaaagttggatcactgtgaagcatcaacaatatagaaaatttcagatcaagattcatatttactgagtgctaatcagaatctatgaacaattatctatgacactcagtctgaataattccatactctacaaggtttctgtgaataattaacagtagcttttttattatcttctgaatgatcaggtatataaattgttatgtatttcacttaatggttgtttgaaaacacacacacacacacacacacacacacacacacacacacaccagtgtaacccagagagtgcttggcacatggtggtttacttacataaatgaataaagagtgattcaacaagtaaatatggcaaaagtattctaaatattctccctgacccatccacatttaaactacaatataattatgctgtcttatcctacacaaatcaataaaatgatgaaaatggggtagaaaaatcagaaaatagctataaaaaataatttgtatttctttagaggcatttagaggcatttgtatataacattaagcagtaagtattcatgaaatgacttaacaatgttggtctgtgttatagatctaagacaattctcatactcaaccattgccttcaatgagattacaagtaatttaaaatgcagcaattttaaagcaataagggaatatgcaatgcatctaccatttatatttataatatcagatcaggtattctagttgactcctggctgcttttcttccaaggtagctgggtatttgactgagcagttatatcacactgttactctgatatttggaaggcagaccatgtgcctgcttagcttgtagctcgaaggagaaggggtcggaaacagccaaaatgttactgaatgttgctattccagctgttttaacaaggtgttacacagacaagaattgggtggtttgtaccaaggatagtaggaaacagagggacttgcaaaattcaacagcttcttgacccctaatgttgggagataaatctgtggcccttatttctaagtgtattgtgtccaatactcttgtaattacatgggaagaggaaaataaagaaggtttaagaactgtgtttactttaatttgtggttactgtggcattgcgttgcctggaagcaactatattagaaacctaccaagtttttgagagaattgtattgacaaggaaactatgagcctatccttaaatcccgttgactcttcaaacagtgaaacagtcctcagagccccaaacttgcatccaaaaaaagtggacttgtatttttgcacagttcagaaggaaggcagagaccatagcaccaatctcaatatggccacagaggataatgaacaagaaggaacctacagtggaactaagccagaagctacaaagaacaatggggaaaggtgctcctctgggggacagccatggtccaatcaaggaactttcttcagtaccacggcaaagttcctcatgatgcctgcctagtttttcactatttggactagtgatgcttatatgtttcccatgtttccgttttctgtattacagtttatactgcagttattctgtccttacttcacaattgtgcattgtgttcatggtggtgatggtggtgggaagcagaaaacttgtattttgttttgttggttaccataatgcaagtgacactgctgaaccaaatgatgcagattgtgtgtcagccacagatcatgaactgtgagacatgcagtaactgaagaagagatctggggatgtttctttttttggttgtggagagaagaaagtcagtgaatattctaagtgtggaagaaaggatgacagatatttggtgagaaaaaggccaaactgtggcagagactgttagcttttcactagaatccactttttcctccttccatattagttaggcacttggctatatatctaaatgatatttattagcctcaattagttaagtatgtctgcatcactaagttctatacaatagaatattagttaaagtagcaggtactatttcctcattcttgcccccttgtggtggaatggaataccagtgacaatgaccacaataatcttagaagcctattattgaaactgaaagaacaattgtcaagctgcttgaagtaaagccacccctgttttgtaacttcagttaggctgcaacattctctggactctccagcaataagaaaatacacttccaggcctggtgcggtggctcatgcctgtaatcccagcagtttgggaggctgaggcaggccgatcacgaggtcaggagatcgagaccatcctggctaacacggtgaaaccctgtctctactgaaaatacaaaaaattacctgggcgtggtggcaggtgcctgtagtcccagctacttgggaggctgaggcagaaggatggcatgaacccagtgggcggagcttgcagtgagccgagatagcgccactgcactccagcctgggcaacagagtgagactccatctcaaaaaaaaaaaaaaaaaaaagacacttctatttggtttgagacattatatttccagtatatttgttacagtatttttgcttgcctagtctactataggcacccatgaatacttttcaggtgatatgtttttccctcatgacatattattaaggcaaccaagacaagctctgaagtgttctcaaattatttgaaggagtagtaatggaaattttctgctgataatagatggctagtctactccctcttttttcttcccttgccccttctttcttcccatctttattgtctatcgcaatgctgttggagtccatgaaatcctgcttgccaatagcaacatatgcaagttagtttgcatggaggtaatgcttgtaagactagttataaattataaaaacatgcaactgttgtaagtgtctccattagtaggacactgtttcaataatgaggatttcactgaaataatgaaaaacgccaaggatttaaattttatgttagcattgaccacatttactgataggaatgagttttgctcattgtagttaagctgatggaataaaaacagtaccttccacatggttgacctcacaggtttatttatttgcttatagatccaacaaatatgcattgagcacttacttcgttctatgccttattctagttactaagctataatagtgaaaaacttctgcccttatgtcattggcattctttcaggaggcagaaaataagccaaatgaaaaatgataataattaataattacatataatatttagagatgacaaattttgtagaggaaaactagagcacaggtgaaaagggatagcaggcattggaaagggttgcaattttaaacaggaaggtcgagaaaattcttgttataaagttgacatttggataacctgaataaggtgaatcagcaagccaagcagatacttgggaggagaatattccaagctcttctgatcaggaagctttcctatggtggtagcatgacccatgtgactgctaagcagcaaagaggccagcatgactggaataaagtgagcagatgagagaatggtaggggtaaggtagttaaatgagtatgtacatataatagagggccttataacccctgtcaattactttgacctttattctcaatgaaatgggaaaccattagtgggttttgagcagaagagtctcaatctgttttacactctaataagatgactctggctactgttttgagattagatggtggcagaggtggggtgaaagcttaaaagcaggtaaaagcagaaagaccaattggggaactattgtagcaatccaggccaaagatgtagaaggtttcagccatgagaatagtgaaagtcataaaaattgtattctggatagatttgaaagataaagacaacaggagtttctgaagtactgtgaattgtgagagaaagaggaaacaaatgacctgttacattttcatacacctgaaaggcaaaggctcattctccttatactgggacactaatataaacattataaaaggcttttccaaccaggtgtatcagctggtgatccagaagccatgacagaatgaggaatgccttctcattgttcatctaacatttccattaaagaaaatggaatgtttcccttctgcccacttcctagcatcacttcctttttattttaataattctgtagccaatcataacccctgtgctggatgagatgacagaaacagaagtctatttgtaaagaaaacagataaattaagaaagaggaaatatgaaatgttaagattgttatgatgaattaccttctgttaatgatatatactattattttgaaggggaaggcaaataatgcatgaaagtggactctaaaataaaagaaattttcttattacaaaaccaataatgataagatagcaccaaactagtaatacaatggagtttagtatttataacacaaaatgttccgttaatatattttatgttctttatgtttcatttgcaaagttggctatgctagcaaaggaggatatattgtataatattaatgggtttaaaacacgataatgtaagaagaagtattaagactcaagggcatggattattggtacattaatacctgtcttatattgccaagatccccactttgccttcttatacttgaaagggcacccaaggtatatattaatagactgccaaagtaatgcttaaaatataattatgttacagtataagaaatggtaagatacttaaattgacctcttgtgatcaatttctcctgttacaccaggataattaattattatatcttcttggattttcaagtacattcaaatgaattgtttccccttgacatatgggcttgaaatgatgtctgagtattacggagcatagacacataaataagcacaaaaaagtgaagaaaacagaatatagcatgtatttttttattttcctttcccccccaaaagtgcataattaataagcactattcaagaaatatctaccttatgaagaaaattgtattaaagccaaagttcagatttcatttagcaagttctgtcatgtttgaaaaattgagaatctctcacacattcaatatggctttgtatgtgtgaagaatggctcaagtaagtgtccactgcaataaacttgatgtgaacgttctttgataccaatatacatggatcaataataaaaaaggtaaatgtccttaggattttaaaattcatccctattcctttccacagcaaatgctattacatatcaatgaattgtataatttggatctgacatgctgtataatgtacactttctgtttgttatctcatacaccaaaaaagctatttattagaaataattagaatgagtataaatgaaactaaagatattctgataaaagcgaatatatatatatatattttataacatgatacatttctgctttattactgccaatcaaagcaagaactttaccatgttaaatatgcaacaccttttctccaactctgcacaaaataatctggtcaatgcataagtcttagtcctcctcaatgctgatgactaaaagggtttagtatatttctacactaatgtatggtaaaataaaatgatatgtagccatagtccatctgaggtaaaaaatgaaaatcacgtttgttttatatttaagatttacttgtacatgtatgtgtgtgtgtgtattctcacacatttatgtatatatacttatttgtattgatgaagtgagtttattcagctcaaaattaattttagagtggcaaaaactgtaattatttgactatcttaaatattttaaatttcaatcaaaatatttatttatgtgttatctatgactccaaaaccaagcttgttttaaaaccatttatttcagacaacaaccactattattatatccctaaaacattgtttttggaattattaaaataattttaatttaaataaaaatttaagatttgattcaattactgtggaaacaaatcaaatgtccaaggacatcaaatcaaaataaaagaagtaaactggttactaaatataaaaaatggcaagcaatacaattttggcagcattaaactaaatattttcttattgttaaacttactgttatatggaaaatcatttctatttagataataaagatgaggtttttttttctcttaaaggactaggaaatataattttgatagaaaatttaagtaatgtttcctcccattgtctgacatgagtttatgcaaaatcctaacacttaacaaagagagcagaacttgttaacttgtgttctgggtaaaaagaccataccatcttcagtcaaggaaccatggaataatctttggtctccacacaatctagaatgagccatgagggaagaaatacctccagcagaattccaccttctagaaaaatatcccttcctgattttttccatacttttatccttcactagatttgacaactaattactaaaaatcactactacttagaaactgattatttatttatctaatatttaccaactatgtaccaagtaatatagctggagctggggatatagcactgaatggaatggtccagacccttgcccttgtggagcttacattacagaaaaaagtgtcactggttacctgtgccttataaatcattagacaagctccctgacttggtcattgatcaaaagattaattcctttctgctagagatgacaagggggtatcactgagagtgactgtctttctcagatgtcatgtgtgaatcctagttctctattaacggaaagaattaaaaaccttcagagtaataagccaccaatgaggtgaaccttaaaaatggtgccaagccttcttatctttacaaagatgatttttgttttcacttgcattaggattcttttcaggtacctgtcacacataaaccacccaattaagatcatttgaagcggttttcacatgaaaagaaaactttcctgtgatggttctatttcagtttattttggggttattgtgtcagtttgctttttgttttaagtaaggaagaaaatagtgaattttagaaaagtatacattagcaagaatcaatataaaatgctattcaagcaataacaaatagagataatatacaaagatgtgctgtatctcaacctgtttatgttcaaaatttttatctctgggtagtaaaaattatgtcttatatatgcagacaaattcagagggatccaaaaatagtgttttcttctttaatgttgaagatgtagagtgacatagttgtttttcatatttcgtttcaatacatgtcctagtaaaatttcttatctacaaattcaaggcatacacctactgttgaaaatttatggtaattacataaatatgcatttgaaaaggtacaaaattttaaactagaaacacaaaacatataattatataacagccataactaccattaaaaaagtgagcatttaactttttaaaattagctgtgctaaaatatctgacaagtttatgaaaacctgatggttccaattttagaggtgacatataatttatttcattgcatatttttctagctattttgtgaaaatgtttaaaaagtttttttagagatgacatcttgctgtgttgcctgggctggagtggtacaatcatagctcactgtagcctggaactcttggtctcaagcaatcctcctgcctcagcctcctgagtagctgagagtacaggcaggcacaactacatctggataattatatatttatttttattttttaggaatagcgttctccttatgttgcccaagctggtgtccaatcactggccccaattgatcctcctgccttattctctagagtagagagaattacaggtatgagccacctgcttctggccacaaatcaaatgcactttttagaaaatattaatgccagtatctccagaataaattaacttcactactttacatacataaattaatatagcatatgtctatgcaaaactataatcataaattatgtatctgcaccccaataatactacctatgttcctaatctttatgaattgtaaatctcttatacaaataacattttagttaacaaacacacataaattgtatatgcaataacttcttacccctaactcttatttcctcctaacttatttataaacaggctacattatgtttgacttgaggctttcagtgatatcgctaacaacaaattatctcttcattacctgagttataatgattctcattatctatgttcatattcttacaaaccactgaggaaccaatccctaaattgaaaatgattgttcaccttctcttgaggccattgggattaatctcattaaattaacagccttatttatgtgggtcaccgcaaaatgccatcccttatattctagatattgttcatatatccaccagtcagactctatctctcacttacctctgatgtccttccactgtatggtttggaattaaatacctgtcatcaacaaaatattctatgtcttcaatcccttcaaggtacaatttatcttcttgcttatactggctatccatcccctgagaatatcaatttccttttctaattgagcctgtaactccttctttttaatccttctctggagatttataacttgtaatgaatgttaagcatgtagacgctatcactgaggtacataaatataatttattttagaattttgcatacatatatattaattgacacacacacaaacacacacatacgcatacatagagagagagagagattgttcttgggatcgtgacataaatttcccctaccgctggatctgcaggtttattcactaatgggtttccagtaggcaaaacaatgagcttggaacatactgggaaagtagtaaacatttgttgaattaatatcttaactaataacttatgttccctcctactcttcacttacttctagaccactttacttcctctctcctcccacaaaattacaacttcttataagtacatgctttgtgactataccattagcttcccttccattttattcatatactggcctcttcatcactctcatcatattttgaataacatagcacttgacttgctgtcatccttgtttgcaatgtggatattgaatccaagcagaaagtccagccaacaccctagcctcacagctccttcctcccttggtcccaacaactttcaagtcttaattgtaggttttctactctgtgagcaccatttcttatctctccagcttgtatattctaatcactcactgcaacaattctttgatgccagtggtattaataattaattgtttacaccattttttttgcccttgataatagccttcctcttcttttcttcttcccctgagtagatgccaaggtcttcctcacagagtttcaatttcttgcccctctcttcttccacatttcttgcctgtcaaaaccccaactctggttaaacctaattctctgcctgctttgcctacatctgttcagctgagcatagctatggaaaaaaatcagaatcaggctgacctgtttcatttcatgtttataacctcaactcacaagttgaattcaactgaattttctctatcaattaacttactacaatgtgagatgagtatttcacaccttcctcctccatattcaaatccctaacactctccccactcactttttctctgagtgacaacatggattttcatttcactgagcaaatagaagaaatcagaagaacatttttattcttccaccaccaaatccatcaatgatttatatttcccttttctctggatgttgcctcggtatttcttctgtattgacttacctggagctgggtagtctggaatagtcattcacgtgtttgaagcttcagttgggacagctggggaaagtttctctgtgatatcttattttccacatagtggcagaaatggtccagcagcaagaaaaagcaagctccaatgaacaagaactcatttaaacctttacttactattatatcattgaccaaagcaagtcacatggccaatattagagttcatgtgggaggggaatactcaaaagtgtgcatataggaaaagaaataatggcgactgctatgaactaagtgcttgtgtccctccaaaactcatatgttaaagcctaaatctcccatgtgatgatatttgaaggtgaggcctttgggaattaattaggtcatgaaggtagagccctcgtgaatgagattagtgcccttatataggaagggacaagagaccttactttctttgttgtccaccatgtgaaaatacaatgagaagatggccatctgcaaaccagaaagtgggctttcaccaggcactggatcttctggccacctcatcttagatttcccggcctccagaactgtgagaaataaatgttcattatttaaatcaccccgtctgtggtatttttgttgtaacagcccaaactgactaagatagaaattggtacttagaagtggagtgctactatttcaaatacctgaaaatgtggaagtgtctttggaagtaggtaatgggtagagtctggaaagattttgaggtgcatgctaaaagaatataatactgctatgaggggacttttaaatgtgaatctggtaagagctcagaaagtaaagaagagagctagaaaggtctctttcttattagagaatatataagtgatcatgtaatgtcagcagaaatatggacaataaaggccgttctcatgtgatctcagacaaaaattgggaaacatgttattggacaatggagaaaaggcactccttgttatacagtggcaaggaacctgggtgaattgtattcatgttctagtattttatggaaggtagaatttgcaagcaatacatgtggatatttagctaaaaaaaatttctgtgtatagttttaaaggatcagcttggttcctcctgactgcttatagtaaagtgtgatgagcaaaaggaattgaagagaaagaaggaatcattaagcaaaaaggaaccaaaacttagagatttggaaaattcttagcctatccatgttgcaggggaacacaaggggtgtggccaggctaccatttgataagaagattagtatgagtgtgatccaagaacctaatcagacatctcaacagaagccagttatagagacggaaatacaccacagaaatactggcaccaaaatggaataaaatgaagaaaagttgttggacttcttagacactacagcactggaccatagagctattcaactgcaaaaacatgttattcttcaagacaagagaagaatgaccctcaagtcattttcagagtttatcagggctgccactctcaccaaaggtccagagtgtatgggcctgggggacagggctgcctccatctcaactttaaagggcaagaccaatatgtgaacccaccaatgggtggggtaatattcttggttccaataggccatacagaggctgccctgagccatggagtcatgacctccacttggcagagcaactggggcctgtgtttcttgcctagcagtgctgcagaggcaaaacttacatcccactggatccagaggcagagcatcatcaagtcaagaggattattgcttaggtgtaagctcttacagagtttgccttgctaggttttggagtttcttgagacctgacacatctttctttcttctgatttctccattttggaatggaaatatttatcctatgcctatcccatcactttattttggaagtacataacttaacgggtttcacacgttcacagggagagaggaattttggctcagaataaatcatacctcaagattcaaccatatataatttagataatatttagataaggctttgaactttagatttgatatgagactaggtaaaacatttctgttggcatggaattaatgtatttttattgtgagaaggacatgaattgtggggggctgggaatggagtgctatgggctatatgtttgtgtccctccgaagttcatatattgaagcttaaattcccaatgtgatagtatttgaaggtggagccattgggaggcaatttggtcatgaggatggagccctcttgaatgggagttgtgcctttataaaaagagacatgagatggcgaaaccccgtgtctactaaaaatacaaaaataaattagccgggcgtgggggcgtgcacctgtaatcccagctacttgggaggctgaggcaagagaatcgcttgaacccaggaggtggatgttgcaatgagccaagatcgtgccattgccctccagcctaggcaacagagcaaaattccatctcaataaaagacaagacatgagagactttgcttctttcttctttgttctctgccatgtgaaaatactataagacagtgtattagtcagggtaccttagaggtacagaactaataggatatatatatatgtgtgtgtatatatatgtatatatatctttttatgtatatatatgcatgtatctatatatgtatctttcatatatatgtgtatatatacaagtttatacaagtatatatatatacacaaacacacacatatatatacacaagtatatatatgtgtgtgtttgtgtatatatagtatatatatatgtgggaatttattaaatattaacttacacaatcacaaggtcccacaacagactgtctgcaagcttgtggagcaaggagacccagtccgagtctcaaaactgaagaacgtggagtcagttgtttgagggcaggaagcatccagcatgggagaaagatgtaggctgggaggctaggccagtctcgacttttcatgtttttctgcctgctttatatttgctggcagttgattagatggtgctcaccagattaagggtgggtctgccttccccagcccactgacttaagtgttaatctcttttggcaacaccctcacagacacacccaggatcaatactttgcatccttcaatcccatcaagttgacactcagtactaaccatcacagatagtcatttgcaaagcaggaagtgtgcactcaccaaacattagatctgacggcaacttaatcttggatttcccagcctccagaactgtgagaaataaatgtttattattttagccacccagatcctaatatatttgttacagtagcccaaactgactaagatagcaaccgttttgcgaacaatacaccttctttttagccctttgtttctcttataatcactttcttgcaaatataaatgtagcattgttatatttttaccatattttatatgacagaattgatgcttcttcagttgagctaggtacttacatacttttcacatcatttctaggagaaaagttgacctgactttttgtcttaatttttatacgtagattgttggggaaatttttttgtgtgtgatggagtctttctctgtcacccaggctggagtgcagtggtaccatcttggctcactgcaacctctgcctcccgggttcaagcaattctcctgcatcagcctcctgagcagctggaactactggtgcatgccaccacacccatctaatttttctattttgaatagagacggggttttaccatattggccaggctggtcttgaactcctgacctcgagatctacctgcctcggcctcccagagtgctgggattacaggcgtgagccactgtgcccggcctgttggggaaatttttgcaaattgattgttagaatgatttaggctaactgtatttctctgctctgtatattttagattactcttagtactcttttatgtctctttattttgaattcgtttaaaactaagaataaattttaaaatggtagtttcagagtatccttcacccaaattttcccggtgataatattttacataaccattgcctattgtcaaaattaggaaatttgaaattggtacaatattattaactcaagctcagacctcattcatatttcaacagtttctacatgcagatttttggtatgtgtgtgtatagttctacaaaattttatcacatgtgtagattagagcaatcaatgcaaccaacaccataatcaggatacagatttgtccacaaccatttaaaaactctttcatgttaccccttaattaccatactctcccgcctactcttaactgttggcaaccactgatctgttctagatcactgtcattgtcaaatcaaaattattatattaatagaatcatatagtatgtgaccatctgaagtttgctttttttttcatttagcataatgcccttgagatttattcaactattgggtgtatcaatagttccttcctttttattgctgaataatagtctattgtatataaacatcatagtttatttattcactccttgaaggatatctggaatatttccagtttgggaatatcacagataaagctgtaatgagcatttacatataggttttgtttgaacataagtcttcatttctctaggatatgtgtccatgaatgcagttcctgggttgtatgttaaatatatgtttaacattattttaaaaagtgcaaattgtttttctagtctgtggtattttacacaatgattggcaataatgagaaatccagtttctctgcatccttatcagcatttattactatcagtatttcttatcttctctattctaacgtgtggtggtatctcataatggttttaattggtatttctaccatggctaataatgttagacatcttattatgtacatacttgccacctatatgtcttttttggtgaagtaactttaatttctggcctattttctggttgagttgtttgttttcttaactgttgagtttctgttgaaagtgccctgtgtattctggatatacatcgtttgtcctttaggtcaaggacattttttttggcttacaaatttctaatttttccaataccatatgatgaaaatttgtaagcaaaactaaaacaaataaagtacctaattttcgagaaaggcacagaaacaattcccttgaggaaagaaaaaatccatagtctatgtggatctgtttctggttctctgttctattctactgatctatgcacagtctttcacaaatatcatatagttttgattattataaccgtatagtaagtcttaaaatcagatagtgtgattccttcagcaatttttctttttctttcaaaattgttttgactgttctattttccttgtcttgccagtcttatttttcctcttatctaaaaattactttaacctgactttgctgatcatcaattgctgtattccttttctagttaatttctgcacttttttaaaatttttgactctcagtagtatctaatttattcctgttatttactcatgctaacttctcagaattagtttccctgtaggctcttctccagcaatccacctatagtttttccttcaaatttgagttggagactatcgtttcctaagaaatattcctgtctaacctcaaagtgtaatagctacactttcttttccccttattagggtcaaactgtgagtttttatgaccttaagcacacacacagataaacagacacgcaaatgcatttctgcatataattcaaaatttaaaaattaaaacaagcaataaaggaagtgtgtaacaaatcccatcaaaatttgacttctcctcatgaagaccccattgatgctactctatttgctcgtatttggaatacgaaattctttttaaaaattctctctctcactctctaattttttttgtttttatctttgcctttaaccacctccccaatttgatgcagatgctttgctggtggtttaggaatatgcattatctttttattgagtaatccaacactagcttttatgaataatttgttctatgtcattaagcattcacatttctgctctagctctctttatctttgctgtctctgccatgtgacaatcacctgatttgtctctctcttttaaattactccatggagcccctaatctgatgccatattattttattctctgcctcacattttaccttagaatttattcttaaatcttcatcccttttcaaaataaatgtattttacacatattcctgtatatatttctgttacattttttgccaaagattgcaaacagttaaattacttctctaatactcttctcttttttaaaaggtatatttccctcagtgcttgaacttaactaaatagtccctcagaacttcttttcataattaaattatttgatagggtctcttgggccttgtgtttgcacagccatactgaatgtgaactaaataattctgagtactttttgaaactttctttttacaaacagtaatgtattatttagaagacagagcaataggattgttcatattgaatgaaaataatgtctacagttatttatcattttaaggagcagagacactacttaattacaacagttttttttttttttttttttttttgaggtagagtctctgtcaccaggctggagtgcagtggtgtgatctcggctcactgtaagctccacctcccaggttcaagcgattctcgtgcctcagccgcctaagtatctgggactacaggtgtgccaccacgcccagctaatttttgtatttttagtagagatggcatttcaccattgttggccagatggtcttgatgtcttgacctcgtgatctacccgcctcggcctcccaaagtgctgggattacaggcatgagccaccgcgctcggcctacaatagttctttttaatgtgcgttttttactcatccaacatggctaatctctaatgaattaaaaacattttgccaaacagatcacaacccttcaccttcaaatgtacatttgttggtattgtgaggtctttggtactcaaccttggtcatcaaagcaaataagttttgactgaggactgacagaatattctcactgaatatttaactcctaaattatttaccatgcctacttaggccttcatttttattgcataatgaggcgtatgaaagcacattttagtctgacaaaataaaatccacacagaaactatgtacaaagatgcttgtgaacctacatgctggtaaggaattgtgaagcagaatattcaggttattttataaaattaacattaattgaaatgacttctttctgctcctttggcaaatctttcctgaataagtatacttcagtgagtacaattcttacacgtgtgaacaaaatgtagcctttgttcagatgacagaaaaatctataatgtaggatcagaagtaactgcagcttccttcactgcatatatctgtagttaggtgacatgaactgacacatatttcttattcatgagttctacagtgtgagaaggaggattcacctgaatattaaactgttataaactgttaatatattctagctagaattaattaagctggtcacattatttcaaagaaaaggttcgtgtagtgtctgcttcatacatatcaatgcttctcatttggattccagttcctgtggcccgcagcagtctttgcaaatgtatctttatttttctttattcttctaagaattaagaaaaacgagatttggaaaaaaaacctcaaactttcaagtgaccttttcttctgttcacatagttacagacattttgctgtaacatgtatgagctttttgaggggcacatatgcacagtctcacatctcatgtttaagccctttcctcttctttgattgtttcagttgaaataagaacacaggtcacaccgccctttaacagtggagtctgctgtttaaaaggtgtgtggggcattgtactaacatcagtagcttctaaattgcctttgtactttaagattattttacagatattatttagaacagccatagtttgtttgcttgcttccttccttccttgcttcctccctctctccttccctccctccctccctccctccttccttctctctcttttcttttttctttctttttttttttttttttttttccctcaagacggtcttgctctgtcgcccagactggagtgcagtggcatgatcacggctcactgcagcctcaaattcccaggctcaagtgatcctcccatattaaccttctgagtagctgggaccacaggcttgtgccaacatgccctgctaattttgggggaccttgaaggtagagacagtgtctctctatgttgcccaggctggccttgaattcctgtgcttaagtgatcttctgccttggcctcccaaagtgttgggattacaggtgtaagccaccacgcctagcctgacatagtttttttttttttaataatacatttagcataaattgattaatatttttcctctgaagcacttttagtttgataagcaagatatttaaaataccaccccaatatacaaaccttcaagccttaggagtcaagttctcctatttgaaattcaggatttcataatttaggaatgatgtaaatcctgattaagtaaggaaattgaggaaaattttaggaagtataaaatgtactttccttcatatttataaaagcttgtagcatttaaaatttggttgtcataatgatacaaaataaacattcaaatagaaatgtcaattataaactaaattttaaaattcatctaagaatagcaaaagtaatagaatatacatggattcagagtcataatagtaacatatctcttaaaggtagagaaacattcaagatcaagacaacaacatagcagagcctgccatgatttctcctgttctcaatttaaatagttatacaatatgcaaaagacaaaagcacataaaagagaaaatatgaataagaggcaaaagaatgactgagccagacttcattcccacttcatttgatttatttatattctcttctttcaagaaaagatttaaaccagtttacaaggataaacaaaatatgacaaaagagtataaattaaagttggaagaaataagaaaggataaacattgaggagataaatggagccaggaatatgccaaaatgcatgctataataactcactggctgacgttgagtcacacattcatatttaagctttcaaatagccaagcaaaagacatagttattttcatttgtataactgaggatgttttgagattcgctaaaaccaaatattaaaaacaaagacacacaactatattggtactaaggaaggattttaactgatggagcgcatcaaagaacataggcaggtgcattaaatgatgttataaagaatatccttgtaatggtaagtttcatagagtggctttcatgataaattaatatattctaagaatattacttatggacaatcactgagggatgatctaaaggattaccagttggaggtacaatgattctctacagaaaattgttttgaatcatctttagactatagataatttaaggaaacctaaatatgagaagaatacaaaaatgcatcgaaaacaaatgaagagtgtaactgatactgaagaaaattgaaatagtgatatggagaacacattttaaagggcatggtagaatgcagaaatacataaaaatgtaattaataaagaaaatagaggatagagcatcaagcttcagaaaacaaggagacgtttatagagatttttggtcataaaagacagttgtaaccattcatagaatgctatgccttccatattttctattaaaataaaaacatataaataaaagaataaaattagatcaacattgaaaaataagatgctgaaaatgtacatgctaaaaaataatggctatccaatttataaatcttcacatgcaaaattaaatttgtctgaagagaacatagaaaagagtcttcactgggccaacacacagacatactcaaatttgaaagagtcagaactaaattaaagataggctctggaatagtttttcttagatcagcccctaatgctaatttgggaaccatagaatgatagatcatggaacccattctaaccgtggatggagggctaagaaatgtaaggaatactgtccatcgtagatccccttaaggataatttggacttcaaagaaataaccaatagctgaaatatgggtgtcaagtctttaccagaatgagaaagctccctgtcaaaagacaaagttagctgtagcttcattctcatttcttatgtgtaagtagaattttaaaataacaagtttcaatcaccagatatcttaaaatctcctcagcccttttggaataaaactaacaaactggacaggtaaacacataattgtagaaaccttcccaaagaaaatgatatagaacacatataattgctttctactagtcatgaaaaaagtgagaaatattacatatatgatgaaaaggactagtagttcaaaagaaggacactatgaagaatcagcataaaggtctttctgtgaatattttttcaacaaagcaatgtttaaaactatatttttaatcccccaaaacttagaaaatatacttaatacttcaaatgggaacaatctgaaataaagattactttaaataaaaatcaaaatgtctgaatattcagagaaaacaagaaacaacatactgaaaacaagcagaacaaaaaatattttaacatccaaaggaaaattttaaagaataaataggttgggggccatttaggaaaaggagaaaaacttacagaagaaaaagtatataaaaaagtaatatgtcaaaagaaattcccagagctaaagaaacatttaggtcttggaacacaaatgtatcccagaatacttagaaaaattaaggtaaaaatctttatacacacagagacacatacacgtgacacatacatcatggtgaatttggaaatttttaaaaaatgaaattgagaaatcaatttaaggaaaaattaaaaagaaaaaaatttttaaattattagcattctgaaatgaattttttcataaagtttaccagatttttttactatgtaaagtattaacagaaacgttcaagtagaagtttaagaaggaagaaattataattcaagaattccatatccatacaaactgacccaaattatcaggataaaaaggcatcctttacataaaaaaatgaaaaagtactcaaagcaattcattaaatgaaccaaaagattgtatgcaatgatgaagaaaaggcgatgtaatgaaaatggtgaattgtggaaactgcaaaatagaataaatgtctaaatgaatgttgtcaggaaacacagcccatgcaatggatatagatagatataaatataatacacataccacaaaatttactcatttaaagtttacaattcagtatttttagtacattcagacaattgtgcaaccattgctataatccaatgttagaacaatcttatcacaccaaaaagaagctccactctcataaagagtcactcctattttttttttttttttgagacagagtctcactgttgccaggctgtagtgctgcggcacaatctttgctccttaaaaccactaatctactttccattttatagatttgcctattctgagcattttatataaatggaatcatataatatgcaacctttggtgactggtttcttttatattttgaaagttcatcaatgttgtagtatgtatcaatagcttatccatttttattgccaaatactgttgtgtcatatagatataccacatttgtctatctagtcatttgaaacatttctactttttggttattatgaattatgaaatatttatgtacaggtttttgtttggacatatgttttctcttttaatttttattttactttaagttctgggatacacgtatagaatgtgcaggtttgttacatagatatacatgtgtcatggtggtttgctgcacctatcaacccgtcatctaggttttaagccctgcatacattaggttggacatatgttttcattactgttgggtatataactaggagctgaattgctggatcccacagtgactgtaggttaatgtttaaaagagctaccaaactgttttccatagtgctatttttattcctaccagcagtctatgagaaattcccaattctccacattgttgctaacacttgttattatctagttttaaaaatattatgattattatagctgtcttagtagctgtgaagtcataaaacattgtgattttaatttgcattttcctgatagtaacgttgtgttttccattcacattttattcatgtgcatgtcttctttgaataaatgtctattcatattcattgcccattttaaattcatttatgtaagttttattcagttgtaagatttctttacatatttcttttatttctttttttattaggcaaataattttcaaattttttcctattttctggctcgtctgttcactttttatggtatattttgcagcacaaatgcctttaattttggttaaatgatttatcaattcttcaaagaataaatttataatttcttcattgcttgtactttgggtgttgcatctaagaagtcattaccaaacacaagataataagcatttactcttatttttcttatgttttcttccaggagttttatgattttgacctttaaatttaggtctatgatccattttgagttaattttggtctatgttataaagaaagttcaactgtattcttttacatgtggatgttcacttgttcaaactttagttgaaaagacatttgatgaaaacgctatttcatccttgacttgttggggtacgcttgttgaaaatcatttaactataaatatagtagtttattattagactcttaattctgtcagattgatctacatgtctatccttataatagtaccacactgtcttaattactgtagctttatagtaagttttgaagtcaggattttccaactttgttcttttttaagatcactttaatctggatctcttggatttctgtattattagctataagtctactcagatgttctatttcatgattaattatggtaggttttgtgtttctaggaatttgttcatttcatccacactatccaatacattggcatataattattcacactacttttttataatcattgttatttctgtacaatcaacagtaatatccctattttcatttctgattttagtaatttgagttttttctcttttttcttagttcatctagataaaagtttgtcaattttgttgaacttttcaaagaaccaatttttggtttttatttattatttatttatttatttatttattttttgagatggagtttcgctcttgtctcccaggcaacaatctcggctcactgcaatctccgcctcccaggttcaagcaattctcctgcctcagcttcctgagtagttgggattacgcattcaccaccatgcctggctaatttttgtattattagtagagatggggtttcaccattttggccagactggtcttgaactcctgacctcaggtgatctgcccgcctcggcctcccaaaaggctgtgattacaggcataagccaccatgccaggcctttattgattttttaaattgtttttctattctcttttttgtttatctctgctctcatctgtattatttctttccttctgttagatttaggcttagtttgttcttatagttccttagtttgttcttatagttccttaagttccttaagtaaaggcaggttgatgatttgagactttactccattttttttcctttttttttttttttttttgaggcagggtctcactctgtcacccaggctggagtgcagtggtgtaatctcggctcactgcaaccgccgcctcccagattcaagcgattctcctgcctcagcctcccgagtaactgggattacaggtgcatgccacgacgcctggctaatttttgtatttttagtagagatggggtttcaccatgttggccatgctggtgtcaaactcctgaccccaagtgatctgtcgtctaccttggcctcccaaattgctgggattacaggtgtgagccaccacgcctggacttacttgatttttaatgtatgcatgtatataatttttccccttagcatggctttcattgcattccataagttttggtatgttgcatttctgttttcattcatctctaagtatgtttaaattttccttgtaatttcttctttgatccattgattgttaattatgttgtttaatttccaatgatttctaaattttccagtttttctctgttattaatttctaacttcatctcgttgtactcagagaagatactttgtatcttttaaatctattgagatttaatttgtggcctaaaatatggtctatcctggaaaatgtaccatgtctacttaagaagaatgtgtatgtagctgctggtatgttgagtgctctgtgtttgttggatcaagttgctttattatgatgtttatgttctcttctcatacttatcttttctctggtggttctgtccattattgaaatgcaggacactgaagtctccaactattacagaactatttctccattcaattttgttagtttttgctggtcagaccattgatggtctgttattcattgtgtaaatgtttacaattattatatcttcttgcaatattgaaacttttactaatatatggggacctgctttggctctgattaacttttaaaattaatgtatattttgtctgctggtatagccatcgttgctttattatttgcatgaactttttttttttcactttcaatctacttgagattttggatctaaactgaatcggttgcaaacaggatatagttagatcatggtttttaatccattctgctaatctgtcttttcattggagagtttaatccatttaatttaaattaattactgatgaagaagcacttctgttttattgctatttcttttccatataccttataaatattcttttctttatttccagcattactgtcttcttttgtgtttagttgacttttttagtagtgaaatgtttcaattacttcctttgtgtgtattttatagctattttctttgtggttaccatagagattacatttaacatcctaaagttatagcactataatttgaatttataccagcttaacttctgttgtgattttctaattttttgtcttaaagtctctttctggtaagtggccataagccaagacagccactctctagaaaagccccgactgggaggagtattagattgagattgccagtaaggaaagacacagaggaggcagcacaacaaagcccattagataaccagaagcagttttattatttgcccaagaacagggaacagcatgtcttgctgagccaaccagaagaggaaagccatccaggacacatgctcacctagtgggaggggagcaaaagagagagcaaaatacctgtgagccaaagcccttattggggtccagagtgtgacccagtttggtttcctgcagggaattctaactgatgggtttagagcaagcaggcacaagttccgtggagtctgtgactgagaggtggttgccttggcatgtcttggcagtccatgtggtatatgggagtcagtgggtcaggtaggttatatctagctgtcccatgggcaggtggttgtcaggaggtagttgtataaactcctcccagttcctcaagctggatcaaccaccttgaggacttgggaggaggtagagaactggaaactatgcaaagtgtgactaagccccgcttctggtatgataaaattaaacctatattcaaaatggatgccaaagcaacataaaattatgagctcacaactttgaatagtatacaaaaactgcccctttacaggtcagttcccactgaccaactttttcagttgctgatgttccaaaattatatctttacatataatgtgccaaaaacataaactaacaattattttaaatggattagcctcttacattattcagaaaacataatgtggagttacaaactgaagttaaaataagactagctttttgacttttttttaatgtgttagtatcttaaattatgtagaaaacagtgaattataaactattgctactataacattagcttttgtaattgcccatatacttaccagtaatgaaatctttatttcttaatgtggctttgagtgactgtccagcatcttgtcattttacgctgcaggactttctcgtacatttctttcagggcagttctactggtaacaaaccaccttaatgtttgtatatctgggaatgtcatactttttcctcattttgaagggtatttttgggatatataagaaagttcgttgacggtttttgtttttccttttagctctttgaatattttgcatcactgccttctggcttccatagtttttgatgagaatctgatggtaatcttattgagcatcacttgcatgaaacaagttgcttatttcttagaattttcaaggttctgtctttggctttgaaaaatttgaatgtaatatgtctcagtgtggtctctttgatttcatcttacttgaaggtctttgtacttctcgggtgtttatattcctgtctttcactacatgtggtgtcataaatttgtgtaatatagtcaccacttaatatccaccttcaggcttgatgtaagttgtttgaaaccagttgtatccagtcacctttcacctagttaaaacttcctttccctgaatggttgtttagatatagcctgtttgttcctcatcccagtgacccaaaccctaacacacctcatagttggttactattataagacccaatggtgaacaacagagtcatctaaataagtttattcatttatatgtgttttctaagctagaaaatctacaaccttcacaggaaaccctaaggaataataccatggactttactgaaggcataattacacaggtactcttcctctctcctgctcctcaccctctggttgagctccctgatgcctttggaattccagtcagcctcccatcagtacctgtaacctctctgaaacctgtgagttatgaatttcttgtttcatgcactttggtttcacttcctctttgtctcacctgacacgcacacacacctaaacctaaccttcctcccattcaggtcttttctagaagagtggctgttttggtttatgagtgctctccaaaaaaagacaataccaaattaaaagaaactgtaataatggaaatctcatgtggaaagttttcagccattatttctttaaatatctctcttaccctttctctctctcttttccttacagtattcccacaatacttgtctgcttgttgacgttcagagatctcataggctctgtttaatattttcttcaatctttttctatttcaagttttataatttccaataccctatcttcaaatttgtttcctctgcctgctcaaatatgcctttgaatccctttagttaatttttcctttcagttgttatatgtttcagctccacatttcttttcggattttctctttttattgatatttccattgtgttcaacattgttttttgtttattctttttttgctttctccacttcttcttttagttatttgacagtctttaatacagttattttaaagtgcttgtctagtagatctgacagcaagtcttttttagggacaatttctgtttgtttgtttttttttctttgaatggaccatacttttctgtttctttctaggctttgtgattttttgttgttgagaactagatagttgaatctaataatgtggtaactctggcaatcagatttttctttcttccccagggtttgctgtggttttttaaaaattattttggtttattgtttttgttttcctattgttgtaggcagtctgtgtgccaggagttagcctgaggtgtaaatttaaggtctcttctggtctgttttgaccctgcacctttcaattgacatgtgtggtcactttctaattttcctcacatacgcagttgcttttgaatgttctaaatgtctttaatgtctgatgcccaagaggggaaaaagagaaaaatgaagtgataggaaaatgatactggccttttaaatgccctagaagttattgtggctggtgggggagcgcttgcaataatgcgggaggtacaaaaacaatagtcagccacttctttctctgcacttctgtgattggaagcagcaatcagtaatcagagcacaaatctctggtatttggggaatacgcttcttttttcccactctggctcccataagctacggacaagctgctccaggaacatgtgcacagccatctgcgatggggacaaggataggtagctactattatgttaagagccgaaattgaccaaaattaagtgcagtttattatccaagctctccagagttccaaaatagttatattggtcagattcttctagtgcgattacaattgttgtttaggtgggaagaaagattcctggtgcttcttattctgccatctctccaaaattttctctccaattgatatttgtatattgctcatgtatcctgtaaccttgctgaatttgtttattagtttttacagttttatgtatattcgagttttctacatacaagatcatggaatctgcaaatagagaattttacttcttccttttctatctggataccttttatttctttttcttgatcgttttccccagctaaaacatgtagtgcaatgttgaatagaagtgattagatcggccatctttgtcttgctccttattttaggatgaaaactttcatctttcattattaaatatgttgttagctattttttttttgtagctgcctgccttttatcagattaagaaagctgtcttctaaccctagtttttttttttttttgctggattttgataaatgttttttcagggtcaattaaaattattgtgtggtattattcttcattttcttaagtgttttattatattaatttttaattattaacacatccttgcatttctagtgaaaatctcactgttcattgtgtataatccattttacatgttgctggatttagtttgctaatattttgttgagaattttaaaatctctgatatttatcagcagttttgatctatggttttttttcttgttatgtatttgtctggttttgatataagtgtaatatcaacctcatagaatgagttgggaagtattccttcctcttgtattttttggaaagtttctgaagtattgatattaattcttctttgaatgtttggtagaattcaccagtgaaacattttgggcctgtccttttctttgtgtagggtttttaaattactaattgttatggactgaactgtatcccctcaaagttcatgtgttgaagccctaagccccaagtaattctatttggagataaggcatttaaagcggtaattatggttaaataagggtaaagccctaatccaatagaactggtatcctttttttatgttttttttttttttgagatggagtctcactctgttgcccaggctggagtgcagtggcgtgatctcggctcactgcaagctcgcctcctgggttcacgccattctcctgcctcagcctcctgagtagctgggactacaggcgcccgccaccaagcccggctaattttttcgcatttttagtagagatggggtttcaccgtgttaaccaggatggtctccatctcctgatctgcctgccttggcctcccgaagtgctgggattacaggcatgagccaccgcgcccagccagaactggtatccttttaaagagagaaagacggcaagggtatgtgtgtatacagagaaaaacctgtgtgaggacagcaagaatatggccatctgcaaataaaggagagaagtctcagcagagattaaacctgatattttgatctgggtcttccagcctccagaaatgtgagaaataaatttctgttgtttaagccacccagtctgtggagtttgttatggcaacattagctaactaattcaatcgctttactcattgtaagtttattaaaattttctgtttcttctagagtcagtttcagaggtcatgtcttcctagaaatgtatccatttaatctaagttgtctatcatagtactttgtcttttaaaaaaatttctgtaagattggcagtgaggtcctctctcttgtttctgattttggtaattttagtcttctctgttttttttcctctggtcagtgttactaaagatttgtcaattttgttcatcttttctatgaacctacttattattttattgattttttctattgtttttataatcactatttcattatttcctactgttattttgtttcctttcttttgctttctgaatgcttagtttgctctttttttttttttttaatgtctaaagatagaagctatggttattggttagagctcttcctttaaaaaataagcaccaacattcataaacttctatctgagcactactttagctgcatccagtaaatattggtatgtcgtgttttcattttcatttatctcagagtatgtgctaatattcctgtgatttcttacttgatacattattcaggagtatattgctaaattttctatattttttaaaatttctcaaatttcattaagtgattgatttataagttcatttccttgtggtcagagaacacgatttctacgatttctacgatttaatttctttaaactttactaaggattattttatggcccactatacgatttatcttggaaaatgatctgttgtactttgtactctgctactgcaaagtggagtcttctatagatatgttagttctagatagtttataatgttgctcaagtcttctatatccttcttgcgcttctgcctagttaatttatccattaggaaagtgtgatattgaaatttcagactgcttttgttgaattgtttatttcttccttcaaattatcagctcttgtttcaggtctttcaggtttattttatgtacctattattagtgttatattgtactgatgaatttacccttttaccattttaggacatccctgtttaacttccttttacatttttggtttataggtttattttgcctgatattagtatagttactccaactctcttatgcttactgttactgtttaatggtgtttcctttccctattcttttcaatctatttgtatctttgaatctaaagtgtgtattcgacagacaacatatagttggatcttgttaatttatcctttctgacaatctctgccttatgattgaattgtacaattcatttcaatttaaatggaagtacatataaaacaaggttatgcattgattggttgataaaaatattgtggccagagactcacaggaaccaaattctgtttttccactacatgaaatggctcagtatttgcctatttgaaattgttggtgactttataaaacataactacatatgaataataaaaattgatggtatatacatgtagtatatgcatactattttatatagttgctttctatgtcaggtaagagatgaaaggacaataaatatgcaattatactaccttttataatcatctctatttatatttatttgtattttatgtgtggatccaaatatttgcctgatgtcacttgttttcagcctgaagaacacctttagtattccttgaaaggcaggttagctagcaataaattctcttaatattgatttatttgggaatatttttatttcaccttttttgaaatatagtttttctggacacagttttcttggttaaaaattcttcttttttttctgtcagcactttgactatgccatatattgccttctgaactccattgtttcagataagaggtcagctgttaatcttttgggatcccctgtacatgataagtctgctcttttgctacttacaagattttctctcttaattaatctacacatccagaaagcccaaagaactcaaaatagaataaaaatgaagagatccacacctagatcaatcagagtcaaaatgttccaacccacttttaaaccctctgtttaatattttcactctaattattgtactttcaaccctggacttttcattaattcttcttctataacatctagctctttattgacattctctacttaataagacaatgccatcatacctttgtttaattatttaagtgtgactttgtttagtttttatttataatatctcctttgcagtctttggctgataagtacaatatttgggtcctttctcttgccattttctttgcctgtgtatggctgtgaattggacattttagaaaatacaatgcaatgttcagtattgattctccttcccctaccctggacttgtttgtttatttgtttagtggcttggctgactgttccaatgcagtctgttttctccacagtgtgtagcctctgaagtcactgagcagacaatggcagctttaggcatagagtgcagtccccctgacaatctctcccccaaatgacagtggtttcagcttggctgtcttttactgtggactcagagtccctggggttcaacttttgattttttgacttcacaatgggtttatcaggatgcaacctcatcgtaagtcgagaagcatctgtatttctcacatcttccttttaattttctggttggtctgtctctcttgctatcacactcagctattagactccattaatttgtagctgattgctctattattttagagaatacctcagggcataagttgctccacagtttgctccaattaacatctcagtccctttgcagatgtagtctttgaggacagttagtgagctttggtgtgaccagaggtgttctctttttagcagcctttttccttgattctctctgttaagcgtttcaatttttactatcgtatggctataaacctccacttaattgcttacgaccaaagtcaccattgttttctatagcactgttatgcttttttctccatactttgttctaaacatctccatgatttattctaaataaagtcagcctccttggggacagctacaaagctctctgttcttggtctgcctctgtccctgggcagaatgtctgcactacttctccgaagaacagcttccacttatcttggaataacatagctactctatgagtggagtgctgggttgggatgacagcctctggttctgtaggaatactttcattctataagtgagatggatcaaaatgatgggacccagaataataagctcactgcattcagagtataggttctgtcctacaattaaggttagatggagaaaggaagcctgagatctgttagcattagaatagagtttctgcaacatatacctagggcagaggaaaattgctagtttgggatcttcccttcctgagaagaaaccatagcactagactgggctctgggagaagatggagacacatcttcttggttgtacttggacagagtagagcttctcttccactgagcctgaggggtctgagaacaattgtaactcaattgtcatggtctcttactgttcttactgagatttaatatattttcttaaaaattgtttcttcatttggagtattccctttgtataattttctaactctactatataaaccaaaattttcagtgaattaaagagttaaaagtatatatctcataaaacgttaatgtaatttgtaataagaaatgcttctaatattagatgttagaagaggagaagcaaactttatatgctgtataatccctttaaaaatattaatacaaacattgctgatgacatgataaagtgaaagaaatttttaaaaaacatctgccaaggtgttgaaaataatatttctaagcaaggtgattaagggtgacttgtattttctttgacacatccttgcatattttccaaatcttctatggtatacatatatgtctataataattagagcaataatccttattaaaaatagtgatgccttttttagaccttacaccgtgtttaaacaaattttactaattgcttggtggctgctagcatgatcattttttccacagtcttctgactctacttttgctgactctgccctgatatttcatcttgattgatacagtatgtgatctactccagtcacctttgttcctccattcattaagggaagcatgaggggaagatgaaattcacacctaggcagttattttcttctgctttattctgactccaaactgctgcagctcttgcaggtcacatgcagctctgagagagattcagtcagctcaccttttaagcccagaggttctcagactgtatcaacttttgaataacttagttcaatctaattctatttttttcctgtaaattcaagtagtcatcatgatttctatgatttcttccatgagaaactgttatattcaatataccttatatagttattgttatttacattccactataggaacataaaaactgtagtaggtcctaccactatttcaccttaaattgtattctgtcggacaaaatcttccatcagcaccttctttatgttgaactcataaaatatggcagtctacaaatctatttatctcttcttaggtatccattagagaattggttttctatcactttgaattttgctcaataacacccctcaaattcaacaaagctaaatcttaaaggtaaatgaaagtaaagagagaccaaaagagagacatgtttaactcacaaatgaaatatctaaaaagattttcaaaaaaccagatactactatatacagctaattggagaaaaaaggaatagactctctttatttgtgagtctaaagtcaattttaaagagctcaatacagaaaaatttgtatatagatgtaaatatttaaatataaaattttgtcaaataactaagatgaaaattatgtcttaacccctgctatgattattaaatagcaaagtaaggtaattatagatgatgttgtcaccatgttttatgtttattaaaggtagcattttaattttaggttaaatatacaatgtaggagtatagtagtttatgggctttaatgcacattttatgaaatgttgagtctgtttgcatagtcactgtgtatgctacatttaggccaattttatgggacttgaagaaccatagcactattttaaatgataatgctggtttatagggattgtgcttccttttacgatatcagtgattgatatatttaatggctaatttttgatgtacttcaatgtgtaaaggtagaatacttatataatgtccaacatactgtgtggaattattcacacagctgccgcaatttgtttatttaactacaaattcaaaattactttcctttcctttcttctttccttcttttttcttttcttttcctccctccctctctctttctctctgtctctcttctcttctctcctcttctcttctcatctcttttcttttcttttcctttcctccagagtctcactccatcacccaggctggagtgtaacggcgagatctcatctcactgcaatctccgcctcccaagttcaagtatttctcctgcctcagcctcccaagcagctgggattacaggcacctgccaccacacccacacctgccaccacacctgccaccacacctgtatttttagtggagacagggtttgccatgttggccagcctggtcttgaactcctgacctcaagtgatctgcccaccttggcctcccaaagtgctgggattataggtgtgagccaccgtgcccggcctcaactacttcttttaagcctatagtatcaggcttctgctgatggaatgaagaattcattgggcttagattcaggagaactgaattaaaatcctgtatgtttgggcaatgattaactagacttttttatttcagttcttttctcttagtgagacaaagctgcaaatttgacgtaaaaagtccaagctgtaaattctggctctatcaggtgttaatgggtatttgacattggaatcatttcttgatttctatgaatatcagattcagtttgtaaaatgtgaatcataatatatatcaccttgataaaaacatgaagtaatgaatgtcaaagtgttttgtaaatggcagagcattattctaacttttgtacatagcacatatatatttagtgcttatttttatgctgagttcccattctcaagtgtgacatcttactggaggaggcaaatacaaataatatccatacaaagagtcagataacatacagatgtacaagtattatagacagcttgcagagctaagcaagcatagaagacttgagtaaacaaatggcatttgaggtgggatttaaaaagggaagaaaaatgggagcaagaactacaacagttgtgtagtggtgtgaaattaactttggctaaagtagataacagtaagatataggcaaagacatggtagaaaatgaggtttgcaaagcattttgaggcagacagagagctattaataggagtttggacctttttccttggtttagtggggagctgttagagctctttaataattctccatccagattatggctggttgatacctatgacttacatatttttgacttaatatcaaatggcaataggaggtgccgggtggttaatcctgatatggtttgaatgttggtgttccctccaaaattcctgaaattgatattgaaacgtagtcccaaatatcaacagtgttaagaagtgaggtatttgggaggtgattaagtcatggaggctcctctcgcagtgggatttaggcctttataaacgaagcttcacatagcatttggctttttcttccccttccttgccttctgctgtgtgaggacacagtgttcaagacaccatcttggaagcagatactaggacctcatcaaatactgaatttactggcaccttgatcttggatttcacaaactctgtaactatgagaaatacatttatctttttttataaatcatataatcccaggtattttgttacagtatcacaaacagactaagacaatttctaaaatctggcaccctgagctcaggtgtcagtttaataaaccgagtgtgtgtaaaatgtggaagaaaaaaaaacaccctttagccactatgcttataattatttaacagttaaaaaaaaggcacagtagttgtctcactccgtttgggctattataagaaaatgccttagactgagtaacttgtgaaaaacaaatttatttttcacatttttggagcctggaaagtctaagatcaagacaccagcagatttggtgtttggtgagggcttgctgcctgcttcaaatatggtatcttcttgctgtgacctcacatggcagaaggagcaaaaatgttccctcagactttgtttataagggtactaatctcattcagggttttgccctcatgacctaatcatctcctaaagatgccatatcttaatactcttgcattggagattaggtttcagcctgtaaattttgggggaacacaaacatttagaccgtagctgtagtgaaatattgtcagtcaagtaatgctaaaagttttgctttttttttttttgtttatttttaaaaacatttttatagatagcatcttattgtgttacccaggctggagtgcaatggcacaatcttgctgcaacgtctgcctcccaaactcaagtgatctgcccacctcagcctcctgtgtagctgggactacaggcgcccaccacaacacctggctaatttttgtatgtttttgtagagacaggtttcaccatgttgcccaggctggcctcgagctcctgaacacaagcaatctgcccaatttggcctcccaaagcactggtttacaggtgtgaaccaccacatctggcgaagtaatgctaaaagtttataacagcacactattggtgaacatgactgggcatatgttctgtaggcatacctttttagatgaaagtacatcctggcctcattggagtattttgtagatgtccttccaaggatatgcatgaacataaacaattcacataatatgtacatatatatgtttatcataaagagtgaatgcaaaataaaaatgtatggagtgaatatttggcagagtacatttacttatttagtttacataattatacctcttgctcataaccctgacagaacaggtctaattttcattaagcatgactacagttttcctacactaatcatattaatgttatacttgttttgataccaaataaagtaattaggttgtttttgatggtagtgaatataatatgtatattaacaaattggcatctgttttatttcatttttcatttcaatttaaatgtaatcaaccaataatgaccctagtaagctagttaataattaagataagcattcttccactaaagttatatagtttatttcaaaacttatgtttaatacatttcaaaagatattaatcagaaatgttcaagagaaatggatattctgagccaattgttgacattctaaatccaagtacattaacagcaccttttcaatcataactattgcatcattagtgcacagctacatagtgctaattactttatttacctctacattgaatgaatgctgttaaacctttttaaataattgataatttattaaatactaatatatgcaaaactgaactatacaagtttttccaaattatatctgccatcttttgattatataaatacaacatatactacctgaatgcaaaattaacatattatatttttattatgttaaaacatatgtaacacacagttttccattttaaccattttaaacgtagagttttcagtggcattaattatattcacaatattatgcaaccattaccagaatctatttcagaattttttatcaccccaaacagaaactatgttccttaaaaagttaagcatacaattaccatatgatccagcaactctgcttctaaaaatatactgcaaagacttgacagcagatactcaaacagatgctggtacacatacatatgtttaactttttgagaaacagtgtaagtgttttccacagtggctatatcattttatattcctgccagcaataaatgaggattccactttctccacatccatgacatgctaacatgtgctattttcttgttttttggtttttttttttagtacagtcatcctgttaagtgtcaagtgatatctaattgtgtgtgtgtgtgtgttttcaattttagtttttgtgggtgcatagccatatatatttatggggcatataagatattttgatacaggcatacaatgtataattatcacattagggtaaatgggctattcataacctccaggatttattctctgtgttacaaataatccacttatactctttcagttaccattgtgattttgaattgcattttcctaatgatgaaaaatgttgagctacttttcatatgcttattggccatttttaaatctcctttggagaaatgtctattcaagtctgtattcatcagagaaaaagaacccataggagatatatatttattatacaaattatacatataaatatatataatataaatctataaaaagagatttattgtgagggactaacttatacaattatggaggctgagcagtcccatgacttctgtctgcaagttataggcacagaaaagatgttggtgtagttggccagttcaaacctgaaggcctgagaacgaggtgcactgatacctgatgcaggagaaggtggatgtcccagctcaagcagagagcacattcagcctttctcatttttgctctatttgtgtcttcagtgagttgggtggtgcccacctgcaatggtgaggatgatcttctttattcagtctaccagttcaaacactactctcttgaggaaaccccctcacagatgcacccagaaataacgttttgtcagctatctgggtatctcataatgcagtcaagtttacacttaaaattaaccatcacagagtcttttatttacttttaatttgctttttgtcttcttgttgttggcttgcataagttctttatatattctggatatatattttaaatataaccatatactttttcccttatcaggtatatgatttataaatgttttcctccactctgtgggttgtgttttcactcttctgatggcatctattttgattcccttatttcctttagtttgtgttcagctagtgttttgatatagattttcttgaattccaagtgcttggaaacaaaacaaaacaaaacaaaaaaacacctctcagtgtttgacgattaattctgtgctgggtcactcttttaagatttagccagcccagttaaagctctggcccaacctttacttcctacttgtgctgagtgtggacatcagccaatgatgaaagcttaaggttttcttgggtcttttttgagcatgcatcctatcctagtcatgttcttggtttccaaattccccagtatatacaggcacttttgagtgttctcatttcccaaagaaattaccttcctggctttttctcccaagatttaggcagtcagttgtgtgtcttaatggtaatctctcttttacctcagttggctgcaggttcttcatttgccttccctttttgaatagcaccttctgtctcctctgctcttggtgggatccaagatatgaaacagaaacaagaacattatgtcagccctcaggtagcacccaaacaggttagaacaaagaaacaattatttttcaataaaccctgctctgctccttccagaaccagaggccagggttccatgctgagaacaccggttaacatcttcaggactgcagcaaagccatggagaggtgtggataagggcgagtaagaatgccacaatttttggctaccatttttaaattgcccccttttttttttttttgattcggcattcatttggttactgtatacttttgactgtttctggagttctgacaaagttggttttgacagttctgcttgttttaaatgatttttgtgaaggcacagatgtttggagctgcctaatctggtgttttgtggatattgctctcctttactgtaattttatattccaatttaagttaatggaattaataagtaaacctgtgaattataagacttgcattacacaaagtactgtaggacgtatgctggtggaagacggaccctcaagaatttgagaggtagatatgacctgcatatacatatctattacagcaggtagtttatgacctgtagtaaatcaggggagtcaggaaaagattaataaggataacttttaaggtggactttgtagcttaactaggatttttatagttagtgataatagggagaaaaagtttagctggaagaactgaatagaatcctgttttatgagtatgtaggctatttgtagagttttggtggaagatagagccagatgatcataattagttctgtctcttatttaaaagacaatgaaaataaaagcttttaagcaaagaaatgctacgatttaagctcctgcttcagaagattagtttggcagtgatgggtagaatgcattgagcctacaaaatgtatattacatacataaaattatatatacaataaatgtgattatattaagacttttgaaatctaggaactcttagtttaagtcaataaataaaagatttgcttattttaaaacccatctaaccattatgacacctaagatttttaaaatactaggcaaatgcagttaaaaaacaaattatgttaaatttagcttcagagtatgtttcaatgaaatatgataaatactaccagaaagttacttattaaaataccatttagaatccgcaatacaaataatcatgctacaagccaatgcttattggatgcttcctatatgccaggaaatatatgatgttaatttatatatgctttctataagtatatttttctaagtgctttatcagtggctgctcatgtaactctctgttacacgtctgccagcctgtcagttaagtaccatttttatcatatcattttatgaatgaggaatctgagacttctataaattagggaacttggcttgccacataaccagcaaatggtagagctgggatttgaatccattcactcaggctcacagattttgaccttaactgtcacatagcactttctccctttttaacagttatcaagaatctagtattgaagtaagatgtcgttaaaaaaaaaaaaaaaaacacaaaatgtgtaaaaagagacattaagaaaactaccatagtagtgagaaattacaatagtctttttgctaagtcctcaatagattagataaaataaataaaaatttatagactttaaatataattaatagtagcaagatattcatacaatagtagatatctatcataggtctgtaatagatgtagatgtatttgtatattaaacagattatatatttatagaatatatatcccaaactttctattcatatatttaaataaataatatagtttattttcaagtgcctatagaatatttacaacgtgaaaaagtgataatatcctagggtgaaatgttagtatcaaaattttaaaaataatattaatatgcataccacattctcaattttcactaacacaaaactagaaattaatagcaaaatgttaaccaaaatacttaataaaatgacaatttattaacatgttcctaaagtaggtctaagataattttaatatgtaattatatagtttttgattaaaggaaatggcaatattacattccaaactgcaaatgatgatgagaaaagagttctcaaataaataccctaaaggcttttataattaagtaaaatagaaaagaaataaatagagtcatatcaataataatgtagcggggaaaacagaaaattcacctgttaatacattagaaaaaaaatgatgaatctaagaataattatttgatagggagaggaaaaattctaccaaaataggtgagaaaaactctggaatgtctaagaaataaatacatggaaagagaaaaattgaaaacacactgtgtttatcaattgctttataactatttactccaagagttagcagcttgcaacaaccatgttttttttcacatggtttctgaaggttaggaatctggtggcagctcggctgggtggttctggttaacgggttcttgtgaagttgccatcagtgttgtttatggttgcacatccaaaagcttgactggagattgaagatctattttcaagcttacatggcttgcaaacttcttcagtatcatgtgggtctcctcttcatacagcttcatacagcttctcatgatatggcatctggctttcctaagagtgagtgatctaagacagtgagggagatatatatatatatatatatatatatacacacacacacacacacacgtatgtatatacatatatatacatgtatgtgcgtatgtgtatatatacacatacatatgtacgcatatacatatatacacgtgtgtatacatacgtgtatatacacacatatacatatgcgtacacatgtgtgcacatatgcatacacatgtgtgcgcatatgtgtacgcatgtgtgcacatatatatatatcagatgatatatatacagaaagtgagagagcagatacatataaatcttcaaaaccagtccttaactaacaggtctcctctcacacacaaatatatcctattggacctttcaagtatattaacttatgtagcaaaaaggacttgcagatataattaaggttaataatcagtgactataaaatagggatattaacctagattatataagagtattggtgggatgtagggtatgatcatgtgcatggagaaattttcttctgctggagtcaggagaggtatagcagaaaaagctagaaaaattccaatgtgagaaaaatttgtgtgccatttggggcccatatgaaaggcttgaagagaggactctaggagttcagggtggcctctggctgacagacaggaaggaaagagaaccttcattcttcagccacaagaaacagcattctgccaacaacttgaatgagtttggaagtggttttgtttgtttgtttgtttgtttgttttttcctaaaacctcactataaaaacccagctggctgacaccttcatttcagccttgacaaacccacagcaaggacacagttagctgagcctaacaggacttctgacttttagaactgtgatataataactgggtgttgttttaagtcgctaaatttgtgagaagtggttacagtagcaatggaaattgaataccatagcatatacttactctcaaagtgatatgccctctcttttgctatattatgttggtcagagaccaagcagggggatatgggagggaaccatacaaagatgtgaataaaactgaggtgagatcatcaaggactgtattggaggttactactatcctctgacctccacaatacaaattccctcacatatgaaaaatacacacactgccccccaggattccccaaaatctcatcccattttagcatcagcttgaggttcatatgctgttatctaggtccaggcatggatgagattcctggagtgtaggcacttaaatacagttccttggataaaattacttaaatacagctccttgaggatatttcctctctatctagagatagaggcaggttactgccccccccatacccaatatcctggcagacaacagaggataatagttgtagacattcctgttcataaaggcaaaaaataaaaggcacaaaggagacataggtccacagcaattttaacatccaactaggcaaatattggcagttcttaattgttgccaactctgattcctgcccccaaatgctctctgtatctttttgtttaagattctgggtttttggtttctccctttgagttaccctttcttttcatgaatggtagtgcatgttcacactgagtaatttttatagcctgccttcttatttatagatttaagggtccaaggacctctttttattttgtactgtcactgttcttttcaattaaaactggcgattctggtgacataatctgcatacaactttgtagatcttctgtggatcttgttaaggatcactccattgacaaaatttatgtccctgcatcttttctatataagcctcttctctaccctcttccactgagatggctgagatactatactctttaccttcttggaatctctctctacttttttttgttgagaggatttatgatgcgcacccttaaattctttatagggctttttttttttcaccacagagtactatgagacaccccttttaacttttctggagtcttaacaaaggcttttagagtcacgtcattggattctactaattctatccttgtttcccgtcttgggacactggaaatcttcaaaaccagtccttaactgataagtctcctctcacattttactctaaacagagtatattcaacatttttaatggaaatttcctcagctggatcaccccatttgttaggtacattttccatcttccacatcactgcaagtaacaggtttgttggacattttgccactaagtaacaagaatattctttcctcaaatttccaataaaattttcctttctttcccttaactgttcacaggcagcctcctcaacgtcaaaacttttgctaacagtctgttcgaggttttcctaaaactcttcttaaaacccttctacctacttcctattgcctggtttcaaaatgattccacatattaggtatttattgtggcaccacactacttccaatttctaaattttgtgttatttgtcaattgctgcataataaatcatccccaaattttgtggttttgaacagcaaacatttactgtctcacatagtttttgggtactaggaatctttgagtagctgagctaggtgctgctggctcagaatctcttgtgatgctataggcacattgttttctggtgctgcagtattctgaatgtgtgattggggcaggaagatctgttttcaagctcggtcctgtgactgttggcattaggcttttcactatgtggacttctccacagtgttgtttatgtgactctgaatagtcacaatgggggttagtgcttcaattcacaggacttcctataagaaaaaaacgatagggcatttatgctaggggagctggctttcctcgggaagtaataacagagagagagaaagagaaagggagggagagagagaaagagaggagaaataaggacggaaaataatatctcttataagctgtctcagaaatgaacataccatcacttctgatatgttctattggtgacatattctattggttacagtgaccaaatctggtacaatgtagacagggtgtacagaagggtagaaatagtaggaggtggggactcctaggagtctcttggaggctgactactacactacaacttctggcctccaattagtcatgtctctctttttaaattaaaaaaaaagaaatgttggggggtatggaattatactttataattcaggaatgtttgtctcagggaaattaagactcttatccaagacattaccaagacaattgaaacctaacccacctgtattgttccttttcctactgctataaagaactgcccgtgactgggtaatttataaaggaaagatgtttaattgactcacagttctgcattgctggggaggcctcaggaaactttcaatcatggcagaagtcaaaggagaagcaggaaccttcttctcagggcagcaggatggagtgagtgcaagcatgggaaatgccagacacttataaaaccatcagatcttgtgaaaactcactatcatgagaacagcatgggggaaaccgcctccctgatccaattgcctctacctggtccctcccttgacacgtggggataatggagattacaattcaagctgagatttgggtggagtcacagacctgaaccatatcgccacctaaacctcatgcctcacctaaaatcttatgccttttctcttgcaataaaataggataccctggagatctgctatgtatagtactgttttccatagtacataatattcctatactgcttgagcttttgaaattgtctatctttgccagtttttctttatctcagccttcaatttctatcttacctcactggaataagtgttccagatggataaattttctctccacccttccagattactatgtttttgtttgcaataaacatgtatggcattgcctatagcatcatgaaagaaccagacttactgaaatcgcatgaaaactaagtgtaggccaggtgtggtggcctgtaatcccagcactttgggaggctgaggtgggtagatcacgaggtcaagagattgagtctggccaacatggtgaaaccccgtctctactaaaaatacaaattttatatatatatatagaatatatgtgtgtatatatattctctatatatatagaatatatgtgtgtatatatattctctatatatatagaatatatgtgtgtatatatattctctatatatatagaatatatgtgtgtatatatattctctatatatatagaatatatgtgtgtatatatattctctatatatatagaatatatgtgtgtatatatattctatatatatatagaatatatgtgtgtatatatattctatatatatatagaatatatgtgtgtatatatataatatatatagaatatatgtgtatatataatatatatagaatatatgtgtatatataatatatatagaatatatgtgtatatatagagagtatatgtatatatagaatatatgtatatatggagtatatgtatatatatagaatatatgtgtgtatatatatagaatatatgtatatgtatatagaatatatgtgtgtatatatagaatatatgtgtgtgtgtgtgtgtatatatatatatagagagagagagagagagagagagagagagagagtaagctgggtgtgatggtgtgtgcctgtaatcccagctacttgggaggctgaggcaggagaattgcttgaacccgggaggcggaggttgcagtgagccgagatcacaccactgcactacagtctaggtgacagagcaagactctgtctcaaaaaaaaagaataagagtaaatacgttctgagtaaaaatctatgtgggtcttcctgtattagactgtttaggttgtcataacaaaatactacaaactgagtggcttcaacaacagaaatttgtttctcacagttctaaaggctgggaagttcgagatcaagatgccagctgactcacttcttgttgatagctctgttcctgttgtgtagatggctgccttctcactgtgtcctcacttggcaaagaaagtgagagagccttcgggtttgaatgctgctataagaatacaaatcctttcagatcagtgcttcacccttaagaactcatttaactctaatcaattccttattctaaatcatgcttgaatgtatgagtttgtgggggaatcaattcaattcataggacttcctataaggaaaaaatatagtgctttgactttgggatattatagtattcaaggagctctttttttccaatgggggttttgtttctttacattatttttctcagtatcaatccagacagtgagtttttcatatatttatgttcccaataattaagttactgattataatatggagtttcattattgctgctattttagaaatatgtatttcctgagtttcaggttcaaaacgtttttaaaggaaaacaaaatacactcattaaagagattaatagcaatggaagaaaatgaaaatagcgtacctataggtggacttgagtttgttttcattcacttaagtagcttcttattagagggtcagattggttttatattaatgtgaagagcgcaacaaacccattatatataatagatttatattatacaaagccactgatatattgtggtagattatatgaagctattctcatcattccccttctagacatacatacacacatgcttatatataataatcaaatgagttagttgacaaaaggttttaaagtccgaatttaattcatgaaggtatccattttcttggattaaaattctagtttctgatttttttacatttcaaaaacactatacctttttctaaattatgtatatttttctgtttgtaaggaaagtgtagagcttacaacagagacatagagaaaatattgactatactaaagttagcaactgatatatgttatagatgaactgtaacaaatatgtccttagtgaaatataaaatgatgttgttataataacgttagagttctagttagtactacattcaatttgtattcaatttgcgacaatttaaaagttattaacctatattctaaagttagtaaattattttacaacagtaatttcaacaatggaggctcccatgtgcccatgtatttggatacatttgtctgaaatcattttaatgagcaattaaaaaactcacaaaatagtctttctaatatttgctctcaaaacaactctgagaggtcaactgtttaatatgtttaatgtaatatctattatattctcaattttaccgttcttactaatgaattatgttatgattttattgcctttggaattgaaagcaagataaaatatgctttttgtgttttatacttacatacaacaaagttttgaagtattttttagctctgaaaaggaatgataacaatgactatttggaaataaaatatatcttctactatagaaaacataagcaaatacaacttgttaccaaggtatagtttctggtgtgtgtgtgtgtgtgtgtgtgtgtgtgtgtgtgtgtgaaagacagagtggtggtgtctatgacatactacggtatatttgagattataaactaacaaagcaactcaaacacttgacaacataagagtaaaagataactgaacatgagatgacaattggaaagttaaccttgaagtggtctggaaaattatattatttgctttgtttttgatttgtcaatggagaccaacataaattttccatgtaatggtaagtcattaaaaagtcataaaatatagtttaatagcattgcaattattattttaataaatgttacaattactataatttaaaatacttgcctgaaattaattctaatcatccaaaatacaacttctaatgaaattttcactcttgaatgtttactttaaatcacattgtcttccatatattcaatacttttgggagcaatgctgtggaatgtagaataaatatcagttgttgctattgaaaattgtgaactttaaaaaattttaataaagggataagattataactttttgcttatgatttgtaaaaaagaactgcagtaccctgttttacaaatatatgattgataacattatttggaaatgctatatataccaatcattttcaggtcatttgaaaatttcatgttttaccttaaaataagagaacaaatttaaagtgagccaactcaagtttattaagaaaaagtttgaggcagtttgtttttcagaataataataataatagtattatagtctcagattatgctttatgccaaactgtggtattgtcatctttggtttctggataagattttactgatgccttaggtattattttaataaatgtcataatttattataactgcttaatgcactcaaaattttgcaaagcttcttatactgtataattcagactaaaatttaacataattgtgatggtactttgaaaggcctacaatgttccatgaaagaagaatctgggggcaccaatcactgcattatctacaaacaatatgagtttttgtatcaataatttcacactttccccaaagaaagtcattttttcttgagtatcaacaaaattttatagtgttcatttagcttgcttgtcatttcaacattatgtattgtgtaccatcacaatagggggtgttgaagaagcccattacctactattcttgtcctccattgttcagagcataatgtagatagaaaatgataaaaacaataccttagattcctaagcatagggcatgatagtaatatcatagtagtgacattggaacccgcatgcaagtcattataaattcctgcccttatcatatacatcatacatgaaaatagaagagataatgagtgcaaataaagaagtggaactgagtggcattaatctcagtattgagagattttgtgagtagtacagcattcttttcatgtgctagctgaagttcccaatggcaaattgaatgctgcttatatcattatatgcatgaatgaatatgattgaaataatgcatatgttattatatcaaatccaatttcacgaatattatcaaccaactaaaaagtctaattgctgattagagaacttattatggaggttcttcttaatatgcttcaaattgacattgcatactggactatgtctcatttatgatttagggaacaaaatgtttgacagtgtgcacacacacagccatagtacacacatatgtctatatacatccataagtgcaaccaaatatatacaatatacaaaatgctatgcagtatatcagagccttctctgtgctcttcaaacttggaagaatggatagcaaagctcacataactctccaggaccacattttctcacttcctctaccttagtaaaacaattccacgcatggtccttgtctctgttgtacaatgttgtgtctccaaaacccagcacaaggcatgggacatgggaagcagtcagtggatcaccttagttcaagaatcctctgcttcagtcatgctttatggggccacaggtgttttgagaagatgctttagttatagctttaatgaagcaaagggtgcagcagagaaaagccaacatccttaccatgatcctaaggcagatgccctccctcacctacaactccttctccaaccatatatgccatcactgtccccatccctctctctagtgctgacgccactagcctctgcagctcttccaaataagcttatgcctcagtgacgttactgtacctggaaatcccttccacagatatctacatggcttattccctcacttcattcaaatctctctttatgaatcatcttattagagaaaacttccctgactacctacttaagtggtaccttccaatacctttttttatttattgaactttggtaagtttaagcatgtcttaaatatgtatttgcctattgtctgaaaaacacaagcacaataatgtaagctctaggagaggagtagtttgtcagaattgtactctgtcttactgcttagaattgagtgtagaaaatagaagttcctcaagaagtatctattaaaagaatgaataaattaagaagtgggtccctaacatccatgtcaagaaatttttggtgttgtttcattttgtttaacacaattgacttctaggtaaaatttcttttgtaataaattttctgtgtctaaaaatagtttgaatttttaaagtttgatttattaaaacctgtattacttggtagcacaaattctatgtatttttgatgatactgaggataattctatattaaataagcttacaaaagcaaaaggaaaatagtttgtaaaaccattctgacattcaaatactgacaaatctatttgcaaagataaatctaactttttgttgtagcagtagggtcttgataaaaatttatattattttgccagtaggctcatataaacctgaatctgatactttaaagcactttctccaaataaaattctacatagatctttgcacaaaagcatcaaagtcaagtggacagaatttagaagctgaaacaatgaaaacttctggctgaatgcaaactgggacgataatcagcactcttagggtgtgtgggcaaagagagagggaataaaaggatggagtacgcaaatggtaatcattctcctaatcaattctatcatatggagaaaaatagaaagacagacaaggaaatagcagaggctattgaagaccggccatatcttcatgaactcagagaaagagcagagttatgcaaggaatggccctccaacatgccatagcctgcacactagtgaatttgctatattctatgtcatggatactgataaatccaattgacaactcctctttctatatgaaggaatgagaaaaaggagttgttttttgcactgtgatgaatatgcactcgatatgtaaattaacccaatgattaatacaaagcagggagtagtagacgcttaaagaatagggaggcttagtattcctatgggaatacagacaaagagactttgacttttctagggttatatggaaagatttcaaagagaaagtgagatttgaggtagacagtgaaagttgggcacaatttgaattgcccagcgtccaggaaggcattttaagatgaggaaatattatgaactctagaggagaaatagtcaaagaacccatgagtatgtaagattggctggactatatttttcccaccgtttatttcagtttttttctatgtcatgtattgtatttagttataattaactattcaattctctcttatatatttgtcaatataaatatttgtttaacatacatttaaatataattattctaaggggctgtattttagattatgtttatgtttatacattagcttagaaaaatactgaaatccacaaaaaatagtatattttaagtaaaaggaaattaaaaccatataaaatgtcttattgttaaacttatgaaatactagaacagttacaaagaaacaattaaaatgatttgttagaaaacatcagtgacagaaataacatatgctgtctggtagaaactttacctccaaacagctattttcatatcgtactttcgtatttccttaggagacataataggttttaaactatgccttattactacgttgtgaagttgggaaaaaagaaaatagactgtgtatgtaactatagcactttaataaaacatagtgtaagtatttgtctaatttaataatgccaattaactgaaaacagtttctagtcaatttgtctgcctctggtatagcaaaaaaaaaaaaaaaaaaaaaaaaaaatctaagaaactatcatatgtgtttttaaaataaagtttatattttatgttaaaagagggaaaaaacaaaatgctacaaagcatttatttttattgatcttgagatctgagcaaatttatactttatgggaatcccagtagggaaaatagaaggacatctaaagttcatttcctcaaggtgggggaagtcttcttaatttgtcttgcattatatttattcacatactcatcagctatttattaattcatacatgtatttgttcattcattcagtttagtctaaactttgactccttttcacctggccctgtccttggtctaactcgggcatgacactttccaatttcttctgcaatacctactgcctgcctacctcattctgcctttctcattagatccgaattaggacctcagaagctcactaacctgcaggatatagacagtctgaattttggatctagcaatcgtgtaatttagatcttgtttaatggtccatgctacctatgctttcaatctcagactgattttctgataaatcaagttaaaattaaacaagtttgacaaattaagttagactgtatcttttatttccaaattcagctccctaaatactcattcataaactaatataccactattcatatttccatttttagctttctggcttctgcctgagcctagaatcctaaactcggacaattgtagctttgtccacttggccgatatttaatttctcaattaagtatatatttggcactgtgatgaagggactgtactgggatctgcacacattttcaaaaggtatgcatgcctttaattcctaagggcttaaattctaataaatggcataaaagcaatacataacagaaaaactatataattataaaatataaaatatatatatacatatttatattataaaaatataaaattttaatataaatataaaaataatagtgtaaatataaacatatttgtataaatgttatatatttataaaatagataaaatgtaattagagtgcgttataacaaactttgttgagtggaaggagataatgtattttaaatacatacatcttatacttgcaaaaactaaccagctgaagtgggagaaaaaagggattgaaaatctggggatctgaaatgattgtactgtaagatagataaataattagtgagataactgcctaaactgttccaagagagtgtttttaacccctttaaataaaccaagattattcatacaaatgcatgctatgagcacttgataaagctaacagacagaaagtcagtaaagatatagaacttgaacagcactatcagccaaatttccctaatggagatttatagtatactccacccaacaacagtagaatatactttcttcttaagtatacgtggagcatcatcgagatagactgtatcttgggccataaaacaagatcaataaaattaagatgatttaaatcttacagagtatgtttcctgaacaaaactgaattaaattagaaatcgataaagatatctggaaagtctccaggtgcttttaaattaaacaacacattttaaatagctcaaaggttaaagaggaattcacaggagaattagaaataatctgaccagaatgaaagcataacatatcaaaatttgtgggatagtgttcagcaaggttacagaattcaaagtcaacacacagaaatcagtcttgtttctatatactagccatgcacaattgtaccaacattttagatttttttaaattaaaaaaaaaaacattcaaaatagctcccaaaatataaatacacaggtataactctaacaagacatacaggatctgtatgttgaaaactacaaaacacttaagaaatctgagaagacctcaaaacatgaaagacatacagggtttgtggtttgcaagtcacaatatggttaaagatgaaaattctccccaaattaacaagtagattcaatgtaattcctatcaaaatttcagcagtatttttgtagagatggacaaatagttcagttgtgtagaatgtggagttctactattgcagctatggaagtaggcagtgcaaggctgtgcagctaacaggccggagtttcaaggctttgaactggatctaggtttgtgctgggtcaggttgtgggatagtgtcatatgatgaaactgttctgcaatagatttaatatcaacagggaaaatatgtattctacaatggattgagactgctaggacaataagaatgattctccaattagttactgcttgttttgtgggccctgactctgtagcttgggcctggacaacactaagaacacagtatccatctttctgccttttcatttatcaagagtgagttccctaatgtttacttgcctatgatcacccttcattctatatccccattgtctgccatacagaacataaaactaactcagtttgcggaatggaaaagcaagtgccagttgcattatatctacatttatgtctacgtttgcattatcacatggtgcgttatcatggggttttcctgcttttatttttcaatttctcttgcttctaaagctctaatttgatcaatccatttgagcatgcccttactaaaaatacctattccttatgacccaaccagtcctcatggcttcaggatagaccacagccaggaacagtcatatctgaaccactatatttacgtaagatatgacttctagtggaaacaatttctgatggaataatcaaaattctacttccttaataggcaaataaagagttaatactattaatatttagccagcattttgaaaattgtataatgttcaaatcgatgtcagacattttcattttatcttgattatacataaatatagggagtatatatgatttgcctgtagttatgtaaatgacagaaatggttaatgagcccagagtccaagcctagtattctttttatgaaaccttaggaagtacaatgttattaaatagtcatagcagtatatagtgttcatattgcaaaaaaataaaaattgccttgattttagaatagccactaattttatatcatatttgcattgatttcaataatttatatattattcctgagtgatttcagaaaggatctgacatggggtgatctttatgtctactagaaaggtgtccaatctaaactgagtaccttcccctttgacatttctacatctttatttgttgcttcaaaataagggtaattagaaatgtatgtggttacaaatggcagattatataaaaataatatccctagaaatgtgttttatatttacctttgaatattaacatatctaaatatgggtgctaaacttcccttagctaaaatactagagttgtattattgtggagaaagactgtattagagctaagaaattaatcacttttttgcaatacacgtgattcttaaacaatgcaatggttaggggaaccaactgcccacacagtcagaaatctgagtataacttttgacattcccaaaccttagctactaaatgcctactgttgactggaagctttactgataagataattgacacaaataactgataagttaattgacacaaatgtatattacatgtattatatactctgttcttataataaagtaagctagagaaaagaaaaatgttactaagaaaattataaggaagagacaatatatttactattcattaagtggaaggggatcatcctaaaggtcttcatccttgttatcttcacgttgagtaggctgaggaagacgaggaacaggaggagatggtcttgttgtcttaggggtggctgaggaggaggaaaatctatgtataagtggactcatgtagtttaaacccatgttgttaaggttccagtgtatgtttgctcaatatctctaagaagccactgaaaaaagtgccccatatggaatttgtaaaacagctgtggaattttgccgcttgaaccactttgtttcctcacatgaacttgactgatggaaacagcaacagcagtagcttacagggatggcagcaggtataggtctccccagtttcttccttctccaaatccacttatttttttttcttttttttattattatactttaagttctgaggtacatgtgcagaacgtgcaggtttgctacgtaggtatacacgtgccatggtggtttgctcacccatcaacccatcatctacattaggtatgtctcctaatgctatctctcccctagcccccactccccgtcaggccctggtgtgtgatgttcccctccctgtgtccatgtgttcccattgttcaactcccacttatgagtgagaacatgtggtgtttggttttctgttcctgtattactttgttaaaaatgatggtttccagcttcatccacatttctgcaaagggcatgaactcattcctttttatggctgcatagtactccatggtgtatatgtgccacattttctttattcagtctatcactgatgggcatttgggttggttctaagtctttgctattgtgaacagtgctgcaataaacatgtgtacatgtgtctttatagtaaaatataaatccactattttatggtttggcatcctcacattccatttattcatctgaatccatgttttccattccctggtgctcctggacccccgcacttgtcccacgctgcatttctaccttgtcctgatgctctgactgctagggatgaggcaatcatgagtcatgtacctacttagagccagtctgtattttagactgatttaaaaggagagcaataattaatgcaaaattgcctttcctgggacttttaatgggtggatttccaagtctttaccaagcaacacactgagctgtaagaagaaatggcaaagtcagtgtgataattaatctagtggttcaccactctcaaggggacattttgacaattgagagtttatttatttatttatttatttatttatttattcttgtttcagtgattcacgggcactgctgtcatgtagtgggtgcagccaggtaggccaagcatgttgctgcgagtagggcagtcctgcataatgaagacttgttttgtgtcacatcggacttcaaaatgccccatgcatactcataaagaaagaaaaagcctgttaatatattttacaatttttcttacattttattttcaaattttaatttttagcctaaaacccaagtccactttgaaaataaacacaaagccccgtttataaagttttactacatactgttttccaggaatgcaactactatttgaaccaaggtgatattttactgaattttaccagaaccttaccgagaattgtttagcgttgcagaaactcttctccgtgacagtaatgccacttgaatttgaatttcctagacagtacaccttaactgtttgcatttatggtcgtcacagctataatgaatgattccatatgtaggtatgagtcactgactccatcattatgtctcttggtgtagttgggcctgagcatatattttgaaaaacacattttttgatatatattactgactacattttttacattaaagttaggttaatatatccatttttaaaattattatctgttaatttcattttgatatagtagatgggactttaaacatatttgttttctaaaggaacattctttaaatttgatgatttttttaaatcatagaattaaggattactgtttgaagaaattaagcagactagtaccgaataataggtgcaaaaattgcataataagttatttagctgaacaaaatacatgctaattacaaaagcctgatgattggtttgtaataactgacacacttatatgcatcagtcgatatttctatcatgtgtaaattgtgctacatacagatgataaaacaaagtcatataaaagttggccttataatacagatgtctaataggcatataagtcatccttaccaactttcagcctgctgaccagtcgtgtaatgaaaatggatggcacctgaatgagaaaacaattatgtggctatctgaaggagggtggtcataccaaaaggatgaacaaaatacttcaagcaaaactaacagcaacataacgagctaagaagtgacaggcacaaacacaagtggatcatgttgacttgaagcaagcagagtttgagctgtttcactgtctcattgaaacagaagagtatgctcagcgtgaaactaagagacagcttacagagaatgacaccctgcaggtagcagctgctgctgacacccaacgggcagaatatagagaaggtatatttgtttatttatgcaatttgtgaggaattgattgcctgacataattcacccttttcagacccatgcttataactaggaagcatcaaggtcaatatcccagtcacacagtgcaaaatattttgccatatgtacaggattgaatgtaatggcagaagtcatttcaacaggactgctgtcaatatatcatttgcatatgtacaaataatttgttaactatggttgttcttaacatattcacaagtaaaccccctaaggcataattacaatagcactgcctattcaatccctatttttgttctggaaattatacctacattgagcctagttctaggttcaggccaaaaaacaagggatatgcaactttaaggggaagaaatactgactccataaatatccatatagctttttaagaaagatttgcttaataggaaaacggtgttttctcacgtaaaattcaggttttgtttaacaaacatattgaatccaaagataaagtatagtataaagtaataggatgtgcttctgtattgaaatactggtagttttaaattcttgacatgaataactggatatggcatatgtaaatctaccaagaaataaaacagaggtcttaaaatgtaaagacatgataggacatatttatcaccccataaaacaaactggcattttcatatcctaagctggccactttgttgtatttgtgtatgggtcctcactacaaagttctgtccctgatttgggaacatcacacatgagaggtaaaaagcacatggtagatgagggatacaaataccattctgtttatgattctaacagatcgatttgtgatacaaaaaccatgggtagaatttgagaataattagtgtgatacgatgttataaatacaaaggaagtatgtgtgtgatttttttttcaaacttggttttctatttcttacagacagtagttttctttgaaagtattaattagttcactgtttgtgtgattttatgggcaggaggagtgactatccattgtgatggcagtaaaaggtaacgtgccctaatgtagttcatagtaatgacgagggacacatgccaggtgacatattttaatgaaatgttaaatgaattaccaagaaaaaagggaacttaattttcaatatgaaaggaagaggccattgaataaataaagtggaggtgagataacagattctcaaaggattcttaaaaatctgccatgttatatcattctggtcaacagaatgattcatatttcattaactgattatagataaaatattagatcctgttacaagttatgtgtcttacagttcagttattattcacataggtatttcagagggagaaaatgattttccatcctttttttttttttttttacaacattaggggaaaataattactattaaaccttctgtttccattcactggatctgagatgaagtggatttccttacatattcatgactgctttggttaaataccatctattctgaattttattctccatattacagctataatataaaggaaataaatatgctttccttaaatgtatcaatggagcaaaaattgtttttataataaagaacaaatccaaagacaggcaattcagttaatcatataatttaaaggttattgcaaggtcttggataaccctgaatatttatttttccaccagctcactatcttatttgcatcttttcttatgtgttctaagatccctgcaactggaataatttctcttgataaaagaataaagaaaagatttaattatggtatttattattgtattttgaaggtaaatattaaaaatatgctttgatggaatgggctcaagagaaatgggaatgaggatgctagttgagaagacttctcatgcgtcctcctcatttcataagcatagattaattaaattaactagttgctcaccaaagcctgacataagaatgatgaggtgcagaagccactaagttttaatgtgtgttaaaaacagcagcaaaaactgttaggggcttagtgagtatcatggactatctgcaggtgggtttccatggaggaggagcccaggggagccccaaggaagtataaggcggggtggggctcaggaaaagcagatttaaagcttgagagcaccatgctgtgctgatattatagcagagaaaaaaactgattttacctttcctaactcctttctcttcttgccatgaatagcatatatggaattacttttaaatatgtgatgaatacatgtatatccgtgacacatgagtctctgcctgcaaatcagttatgtaagaaatatggcatttccttgtttactagaagtcaagctaatttagacatgactctctttcttatatgtctagctagaaattctaccttagtcattcttagggcatctcttccctatggtggtgccaagttcctggagccttattctacattagtcatcaggagcccttcctagttgttggtcatctgcccactgctgaaataaatgttcagtgtcccagcttcatggtaatgtgccttactttgttgttatacatggaccatctttggatgaagggtgaaacttaggactaggatccagcctctcagatgaatcctgtggtgtttccctctgagatctggctaccttttccaggcaatgcaatagaatgatactaaattctttccttctcacagagcctgacaagcatacatacccctttcctactccaagggaatctacctcactctttctccttgtccttgaaagcttccctaaagccttctcttctttcagagataactagcatgagcttagagtttcataaaagatgagaaacacttctgactccaggtagtttctggtctctgtccatccaatattccagaggcaaggaattacaaagcctgtttccctgcttcactggaaaaaatagggggaaatcaccaggagtataaatgcaaattagtatttcaataaattatactaccattgaggaagaatctcacacatttatgtcaccaggaatactgataatgaaggaattaattccaaaatacaattttaaagcagatacctaatggctaagttctgacaaagagtatagatctgatttgtgcattatgcatgtaactatttcagagacatggaaattaaatcatatttaagacatatttgatgtattatatttactgaaaataataaaattctgtaaaatcaggactgtcaggaaaagtcagaatgtagccactgtactcagttatagaataaaagcagatatatcttggccattgaatcacagtgccttaaaataagatagtaaagtaatgaggaagctctcctactaatgctattctttttttttttttttttttttgagatggagtctctccctgtcactcaggctggagtgcaatggcgcgatctctgctcactgcaacctctgcctctcaggttcaagcgattctcctgcctcagcctcccaagtagctgagattacaggcatgtgccactgggccaggctaattttttgtgtctttagtagagacggggtttcaccatgttggccaggctggtctcgaactcctgacctcgtgatctgcccacctcggcctcccaaagtgctgggattacaggtgtgagccgccgcacccggccctactaatgctattattctaaactaattgccctttctaggtttgcctgcctggattgtgttttttaaatattttttcttatatgttatattcttgttagatggctagaatgctctagggtctggaaagagggacaacatcctttgggtaaatggaaaagttgaactaattgagaaaaatattctgtgtttaaattatgtttgccatttttagtattttcatttttagggactacatatgctgacttaggaagttcaagctaggtttaattttcttcctttgatagcttcacataacccacactttccctccaaatattcctcatctttcacctttgcttatagttgttatagaatttattaaagagtaagaagaaaagaaaataatagacataccaggggctcaggaataatactatatagaaaattacatactgttggcctttagtttttgaacatgattaaatgtgaaatattgctataaaacttttattcagctcagaagggttcggcctacataacagaaagtgggagataatggggaactaattttccaaaaacaaatttcttattttatcattttgtataaagtcatttctgacatatcatggcagcaaaaacatgataaataaagtcaacagtaatgttgtgtacttgatctactgtggcaaaactgaaggtcccctgttagtcctaatatattttcccactttctttttaacagtgaattatatcctcattcaaacattaaaaaatactcttttgctgacattttaaagaagaggtgtccaatcttttggcttccccaggccacattgaaagaagaagaattgtcttgggccacacataaaatacactagtgatagctgatgaggttataaaaaaattgccagtctcataatgttttaaaaaactttagtaatttatgttggaccacattcagagtcattctgggctgcatgcagcccatgggccatgggttggacaagcttgttttgtaacaacacagtggaaaaatggaacccttacattgataccatcaagaatggtaagcaaggtatacacatttaatactcttaaggagcttacattcttgagaacaagagtgtgaattaaagtcagaaatttcagttaactaaattatactgttagatgagaaaataaaaactaaaatactggaagtttctatagtctttactgggcaatcaattattgtgccctttttgttgatcatgtgattaaggtaattaaaatccacgtaaatctcagcaagtatatttttaaacaatagattcaaaatttcaagatgaattccaaagggaaggatactgcattgagggttaaatactgggaagtgatatggtttggctttgtgtccccacccaaatctcatcttgaattgtactcccataattcccatgtgttctgggaggaccaggtgggagataatttgaatcatgggggtggtttcccccatactgttctcatggtagtgaataagtctcacgagatctgatggttttatcaagggttttccacttttacatcttcctcattttctcttgctgcctccataagaagtgcctttcacctcctgccatgattctgaggcctccccagccatgcagaactctaagtccaataaacctttttttcttcccattcttgggtatgtctttatcagcagcatggaaacagactagtagagtaaactggtaccagtagagtgggatgttgctgaaaagttacctgaaaatgtggcagcaactttggaactggttaacaggcagaggttggaacagattgaagacaggaaaatgtgggaaagtttggaactttctatagactagttgaatggctttgaccaaaagcttgatagtgatatggacactaaggtccaggctgaggtggtctcagatggagatgaggaacttgttggaaattggagaaaggtgactcttgttatgttttagcaaagagactggtggcattttgcccctgccctagggatttgtggaactttgaacttgagagagatgatttagggtatctggtgcaagaaatttctaagcagtaaaactcaagcgatgacttgggtgctgttaaaggcattcagttttataagggaagcagagcatgaaaaattcagaaaatttgcagcctgacaatgtgataaaaaagaaaaacccattttctgaggagaaattcaagccagctgcagaaatttgcataagtaacaacgaggggaatgttaatccccaagacaatggggaaaatgtctccagggcatgtcagaggtcttcacggcagcccctcccatcacaggctaggaggcttaggagaaaatggtttcatgtgcctggcccaggatccccatgttgtatgcagcctaaggactttttgccctgcatcccagatgctccagccatggctgaaagggtccaatgtagagcttgggctgtggcttcagagggtgcaagccccagtccttggcagcttccacgtggtgttgagcctacaagtaaacagaagtcaagaactggggcttgggaacctttgcctagatttgagaacatgtatggaaatgcctggatgtccaggcagaagtttgctgcaggggcagggtgctcatgaagaacctctgctagggcagtgtggaagagaaatgtgtggctggagcccccatacacagtccttactggggcactgcctagtggggctgtgagaagagggccaccgtcttccagaccctagaatggtagatccactggaagcttgcactgtttgcctggcaaagtcacagacactcgatgccagcccatgaaaggagctgagagagaggctgtaccctgcaaagccacatgggtgaagctgcccaagaccatgggaacctacctcttgcatcagcgtgacctggatgtgagacttggagtcaaaggacattattttggagctttaaaatttgactgcctcactggatttcagacttgcatgggccctgtaaccactttgtttgtgccaatttctcccatttggaagggctgtatttacccaatacctgtacccctattgtatctaggaagtaactagcttgcttttgattttacaggctcataggtggaagggatttgccttgtctcagatgagactttggactgtggacttttgagttaatgctgaaatgagttaagactttgggggactgttgggaaggcataattggttttcaaatgtgaggacatgagatttggaggggccaggggtagaatgatatggtttggctctgtgtccccacccacatctcatcttgaattgtactcccataatttctacttgttgtgggtgggacccagtgggagatcatttgaattatcagagcggtttcccccacactgttctcagggtactgaataagtctcacgagttctgacggttttatcaggggtttccgcttttgcatcatcctcattttctgttgctgcctttcactcctgggccattattttgagggctcccctaccatatggaactgtaagtccaatgaaacctctttttcttcacagtcttgagtatgtctttatcagcagcatgaaaacagactaatataggaagtaatggtgtctcttcagagaacacgaagatttgtcgtttcattaaaaataaatatttattgagtacccactctgggctagctatgtacaactgttaagtgatggattgtgacatataaggccagagtcctcatggagtgtttaactctacacagggctgacaagtgtaagagggaacaagaacataaataaataagctaaattcagctagtgattggtgctaaaaaggaaataaacaggataatgtgatagtgatgtgtgttgtgggtccattcgggtttctagctctttatggtcagaagatactgagctttgaaggcaagctctgcgcatgaggaaacaggtgggttaaatagattttttttttctctgacaatcaagcccctggataacctaagcgttttcgccttcatttcagccaggctttttctcctttattctatgcttgctgggccctttactctctaatagccaaactactagagctagagatcttgcctttgtcattaacttttcctgttcccaatatctgctttctaagatctctttcaggaggtagatatggaaaggaaaacagacataaaatttgaatgtatcattgtggctacatgtgaacatattgcattaaattaattgatagaaagaagtttgaataaaatattttagaagaggtttttgaatttagagtttatgaggttatacttctttatcaacttacagttaacaatgaagttattcccaagcatctttaaagctaatttatttccttttgtgtttaaagttttttgaaggaaatatatgcctcaaaacaattctgttgaccttttctatctatctatttatctataaaacaaaacattaaatggttccttgatggttttaagtcatggaatttttagaagctaaaagtgatttaactgcagaacattaaaaaacagcactgtatgattgaaactatgagctttcattctttcttacccaggtctggggttcaggcacatgaaggattgactttcatagttccacatcataaggcacagattgtaaagtatatgtaaccattttacttagtctattaactttcagaaacccaaaccaagagaatcactcagcaatgtgacatttcacttttagctcttactgtcctttataatattcaggtaaaataatattttaaactagtttagactgtggcacatgcagtacataccttgatggtacggatgacaggcatcaaacctaaactctgtaaaaaatctgtgtaaataactcttattttactttacactgaaagtaaagtaaaataaggactcaatggtaaactatttctttattaatacacacattcttattttacatttcagagtaaagtaagagtttgtgcgtattagtccgttttcatgctgatgataaagacatacttgagactgggcaatttataaagaaaaagaggtttaatggactcacagttccatgtgtctgaggaggcttcacaattgtggctgaatgtgaaaggcacagcttgcatggtggcagacaagagagaatgagagccgagcgaaaggggtttccccttataaaaccatcagatgtcttgagacttattcactaccaagagaacagtatgggggaaactatctccctgattcaatcatctcccactaggtccctccacgacatgtgggaattatgggaactccaattcaagatgagatttgggtggggacacagccaaaccatatatttgtgtattaataaagaaatagtttactattgcatccttaagaattgaggcacttacatatagctcacattcattcttactcttctgagtctcagtatcaaatgggctggattaaaaataaataaaaaacaaaacaataaataaggcaaggggaactcaagtgaacacatggataaaatgattagataataaatggaattattcgagaaatattttaaaaattagtgtaattataaaaggtaaataaattctagataaacactgtattaatcagggttctccagtgaaacagaaccaataggagaaagagagagagagagatagatgcaattatggaggcaggaagtcccacgatgtgctgtctgcaagctggaggcacaggaaagccagtggtacagttccagtccaaacctgaaggtctgtgaaccaaggcagtcagtgctctaagtcctggtccaagttcaaaggcctgagaaccaggagctctgatatccgacagcaggagaatatggatgtcccagattgagcaaagagcaaactcaccattttagttatatttatgccctcaatggattgaatggtgccctcttacattggcgagggacatctcctttactcagtctactgatccaaatgttaatctcttctagaaacaccttcacagacatacccagcagtaacattttaccatctggacatacttatcctggtcaagttgacacataaaattatcgcattgagaatattaggcatccaatagtggtgtgcttgcaagcccactctcagaataataaaggcctcgatatgtagcatttgacaacttccgtagtgtaaataccctcaccataacacatttcagaggatcaacctgaagttgctgaatgtgaagttgggaagcaatgtataccattttcccgtgtgaaccagtacgagtcaactgcagtgtaccactgtattagaccagttaatatatttaaaaatgtttctaatccacagaaatggacttatctgacactgtgggagatcggttaatataaattaattttctagatagtggccatttcacctgtaagcaaatagtgtctatttattaaagataatttctatacaatgtatatgttttctgcctatagagcataatttcatcaattcttgatgatctaagttcctcagttgatattaatcttatgtgaacaatcaggaaggtagtataatggttaaaagaacatagtcttaaaccaactgtttgggataaaatcctgcctctactattgtgtaatgttgagtgttactcaggttccttctacctcagtttccttctctgttaattggggaaattataagtgttgttagttcttgttattcaaggcagttatattctataaagtcaccacaaacactgaattagtaaatactggattattgttttgaggggaaatacaggggttaatttcctggaagctgattcatcaaccaatcaatacctgcattgttttgtgtatgttcctatttaaagataatttatttaatatatatagttgaatcattaacatggaccacatagacaacagcactatcacttgtgtgtgaacaaagcttactgacaaatgtacgttctctctaagacacatcacagcctttttgcatttaggatcactagacagcacatagcgctacagccaagggctgttttaaatagggaaatcaccaacaaaaaatcacagaagcatgaaaaacatggcaataaatagactgttaaagccaccctgtttatagtatgagagttgaaacacaaaggtagggctttgcctagtttcaacacaaatgggaacatgcacatcaggtgactcaaatttttcaagcttctgcccatgcctgtgtctacaaatgagcaaaaagggctgtgagtataatttgggagttactgtcaaagatcaacaaagctggacactagttaaagtggtaagatcaggtggtaatcagtaatatactgctgcagaagggaagagggtctggcgtgacctgaattcaacttagatttgtacaaggaggactgggcattttaaagagagaattgtagaatagggagaagggtgagcagggactcagtagagtcagggtagcaaaaaattacaaagtgttggtcactgtaaatgattcaatcctccagcagagacggggaggcaagctgttcctcctgatatttacattttaagagaatggctttcaggtcctttgagaaacatactccttaattgtaggagacacataggtatctcaaagggataaaggaaggatccacaattgtaagacctttgtagtaaatgctctaaaaaaggtgtcggggcttatcatcaggtgtgggctagagtagtcgattcttttggcagccctaaaaaaggtgtccgcggcttatcatcaggtgtgggctggagtagtcaattcttttggcagccatgagcttccccaggcaggatcttaaatggggctgggtcatcctagggatgcaggcttgatctagtgcttattcaagtcttttcataggagggtgggagaatttcatgttcgctgacagcctgtagattttataggccaagcatgagacctagtcagggagttccgaggagcctggctagcatttgagcaaagagagaatatttgtgattacaaatatattttattaaataggcaaattcgcaaatatgaaatcacaaataatgagggtcgaccgtattttcacattgttgttatttaattatgtaaattgcttagaacactaagcactcaataaatgtctgcttaaattataatgtaagatgtaggaagtgttgagttataaagctgtttgttttgatctttatcagcctgcctcaggttgctattttaatatttggtcttctttttgttttatattttcggttttccagtttactgccaagcttccactttttctcactgttagtttgtgctactctggccttttaaccccagccctcctgcacccatattctttgcgaaaatgtttcagttgactatttaacaaggctgagtgaggacttgaaggcactctgagttgctagctctactatgatcattttatttgttcaccttttgcttttagacccaagatcctgcccgtgttccaggtacttgaggttgttaggggtctgccttttatgtgaggtggatttttatgaccatttgggaacaatgttcaatttattagtatatttttatcatcgagggttttggccaagaacttcttttgtttaggagctgtggcctggccatgatccaacctggctgagatgctcagaccacgtgattttcatacagacacagactgtggtgaatcttatggtagagcttgcggcagactccatggtagattttatttagatctcacgtctccactgaataaccaactgaatttcatggctacaaagaaaggaactatcacatgatgaattattttatattatttttgacaatataaaacaaataaatgttttcattataaaagtattcttgacttttgaagtaaaatttgggtgtcactcgaggactttgcctggctaaggtgcaaaattcttgtgaattttaaaaatagcttatatataaacctttacagaaaactaggaggtgaggaaaatccctcatgaacttggatgttatgaattgcagtctagggatttaaataggtttcacttatgttcatgttggattgttagagtaggtatttcatgaataattttatctcagataaactcatgatagattttatcattttattttggttcaattatataaatgctatttaaaatccagctcttactaagggttaatatggtaatgaattctagtattccctttgaaaacacggatagatattttttaatctttttttcatgttcacttaaaaaatatcttgctactgtctttatatcaatgtttcataattctattagccacattttgttgacctgcatattcctacaagcctgaattttaagttacaactttgtattcaatattagtagtattaaaacaaacatatcaaaggaaataaaaaccctaaaatttaatgtttcacaaaggaactctgtgttaaaacagtgtccttttagagttaacatatgtatgggagatgcattttaaataaagatgtatctgacctggaagagtagacaaatctgctttacagcaagttgaaagtttagagaaatatttatcattcagttaccaaaataacaaattaaagcagcaaggaaagagaaaagagaggagatgaaaggaaataaaggaaaaccaagacgtaagttaagaaagagctattgcttgtgaacttcttcctaaaaaatgatagaaaaaaaagataagaaacagaaaattgcatgagacttcagtgtttatgttttgatggaaatgtacaaatcattttcattctttgcagtgctgtcatgctccatcactttagtccattttcaccttccaaagaaattctgaatgggccttccttctctggcagctaattaatctttcacaagcctactcttgcagcctgtctgccagggatgccccacaccttaagccagtgactcacgagcagatttcttaccctcttgagcagtactttcttcccttgagctatgtgaagacctagcttttctattttgtttcggaaactatgtgagctgtaatatatcattgaagaattgctccttcccccccaccaccataagtgaatataaagtgttcctgaatcatttaattgggtaataatgacaacaaagtctgaatataaattatgaatgtgtacagcattttaccaatagtgtatatcatatagatgtaaggacacatattactagattataaattctctgtgtatatacatttgttagattatcattgtaataacacaaatgtacttatatttataataatgttgcatttgcctaaaaatactaataaaactgcaaataaaaataatttttagtctaattaatggaagatttggtatatgaatttttttttaagttagagcataattctttacagattgaaatgcctcagttaaaacaaaacaatatggccagggatggtggctcgtgcctgcaatcccagcattttgggaggccaaagctggaagatttcttgaggccacaagtttgagaccagcctggacaatatagcaagactctatctctacaaaaaaaaaaaatgtgtgaaattaaaaagtttggtatacattctttttgtatgcaaatgtttccatctgttgtcatttcaatttaatctgaataacttcttttcagcctttctggtagaaaacatctgctgtcaatgactttatcaggttttatttatctaaaaaatgttttattctcgttattgaaggaattctgggctgaatattgaattttcagccctcaaaaaagtgatctgcctccattatttctgttaaaatgtcagttgctatttgtataattgctctgcacattatgtttatctgtggctgctttagagattttgttttatgttttgcttttgacagttgactattatatacttaggtgcattctttctgttgttaagcatgtttggattttgctgagctttttcaatcttgatatgaatattgataggaatgttgacatgaaaaatatcaatgttgatagttttcattaaattgcagaagattttagccatcatttctgcaaaaatatttctacctcatctccctccctccttctcttcacccctctctgataacacaattatacttatgttagaccttgtaatatttttctactgattattgagactgtaatccatggtttttcaatattttttctgttcttcaaatcagataatttctattaatctcttttcattctcactactattttttccttcagtacccaatctgatattttgctcacccagctaacattttaatttcacatttacttatccattcttacatagacctctttttttatggtttgcagttaccttctgagattctctatctgtgcacccattataactatatgtttctttaaatctttgaacataataataataaatcatttgtagtcttggtctttgatttccaatgtttgattcagagtctgttctgttctatgtatttttttatttttcttgtgtatggattacatttttacctttccacttatgtacatatgtagcatttaaaaaaaaaaattacatgctggggctgggtgtagtggctcacgcctgtaatcccagcactttgggaggccaaagtgggtggattacttgaggtcaggagttcgacaccagcctggccgacatggtgaaaccctgtctccactaaaaatacaaaaatcagcctggtgtgctggcacaggcctgtagccccagctactccagaggctgaggtaggagaatcgcttgaaccggggagacagaggttgcagtgagccaagatcgtgccactgcactccagcctgggcaacagagcaagactccatctcaaaaaaaaaaaaaaaatacatgctagatgttgttaatgactaatttggagaaatctatattaggttttctcctggaaaaggtattgagttctgttgtaaggagcagtttaattatgggaagatcatttttgccctttcaggcatagttttattcattggtagtagaactctacttttgttttgaatttagtttatgaaccttacccgtacccctatagtggagcctttcttgaatctccaagtgagagtctgagatatgcagtaaattatctccacttcacccaggattaaactccagagtattctttctagcagtagctaatctctggtatcattgttcagcaatcaaccatagagcaggaaatctctgctagaccttgtggaatcttactctatgaaaatgccatctagacgttcgcccaaaattcatggtgaatcctcacacaaactactgccattcccagctcagctcccttttgtcagctaccctacactccaaattttaagcaactcagaagcccagacttttctcgctgcttctcaactcagtgaaacttcagttctactgggctctatttccgtatttgatagtaaaaagtgcatccaagcagaaagtcatggaggttacagagctcattttgagtttttccttctcttaaggattatattcctgtgctatgtttagttcaatgccagtaaaaatttactttagataatgtgtgtaattttacagttgcttattataagagaagtacagaaactggttactttatcacagttggaagcataaatcctaacaagccatttttattgttagataaaagagataaagcagattgccatagatgaggcagaatgagggtcgtgagggaggcaggctcattgagagttaaaatagagcctgtgatgctacgggtattgcaacatactacatacatctgtacttgaaagtaaagcaaaaaaatggagaagagatacacgtcagggattgggtcaacagcacacgaggtgaaaagattttgtaggagacaacaaatctgaatagaagtcagtgcctttctctccttctgccaattaattttcccaccttttgccattaatctttagaaaacagctatcccccaatagctgtcctcgtaagtcataataaaaagaaaccaaccagattttataaagaattgcaaaaattgaagagtaaatgaataaaactccaaatttcagtgaagaacatgaagtgcataaaggaatcacctgagtaaagatatgaaatcaataattcacacaaaagtactctgtttccaaagaaattactgaaatgctatattttaaattgtttttatataataaaatgtcaaaagagttaaaatattttattatgatttgtaagatgatagatgcaaataaaaagcagactgaaaaagatcaggaaacaagtgaactagaaaacagaaataaaagcttttgattgctcttcccctacccaacacacaaatagaataaacataattgagagttataaagaacagatattaaaaatgaaaaaaataagaattgtagagaaaatattaaacgtaaaggcaaattagacaaaaaaggacatagtgtttctaaacaaaataaatggactaaattgaggagaaagagaaaaaaaagtcacaggggaagaaactttcctggaataataaaagtctaggcataataggtggacctttccattagggtatgctgtgctaaaatttctgaacttcagtatttgggaaagaaactgtaagggctcttgggtgtaaacagcaaacgaaccccaaagaaggttggatgggagattggagagactagactgacctcagactttgcagtactctaacagtgaattgtttctccacaaacatttgaggaggtcaggtgacccaagaaattataaccagcgaaactgctgttgaagtactgaataatcattaaactgtataaaagtatggatgcagaggattaatttaaacatatattaaacactaggaagatggggaaggagggacgctgagtttgagctttgtgattacagatcaaaatatgtgatgatttttgatattctaaatttaacaataagatttttttaaatttcagaggtgagtaaaaagaaagtgggaggaacataaatacgttattttccttttttcactatactttttataaatgaaatgttattaaaataatatactttaatatttttcttaatgttatcttttagatagtgatagatcttgtcttgtagtaagaaagtatctacgtgactttcagcaatgcctttagttatacttattttattgttaaatttcatataatttaataatttaccattttaatataataggaataaaattcttaatttttatctctctctttttctctcccacctcacctctctgtctctccatagagctataactacagtaattatactaatatttaaagatgattatttcaagatagtgggctttggaatagaaacttaaaaaatgttcatacttacatttttagattcattaaaaatagcaggtaaaatttgtacataaaacagtaattttttaaaagaaaataacttattctgtaagttttggcactctcctcaaaaaagattaaatgtcataagtaaaacccaagtatactcgtaaatattctaatatattggtatacttcttgggtcagcaaacttttcttcaaagggctatgaattaaatatttttgatttgtggaccatattatctctgttgtggctatgcaactctgttactgtaatgggaaagcagcaatagacaatatgtaaacagactggcatattccaataaaactttatttacaaaaataagcagtcagttctgggtcgtggtttgttgacccctggtatacacatcatcaactttagtgattaaaatattatcagcctatctgtgaaatactgaggtaaggaaactaatacaaaatattcctgatgtattgattttatattcttgctccaaatacttattactgtaatacttagctttgatgagaaagggaagtgttgctaaataatttacatacatattcatatacatgcaaattttcatatcttttgatgtctcaaaaatgctgacatttaagaaaggaagggcatattttgcttcttacagttcatatgtgctgtactcaagctgacttcttccttcccattttacatttctaactttgatctcagaatgtaggagctggacaggatcaccgagtgcatcaggtaaataatttcattcacacaagaagaaaatttacggccactaaagttaaacggttaccatgctagttcttgccaaagtcaggactggaattcagtctcctggctcccattgcagagttttgcccactacactatattattgtacatggcttggttcaagccacagaggaactaatcaaagattaactatctgatttatacatatgtatatatatacttacttatatatatatatttttatacttacatatatatatatatatatatatatatatatttttttttttttttttttttcctcgagagggcatctcgctctgtcacccagtctggagtgcagtggtgtgatctctgctcactgcaacctctgcctcccagattcaagcgattctcctgcttcagcctcccgagtagctgggattacaggcatatgccgccacgtcaggctaatttttgtatttttagtagagatggggtttcaccatgttggtcaggctggtctcgaacacctgacttcaggtggtctcctgcctcggcctcccaaagtggttggattactgacttgagccacaatgcctgggccaactgactgattattatattaggaatgcatttatattgactcctctgttctgagtacttactagttatcctgattctatttgttctctattttaaaagtaggtttataaataaagttatttaagagcaatcagtcattacacatgaggagtggtattgctctatgtatactccgtttcattgagaaacagccttttcgtaaaatggcaaaaaaaacacagctgcagttatccctttcttctgggtcatttctaatagtttagatcagtggttctcaaactttaacatgtatcagaatcacttgaagagcttgctaaaacacagattgctggggcctcctccagagtttctgattcaataggtttgggatgacgcctgagaatttgcatttcagacacgtttccaagtgacagtgatactgctagtctgggtaaaaaattttaaaaaccactgggtttaaattctcagccctaaaggcatattataattaccaggagaggcattaatccactaattaattcccaggctccatcatcaattggcatagaatgtctagggcttgagactgggtatgagtattttgtcttttttttttttttttggtttaagtaattaatcggtgcattaataattgtacatatggggtacaatttgatgtttcaatacatatctgtggtgtagagagatccaatcagggtagtgactgtatccatcacttcatgcatttaccacttctttgtggcgagaactttcaaaagcgtttcttctagctgttttgtaatatacaatattttaatgttaaccatagtcaccctactgtgcaacaggacaccaaaatttattcctcctatctaattgtaactttgtacccactgaccagtctctccctattctcccgtctcttttccctcccccagtctctggtagccactgaagtgcctcaggtgattctaatatataaccaagtcggagaagcaattaagaaaagtaatgactgaaaaagtttattttgtctgatgaattagtgcaaaattttttaaacatattcctctattatgtggggataatttttatactgtcatttcatggtaaagtataaatgagatagtataaagatgactttaccaagtgattccataaattgaaggtaatttgagtgtagttttatgctactaatcgtataaagtgctgagaatataaggtagctatagaattttacttttaaaatgttgttattgtaaaatttttgccattaataaaattatttcatgcctcagttccttaaattatttttattagcattgtatagacagcatagatactaactcctaaaattcttaatttctctctttatagtgaaagatgcagatgtactttgtatggacatacagattctgtgaacagcattgagttttttcctttctccaatactcttctcacaagctctgcagacaagaccctgtctatatgggatgcaagaacagtaagcaaatcattcactttttttcccagcttttgataagtctgattactctcggtcattctttgggtatggaatatgacttaaaaagtgattgtgcaagggcattcagggcaaaagaacagtaaaaagttcataattacaagatcctttctatgcacttgtatccattctgccttccaaatgtgatcaggtaaaaataatatgattatctcattaagcattatttcaacaattatttattgcgatagaagctctgctggttcatgggatacaaaagggaaatacacactgtgccccctccttaaggatcttttagctaggtaaaggaagagaaacgagagattattttgatgaaatgagacatgcgttaataaaatggaagactatctaaatacagggggaaagcaaggaggaggattcatatctgctggaagagtgtggatggctttcaaaggagcctaggcttgagctaagatctggagggtaagtaggatatataggtcatctggagaggggtagatttaggagagggcaatacatgctcaaagccatagagatgtgaggctgcaatggcatgttctgacagtaatgatataaatggaaagagcttaaggaaaaagaggcatgataggcaagaatgtacagagacaaaacaagatcatgacgtatttgattaaagtcttaaactatttccgagagaattaaagagcattaagcaaacagggtgacataatcggatttaccttgtcaactgaagagtgacaaggttcataaatttggaaaataaattcctcataaggggttacagtctgcagggtggccattcggacaagctggaaagcatagcctccagccagaagccagaaatagatacttcgagggaggagcaaagggaacaggaatttatgctgagttgggtatgtgaatatttcataagcttgaggaggagtcatgactatttatgaaaggtgaatcatgcacatgcacagtatacattcatgccccttcatgggtcccatgtaccaaaaatggcagttttagcatgatccaaggctggagttttcagccgcctaacatcggaaggtgaagtggaggacatgaaaacccttactgcacatgttccatggactggccagacccacttcatggtcagtggtctcttatcaggctaaaagaggaagggcagtatcaggtggctggttgatatcagtattgaggtcttttgaaagggctggtttcggctgggtgcagtggctcacgcctgtaatcccaccactttgggaggctaaggcaggtggatcactggaggtcaggagttccagaccagcctgtccaacatggtgaaaccccatctctactgaaaatacaaaattggctgggtgcggtggtgcatgcctgtaatcccagctacttgggaggctgaggcaggagaatcgcttgtatccaggaggcggaagttgcagtgagccgaaatcatgccattgcactctagcctgggcaacaagggcaaaactccatctcagaaaaaaaaaaaaatcaaagaaagaaagggctggtttctgtttagcacttagggaagcaaggctaatggtcattttggagggagggagtatgaggaggcttgtctgaacaccatcctgtcctggctgagagctcagttttcaaggttactctggggtcctgttggctaagagatgttccattcagttggctgggggagggccttagaattttgcttttatttgtcccctttttagaagatgattttgataaggaagtaagagagtcagtcatgtgaggaatctaatataacaggctatgagtggatgagaatttgagctaggaaacagcgtagatgaaaaggagagaatgcattaagcataggaagtttatccaaatttggagagtgattggaggtgaagattatgtggggaggaggaggagttcagggtgagaaacttttccaatttgtctaggaatgagggttttcctgagtcatgagattttcagagctaaaattggacagaactggattactggtaggttcaagagtgaatttgattttaataaaagtgttttagtctgttctcaccctgctgataaagacatacccaaggctgggtaatttataaaggaagaggtttaatgaactcacagttccttatacctgtggaggcctcacagcatggtgaaaagtgaatgaggaagcaaagtcacgtcatacatggcagcatgcaagagagcatgtgccggggaactcacctttataaaaccatcagagctcgtgagacttattcactatcacgagaacagcatgggaaaaactcacccctgattcagttacttcccaccaggtccctcccatgacatgtggggattattacaattcagggtgagatttgggtggggaacaaaaagccaagccatatcacaaagtaaacaacatgtagggactacactttcaaacagtttggctgtgaagatgaataggagaaaagattgtagctctaagatcaaataaaggatcctcctttgttcagataggagacagcatgtttatttgcttatgggtaagatcggggagatgaaatgaaaatgtaggaaagagaaaagataacagagtttattgtgcacagattttcataacttgaagaatgccaatatgtgtaaaacaaggcctccatattcttcttagtgatattttataaagatcacaagagaaacaatgactacagttgactctataagaaaagaataaatattcataatttctggttcctgggtcaataagaaagagaaatgtaatttctcccattttatttcccatatacaaaacatgattgatataaataaaggaatatggtaatggacatgcagatggtgttaggagggatgcaagttcagtatgtgaagccctgtttagacctctgaggccaatttatttaggatatatgaagaacaaaatatgctcagcaccacacattatagaaaaaactaaggtagagctacccatgtcttggtgaccaacttcacatgttgcagagatttaaacttctgaggaagcagaagtcaagggggcattgtggaaagagtgcatcaggcgtgacttaaaaataaaatcaggatgattttttgttaggtacaaaggtccgacaatctcctccttgctttaaaatagcttctcagacattgatgcagtggagtttgctcctgctaatggagcgtcaatggaaaagtaagattttcaatatattttgaactaaaaacttagatgtgaagtttgtataaaagtgattggtagaggaatatccatagagaaaatattaatttagcagtgacctaaattctattgacttcaaggtttttttctctctctctcaagtgctataactgagtgttctaggaaagtctatatcttatttactttctcttatgtgaaaaacagaagcactaatgcttagaagtaaaactgctctaattttaaaaagtttcctctcatatatatctgccttgaatgcatacagctgtttattgatggtgaccttcctccctccctgaggttctgagctctttctgtgctatccttattccctgaagtatcaggagaaaaagagggattcagcacagcacagtaccttcagcatagtgcaattgcatatgcattgaatgtaaaagcatagaagggtttgcaagtcccatttgcatgactttaatcaacataaatatttttaagttgacttaatggcaaattaaaatgtatatcactacaattattattgctattttgttactattatgcatgctagctttatattaattaatactagaaaaaaggctctaaaatattttggtttaaatgaaatatgattcctaaatgtatcataaatgcatcattaattagaaataaagttcatttaatgggtttattttctaaaaatattttcaaaccaagtagaaaaaaatttaaattgatagctatgtactgtaaaaaactggcatataatgcaaaggaaactcattcaacttattaattactagataatataaattgttaacgaaaatattgatataaaattctacaagtgaaatacgataatccaaaaattaaacagaatcattccactaacattgcattaggcaactgtggcgacttcatttcagatatagctaatttattaaaaaacaaaacaaaacaaaaaaactttaaatcacccaggttttaaaaaatttatactgttatatacattgtttttaaaagacaaagacacgtgttatatgttgtctgtataatatggaattgttagttgttttttatcccagtggttcataaacaagttaaaataaatttacatttttagttaaatagtaagagattttgaaaagggtaaccagattagctaaagtttttttctatgttgtaatgataagaacagtataacatattgatatggatgacattatttgatttgcaacatcaactgaatccatggtatactggcatgcttcttctttataatttttaaaatatgttaattccttgatacatgataaattgtcaggttatcctgaaggtctggacctaaaaggagattaatgactttcttctattagtgaagcagtaatggtacattttgtcacctcaatgtgatcagttactattgagacaccctctgaaatattttttgatgaaatgtgaaaatgaccagtggattatattcctataaattagttttaaacctccttctcccactctcaaacatatactcgttttaaatcattaatatgatctaacacctttattatcaaagataattaacgtggaggcctaagtcagtttccaagtcaactggacatatcagctctgaattttgtagaggatgaaaaaagggatataaatctctataattaccaaatggaggctacaaaataacttgcagtttggaaactcatgaaattgctcagttttacaggactgcatgtatttttcttcaaagttgaagactattttattaaaattgaaagataagattgctttattgtcagaaagtgatatatcacatagcaaactgaatgagaaattataaggcctacctaaaggcagtaagaaaaggctcaatgtacatacagtgatttggaagcctgtttaaaataaatgcaatgagattgttagtcatccacaaacccagtgaaaatattaaggctttttttttaaagaaaagaatgttttcaatatacagtaaaacacagaatgagaatgagatgagtaatacatctatgagttgtgtcagagctgggctggcaacagtcagagttgctgacattttgtctcttgccatgagtcagacacagagggttcatgacctggactgcctttagtggccattccttgctccttagactaactgcgggcacttgtccagcttacagcattctcctgacttagctttggccaaaagatccagtaacttgtcactgcgagtttctataaagtggataaacaaggaactcacaaaaagagttaacctgttggctcctgtttggtgccagacccatgtctgctctacagttcatcctgcaccctgcataggcctgttggttttcatagataggatctggtgaactctaagaggagcctaatattcagaatccagaatgtggaaacaaagggaagcttgtacctctctcttttatccctcagccatatttgatttagtaatgtttactggagatctatgtgctaggcaacatcctaggttctcgagaggtgactgtgacagaatccctgccctcaatgaacacacagactctcagggacaatgtataaagataaattatcttaaaataatgtagtaattgctatatattctatataactatagctttggtttttctgtgccaaagctcactgtctcaagagctgattgatggttaacacttattgaatatgtaatttgtgccatcattttacctataaaatctacatagcttactggaatctgattgggtgggtaccattattatctttatttcacaactgagaaagtggagcctgaggaagtaagttgcgcaagaacagcccagtggtcagtgacagggtgagaacgcaggctgcctctccaacctcggtcttccttcttccatgcccttggccatttccatgcctctattaatctacttagtcccttcgagtttctaccacagtagtctccaaactattttttataaaaatgttttaagcaattactactgtgctggtattttatgtatgtaatactttatatatacacctgaaataaaaataatgacagaaaggtacaattagcaatatttaaaattccatgtttcttttatagcctctaattttgtttgtttctgaccaaaaaataacaatgacacaaaaatgacagttcagtaagaaaagatgactcaatatgcttatattttcaaggaattctgatttaataattttaattaatgactgtaattcagtgattcacaagtatgatctatgattggatttagcagctatcagaactgcaaatgatcccttgacaaaaaatacaaaactcctaaaggaaaaaatgtatgatgatctgtacttaccaatgtgcaggctgaactttcaaattcatccactaattatgcaaaggaatttttgttaaaattttgttagggtttcctcttgttctgaggtcaatcagttggttttgcaaactaatcagaagttttcaaacattttaatactatgtggaaaattctttttctacatgtcttaaaggttcagatacaaggacttttaaaggttactgcccttatgtagatttggtagaggaaacactaaaaatatgtgttatcaaatgttctatatcataagtttctttcgaaaatggtgccttttttgtttattgttaaaatgtcacctttattttgataggatgattaatcatattattttcaaaattatctgcttacagttcactgttggcaaatgcctattatcacaaaaaaggtcaacaaattaggaatatttgtgttttggggagaaaaagcataacacatatttaaggtcaacttttcttttaaacactttgctaaaaaattgtgaaatttaaattttgtgggagtagaaaacatttttttggtcactctgactttttacaaaatattataaagatcctaatcatcaaaggactagtgtattaatctgttttcacgctgctgataaagacatacccaagactgggcaatgtatgaaagaatgaagtttattggactcacagtttcaggtggctgaggaggcctcacaatcatggcggaaggcaaaaagtacttcttacacagtggtggcaagaaagagacgcttgtgcagggaaactcccgtttttaaaaccatcagatctcatgagacccattcactgtcatgagagcagcacagaaaagacctgcccccataattcaatcacctcccattggttccctgccacaacacctgggaattatgggagctacaagatgagatttgggtggggacacagagccaaaccttatcaactagttaacctaaaattaaccaacttataaatatgcaaagtgcttgaaagtgcaataatacaatacaaaatttaaaataaacctcactgcattgattttatatactgtgttacaccttgctttgaacaccttggttcaaagaccttcatgttgcacaaatcctgtgtagagacttactgctttctcactaaataaacatctactaccatcagttattaaatacatgatgtcctaaccgtgtgaagttaacaaacatataacatgatctttcctctgaaaaagctttccctttactatttcatctgcctgacacaccttttcccctcatcacctaaagaatttgcatccatccttaaaggttcacttcaccttccctccaaagctccccatgcttgttcctctggattaggcatcccaagaggcaaccaagagaactttgtaccccgtagaattttgctaattatttctttgtaaagtgttttaaaatgttgaacttggcgaatgagacatttttttctccataaaaagacaagccttaccaattagctaacatttcgtgtaattactaatggcttcaggaatgggctacaagaagatatgcttgaaaaaaatcaatgtacgtaattgcatttttatagaactctggacttatatcctatattatcttgtatttacatcagaccatatagcacgataggaacatgcagccattctgcctggattcaaacccaaaatttgctgcttatttacagtgtgtccttgggcatattgtataaaatatttttcccacaatttcctcatttgtaaaatgtgcatagtagtactacttatcacataaggataaaatgggtattaaatgatcaatcatatgatgtgcctagaaaagtgacagatgagaactcagtatcttttagatattcttacagcagttgtcatgccatataattgtttagttatattttgctctcatgaaactcggagctttcttctctattttcacaatggttggataataggtgcttaacagatgttaaaggaagtgagggaacaatggagggtgaaaaagaagtgaaggagggaagggaggaaaaaaaagaatctgtcttaccatggtgtttcttctaactcaagaacttgtgtcatgttcttcagatataccctatttcacttttatttcttttcctttctttccatttatattaacaccaagccatagtacagaattgttactaaatatttaagaaatacataaattatgcaattttgtttctccaagttattgccaaattctatcctcttccttctttcctgataatgacatagccttccttctttgctactacaatttgatgacatgaatctcattagacatttcaagttatctttcaatcagtccctgacagtgcatctgacataatttaatattccccgttctcaattatcccattttattatgccttttatttcagataaaccttctcttttcccctcatgttttctctgggtatctctgtagcttgcagtaggtaatcacttatgttcaacaggcctttgttttccaagtaacttctctcacttcattaaaaatgtagtagaagctgtgttctgagaaaagtcacactgattaagatggatgttatggttttttcagagtaatattaacaacaaaagtaaaaaatactgattttccaccaaaatgactgactggtttggctttcacatctttccctagaggagtagtatttgagtggctatcaattgcttcctaaggcattcattaaaaaaaaaagaaaaaaatactttatgtgttttctaaaatgcataagattttcagaacttacagtcatatcatttacatttgtcattaacttaaggtataagtacataggttttaagttattacagactataaatcagatgttttgcttttaggtagaaaagcattttactcaaataatccaattgtttgaaaattaaaactaagtatttttaatacacagtaaaaacattgtatcttaaatagtagatcaatttaatatgctataaggctttcaaagattgttacttaactttgctaaaactattgtgtatctcatactttccatataaaacctttgcatacacatcacaaatatcattcctttcttcttttccttgcagttactataaatggtattacactggccagtagcgggaagactagatttttgtatatcggtatcagcctttgaaaaaatatcatattcaataatggcattaaataatttaattaattgaattaattataatgactatgtccattgaaaaataaatatagattagctttatgagattattttaattctgtaagaggtaaaaataatttctttatacttcatgcagtttatttagattccattcaataaagatggaatgtagagatatggtgttggatgagataaaagtaagtaaaattcccaatcaattatttagaataaaatattcttaatactcctgtcatagttgagacaccatgttgtactgtttttttatgctgaattttctgatttggaatgaattctaggattggaaggaacaagccaaaagaaaataccagatacaaaaattcatcttttgagtagaagtaatatgggctaaatcatctcaaaaacttttctccacgtgcttacccaactgatttttattcattactgaaatggcttctttgtaataattttagagtattttattaggacagagattatgatctagaagggtatgaaatttagatatagtaaatatagatgatttaattccttttgtattccttaataatatctgtagtgaacacaaaatagtttaaatgatatctaaaatgaaaattgagatcaattattttcttagggaagaataagataaatgaattgtaaaacataattacttaattcaatatttttgtaaaagttatataatacattctaaacttaaagatatttgtttattccttcttttgaataatatcagtgagtatttcttccttttattcagattgatgtgaaattatatgaatagaaggttgatagagagctaaaaccaaagattgatggaaagttgaaactaaaggaaaagcatgcatctaccttttcaggtgtggtagaatctagatctcttagaaaaactatgtttttttgacttatttgaattaaataaggaataggattgtcacatataaatattgaaggtaacttaatcatagaatatatttgaccaacaggaaaccccagtggattgcctccagtcttttctgccttgagcataataatgtagaaaaattacagattctgaagtcagatagattagagtcttgagtccaagattttttaaagttcttttacctcctggttgtgaattttgaggcacaatatttaatacctgtaaaattcagcattctcttttaaaatgggaataataataattaaatcacagtattagcactgggagtatttatttggaaatcaaaaagggtcagttacgtttttctatttttggtagctgagaatgctagagacaagtcttctcatgatttgtagttctgtctctttggttgatgggttaaatgatgcttaatgagattgaataattccattgcaaattgctttacccagtgttttgtgtgttgctgtcactttcaagaactaagtgactacaattcattgcatcagtttgtaattccacagtatgtatagtgtttatttgacctatcttacttgtagcctcttaattttacttcaacatatagaaattactaggaataagcttgtcactgttattcattcttttatacattcaacccattaaaacttcaatagtgatggcttggctgtacttcaagatagtcttaacttcaaattcactgtagtaccacatgttaattataatttttagataccgttgatgaaactagaaattaaatgcaacatttgtggcaagtgtttccggcattctgctgtggttgctattgtgatccgtgtaaggtaaaacaacacctcttgttatatagatttatagcaccagaaaattattagcaattcattaaattacatttaaattggataaccattgatgcaccatataatcatggtgactttttttcaaccatttagtatactcaggcatttcattcaataaagaaaatactgtaaaagaagacaagctgccttgcataccctactgttatgacacttgtgcattctatatataaggacaaaaaccttaaatttaatgatataacaaaattaaactgtaaacttctgtaaaagatttactaagatggtcatttgttgtttatttgactacccagcatccaagaaatattcttttgaagggaaattgacaatgtaagaaatgtggtaagaggcagggctgaagaaatatcagcaaatagaaaataataaagattaaagcataatttaacagtggaaaaaaagtagaatttgtttgtccaaaaacagtttctttagaaaagctaacagcaaaccatacttagcgttactttgccttactgttagcatcttcttataatttctacttttgcaataacatatatacatacatgcatatatatacatacacatattatattatatatacacacacacacagaaaccatgtgtatatttttattagtttagaactaataaaaatgtcataaagttagtctaggaaaattcaatggaaaaatcaatagcttcttctttgctgacaaaacaaaaacaaaagttaaaagtgcaaattaacaatatcaacaaaaatatcctatacacataaagatgtttgtgtaatgtgaaagaataaatctgcataataacagtgaagtgtgtaaataagtatggacacacgtataaggatatgccaggttctttcattgaaagagacacatttctttataaactaatatataggtttaatgaaattccaaggagatcctaataatgtttctgctttgagtgtatttggtaaataaagttattctaacctttatatctccttagataatagcaattgataaataaagctggagggaaaagattcatgagaaagactagcctaccggttattaatctataaatttactatacagtaaatattgtagaactgaagaaagattgataacccaatcaatgaaatagaagttagagcccttaaacagactcttaattatgtactatacaatataaaatcctttatttaaaaagggaactcttcttgagacttcttcagtaaatcaaagtcatcatttttttcccttcagcctttccccattttgacttgctgattctcaaatccctttctatctaaatcttgtatatcttttgactttgtatatctaaagtttcatctgtttcaaagaaactttattccactgtttgatgagattttatttttagatttttttcattatcacacaagtaaaacactattcagtgtaggaaagagtagactttaaaagtacttagaaacacacccttaaaataagtaatgataaaatattagtatgataacctttccaatttttgtatgctatagataagatgtacattcaaacccttctattcataataatagcatactataaatattatagaagttaattcttctttactgaacagcataacttgaaaattattttaaatattattgtataagcattctcattcttattatcaatgtattatacatatattatagttaatgatatagatgtatcactgtttgcttggacagtcttttcctatgaatatttggatggtttctaagtaattgatcttctaaacaagaatgcagaaacatccttgcaggtttattttttcacatttgtcagttcttttcattgagatacatttataggtggtaaaatttgcatttttaaaaagcatttaaatcatattgataaaggatctataagatgttgacaattcctagctatatactctttccagcaatccatctgtgtccactttcccccattcttaccacttaagttttagaagttagagaagataaaattatcctgtcactgttttagtatataagttttaggacagttaaaatgttttatgttatcattaagcataaggctaccattgacattaatttctatatctgtaattcatatttacattatttgacacaggattttggacagtctttttcaaattagtatggttatctggtttatttgttttgacattcaaactagttgaacattttttctgtttgtcttggaaaattgagtgcttcttggaatgtatcgtgattgtcttaaaggtataatatatgactaagtgtgttattttagctaactaattaaaatatatatttgtaaaatgagcctttattttccctaccatcttcttaactgttttctggaacttttggcatctaggatttgcaacacacatttttatgatgtgtgagattgtggggagctagcatactactgtgcctaaattactttacttgggtccccaattacactgaactagccatgccttttccgtattttctgtattccctggaatttgtgtatctgattataggaaaatggtggtgagtttgtgatgaaatgacatagaataacaaggagtagaactagtctattgtacttcttagataggctcatagagtttgaatcacactgctgtcaatgtcttagttcctaaaagccacagaactcaggatcacttggcagatagatgatggagccttttcacaattcttgactacttcatgaagcaaagctatggcttgactgaatagaattctcaactgaatagaattctcaactcagccaaattgggaatttgtttgtctgttggtattttttaatgtgtttgcatgctttagtctctggttgtatctttgtggatgatacatatatcctaatacttagttataatttcataacaaatgcctcaacccaagattttaattttacatgcatttgataaaattttaaaggatatttaagagtattattaaataagaatcttctgtatttctgatatattaacattgaaatcacttgatgtgaaatcttgaataattttactatttactatagtatctgtgaaaaaaatcatttttgttaaaaatgtatgtatgtgtgtatatatttgtgtgtgtgtgcacgcatgtgtatgtgttgaatgattttattgcattcaatactatatttggcccaaatctttactattgaatgtaatacaatcaatcattcaacacgtaagtactgaatgcctaacgtgtagcagggactattctatggatacaatttttttttaaagactaaagtctctgcctttggggagacttttagtagaaggagaaagataaaataagaaaaataatgagtatgttagatgacacatgttgtggagaagaaatcaggaatcagggaaataatgtaagaaatcttttgctggtggggaaaaatgatgttgtgattctaattaagatacagctagaaccaaggtctaaataaggtttggtggggagccttcccaatatctgggggaagagtgttccagagagagaaaactgcaagtacaaaaactcaggagtagtaatgtgcctggtatgtgtttgaggatcaagcaaggagcagcaggagtggatgagtgaggaaagaggggttggaaaatataaaatgaggccagagagtgttggtgggtaggaagagtgggacaaattctgtagtctggtagactatttggatgactggcatttactcagggtggtatgggaagatattggagggcttcgagcaaagaggtacattatctgcattaccttttatcacactagtgggcggggagaggggaaggcaatggtggaagcagaaaaatccactgtggctattctgatccatctatgcaaaagatgacaatggatgggaccagaatgatagcaaagaggaagatgtggttagagaaaattaaacacacaaaagaaaagaatgtggagaagagaagatgatcagggacttggaaaatgtggaattgccccaaaaacaaatcttactcaaacttaactctatgcctttccctactaattcagccttcaaagaagcgacaaattactcagtcactcacaaaacaaaaataaataaaacgtatgaaatttaatacattttgctcttaacagctgtatggaggtgtaattgatttggtttatttttggaattgcacttgtttaatgtatacaatttgatgaatttggacatatgcataaacctatgcataatatcaccacaatcaaggtaataaatatattcaccacctccaaaagtttccgtgtgtgtgtattttagtggtaagaacaatcaacatgagatctagtctctcaacctaattttaagtgcacaatactatgttgttaactttaggcactcttgtacagcagagctctagcccttattcatcttacataatggaaactttatattcattgactaactctctatttcccccttccgcaggtcctagcaaccactattttgttttcttcttttgtgactttgactattttagatacctcatctaagtggaatcacacagtatttgcctttctgaggttggattatttcacttagcacaatgtcttccaggttcacccatgttgtcccaaatagaatttccttctttttatggctaaaaactgttgcattgtatgtatataccatatgatccagcactcccatgttcattacagcattattcataacagccgagatgtagaaacaactcaaatgcccatcagcagataaatggataaacacacttttatttcttactttggcattgtatattgacattgtaaatagatcttgtcaattaatattttatgtatatggtataaagaggtcctggatttttagtgccatagttagaaatttgaggtccatctgaaatcaactaaaaatgcaaagatttctggtaataacatgtctttcaagttaatttaagtctatgagtctttacttaaatggctctgtgttcagagatgatgaacttacagcagatttgattccaaaataaacctaggagactgtaacagatgccattgatacctctccccctaacctcacgtttatctgcagctgtactgcaattcctgggtcccttatctacttcccacctcaagggttttcatctgcatctctctgtttctctgcctaaggcaatgccacagcttactaggctcaagtttgaggaagttaatgtccctggggacaggtagaagtcactggataaatagctcagcattgttgtccctcagtaggacagttgtgaagcatgttttatatgattcttcagggagtctttgtattagtttgttctcactttgctataaagaactacctgagtttccagtttttctgctctgttttttccccatctttgtggttttatctacttttggtctttgatgatggtgatgtacagatgggtttttggtgtggatgtcagttttccttctaacagacagaaccctcagctgcaggtctgttggagtttgctagaggtccaaccatgatagactggattaagaaaatgtggcacatatgcaccatggaatactatgcagccataaaaaatgatgagttcatgtcctttgtagggacatggatgaaattggaaatcatccttctcagtaaactatcgcaaggacaaaaaaccaaacaccgcatgttctcactcataggtgggaattgaacaatgagaacacatggacacaggaaggggaacatcacactctggggactgttgtggggtggggggaggggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaataaaataaaataaacatgaaaaaaaaaagaaaaaataaaaagagctacctgagactggaagacctttacgaagaaaacaggtttaattgactcacagttttacaggctctataggaagcacagctggggaggtctcaggaaactaacaatcatgacagaaggcaaagaggaagcaggcatatcttcacagtggtgcagcaggagagagagagaaccaaggggggaagtgctacacacttttaaacaaccagatctcatgagaactcattcactatcactagaaccaagggggaaatctgcccccatgatccagtcacctcccaccaggcccctcctccaacactgagaattacaattcaacatgagaactgggtgaggacacagagacaaatcatgtcagtcttcaataagtccaagttccagttgctcatagtgttcccatagcataccctttactggcttttgcccttctttatttcccttttcccctcccttgcatgcactttctggttcacctcccaaataaatgaacttcaaagtatttgtcttagggtacacttgggggtcccacatcaagccaggcagagacactttaatgaagttgctcatgtctggttgacaaaacaaaaggttcaagaatgttcctcaggaattaagcaaaggtgattgttagctccatctactttgttttacccctctttgatcttattggtctcactgtgaccagcattaaagaaacaaagggtcttgagctggtacagctcaaaatggtgaatctgttgctgtttccataattaatcatttttgtcaatagttataagtgaacagagccatgaaatgcagaatgcataataggaagctgaaaatttatgggcatattgaagacatgtaacaattgcctgtatgaataacaaaggagcaggaatacagcttctcggaggctaggatctgagtttctgacatctagaataaagttaggaagaacttaagtgctacaataacaaaagatgccactggatttacagtttggctgaattctagggaaatcacatgttgtaaggccttggtaaagatcagattcagaaattatttttaaaaagaagaatttggaaaagataaagtaaaaccccaaattctatattaatttttgatgtagatttactttggaggcataccaagtgtttctggcttggaaaagtttaggtgcaaagactatggatgagcaaatgttcagtggtccttttctttccctcttatggcataatctaagcctcaggaacagaaatatccataatccataaaatgctttttttatgttatacaaagaatcagaaagacacgacttgtttagaaattcaaaagactgttaacagagaacacacacatctcctctgacatgaaaattttcagataaatcaggcagcagagaaagacaaagtcagaaaatgtttatcgttttcctgcaattattggaaacatgaaatatttttggtcaaagcagagggaaccaaattaaggtaataatgtgtaataactaataaaccgataaagtaggtgacaactgcagcaaatgcatgatcacttatttttccccaagattactgtcattattcttatgggtatgtgggtgtgggcaaggggaaataaggcccatgtaaataaaatgtaattctttgcttgagatatttatagttttgtggttgaaaaacatatataaacatgttatttcagtacagtgtgaaaagggcactgggtttttggcagagttagatgcagagaagtggcatgatctgattatattttcgaagaattactgtggctttcttgctgagaagagactgagagggggctggaagacaataatccaggcagaagagtttggtggactagggacaagatggtagcagtgagctgatgagaacatgacacaaaaagattatattcaaccatttattcatgccttcatgcatccatccattcactcatttagacataggtccagtcttaccaaaaagttgtaagaataacacaacagacacttcacccagatttcccaagtgttaacattttactatttttttttatatttttctctctttgtctgagagagagaaatagacttatatttctccaaaatattgactaaattgtaggcatgataccccttcacctctaaatacacctccaaatataccagggtataatatctaaaaacaacaacattctctgaaacaatcttagaaaaattatccaattcagttttaacactgatacagctatctaatctacagaactttttcaaatttgttaacctgccccaatagtgcctttataacaaaagaaaatccataatcatgtattgcattcagttagttgtcttgtctctttagttccctttaatctggaatagttcatttctctttcattgtgtttcatgatattgacattttggaaaagtacaggccagctatttatagaatgtctcccgatttgtgtttgtctaatatttcttcttgtttacattcaccttatgcaggtttcatagaaatacctcagaagtgatgctcttttcacagaattttatatcaggaggcacatgctgttgatcagtgtcattaacggtgatgttaactttgatcacttggttatggtagactctgctgtctctctactgtaaagcagaatatttaactttgtaattaaaaaatatcttattattttcacactgtgttaaatatcccatgtgttctccagatttcacctattagtgttacaggatctttggggcattgctttgccagctggaaacctccatggccagtggtgtctttgcttgagttttgcttgggcctgctgggccaactcagcaggctgctgttagctcacacctctggcctggattgcatgcctgccaagggcaagtggagcagcaaggggtgtgtgagagagacagcatggggtctagccactgtgcatagccaggcacgctggctgcagcggggtgggcagctccaggcactgacacaggtgctggctccctgtgaggctgcagccagaccagacatcctgaaagcagcttccacagctggcaccagggaatgctgcagcacctggaagctttaagatgccaggaactgcaaagccccatagaggatgtcacggccctggcttaaggagctcctaggtctgggctcccctaagggctgcagatcttctctccttctttttgcctgcaacatggcaagcaagggccatgttttagccttgctcatgttacagctctttcatccctgccattcggcaggtcctgagttcttgaacctgtgcccaggaagaatgaggtatgtggacaagtggagctgaataattctatttttcaagtggatggtgagcaaggtgaaaaggagctttattgtgtgatgtaacagctcagaggagacacgcagtggatagctactctccacagctagggtgtcacaacaagtattcagctctctgcagagaggagaccgtggggtaggtagctcctctctgcagctggtcttatcatcatctcctcaagtctggctgagtctggggcttttatgggcctcagaggggaggaagtgcacactgattaatctatgagcagcctgaataaagcacaagttcccactcgcgtccatgggcccagcagcccggcccccaggcttcaggccctccccagctcacaggtgggacttcaccagggacctgccccttatgcccaggagcctgtctgctttctgctgccattcatggcgcccaggccattcatgccaagggaaacctgtaggccaatgccaagctgccctcagcagcccctcaacccccctcacatacttgttggtgcccaaagtccagagggggctgaggcaacaggggactggcatgtcagtgctgccttgagagtgtgcacacactggcaacctgcaacagtgcccaggctcagccccaatcttgctccaagattggagtgtgcgccaggagcagggagagggcagacagtaggagcagacacttctgagcccctgggggcgggggtccttcctgtgcccccaagagtgcagagctgccaggtctgcagccatggcttgggtggctgtaactgtgctcttgcctgcttccagcctccaaaagcacaaggaagcccacatccacagccatggctggatggtcagagctgtgcccagggagcacgaagttcctgccctgtcaactcagaaggggatggcacttctgcctgttcccagatcctgccagctccatggagtgcacagccctggcatgccttccccactgcagccggtgtcatgcagtggccgctgtagattaaccaccactgccatgactagttttaatatccattgatgattctcactttcattgattactaccaagatggttgttatgataatttttaaattccatcatttatttttattaatttattttctaccaaaaggaatagcttttccttcatcctaattttcatttatatcagtggattaatgtatttctattttgtacaataggttattcttattgtcattatttatttgaatgttcaaattgtcacattcttggccaatggaaattttttcaagtaggccacagttgcccttttgacatggaccataattctttgagcactctcccaactttcagcacagaatgttgcagggtcctcttgtactttccttggcttagcactggagtcagccatttcttcaagaaactctggttcctttcagtacagaatggtattagagatcaagattagggttctatctgtaaccatcaccacaggggagtcgttgcttctaggcattgttaatattaataaacaaagccagaaatagaaagataactgtgtattacactcactcacctgtctctatttagctaactagctatattaaaaacagttgatacacactggtttctctgcttccattccaacatagcaggataattgtattttctccctttttatacttataactgtcctctctactagtgacaaacagctcccattatttataatatattcacttacatgtttaatcttacaatgtacagaaagtagggtcagtgttactaacctagacatctaagaaagaggcctactcagtagcattcagtatttatttagggttctttttgtctttagctggaaaacatatagtccaactatggttagatcttctcccattacttcttagtgttatttattcaaaatattatttatttaaagtatactgggtcatttgtttctgtttctgttcaattttagaatttttcaccttcctttttgttttattattttcttttttgtgtctgtgaaatactaatattctaaaagtgagatctatattaaatttcacttttaactaaattatttcctttcttgtgttgtcgtttagttgatttctttatatattcatgtatttttaagcagataatttaattcatttaggcatattcatttttattgatgaaatgtttgaggttatagggtttccttttatcactattttatgtgccacagattctcatataaatagagatagatagtatgtatactttaatatacacatatatgtgtatgtttttattattccttgtttagaaattctttaaatttgttttgtattttcatattcacccaacttgtttaataaaagttatttttgattatttattccaatcgtatgaccttttaccttttttattttaaaataatctgttttttgttattagagattaaattgtaatatttataattatgaaatgtacttatgtaacttagtatatgattacattttaagaatgcccaatgaatgtttgagaagaagatgtattcactattacttgagtgtaaagttctgtgtgtataatatctaccttactgattaggttttgcaggacttctatatcctgttctgtgtgcacttgattgatcttatatcaattctgatatattaacatctcctaggcttgtatgtttctatctgtgtctttttgattctccttaattttttgctttataaaagtgtctactatgttattttggtgcatagatattgatagttgtcatgcctattttgtgaattcaggcttttaacattgaaaagaataatttttcccatatttaatgcttcttagcaaagtttaatattaactttgtttgataccaatattgcctttgctctgttattattcccagaagcctggtgtgtgtgtgtgtgtgtgtgtgtgtgtgtgtgtgtgtgtgtgtgtgtgtatccaagtctttctatttagcctttctgaattattttgcatatgttttggatgcagaacatattgggttttactttgtgagtcaaattgaaaataatttccttctaatggttgtgttaatcttatccattcacattaattgacgtgctaaatgtctaatgtcagctctgttattttatgtaataattatcatgtgtactgtgttatatttgctgtgtttctctatacaaagtagagtattgacctcttttattctattttgtaatttcttttggtgtttaggaaagactgtacttttgttctagcagtcaatttttaattctttttacattttcttattcttttgcttttgttttaacatgtttctgtgttgtttgcattttgaatgacatattttaacacaaactattacctacacagcaacttccctattttctctcttctgtcaatttcagttctgttatttctactttgtcagaacatataacacacactatgtagcatataacataaaatattattactccactctcaactttatctttgttttagtcttagatttacaattacatatactaaaagcttaccatttgtaatactgctgaaatttctcaattcatttctttttttttagattttttttaatactttaagttttagggtacatgtgcacaatgtgcaggttagttacatatatatacatgtgccatgttggtgtgctgcacccagtaactggtcatttaacattaggtatatctccaaatgctatccctcccccctccccctaccccacaacaagccctggtgtgtgatgttccccttcctgtgtccatgtgttctcattgttcaattcccacctatgagtgagaacacgcagtgtttggttttttgtccttgtgatagtttgctgagaatgatggtttccagcttcatccatgtgcctacaaaggacatgaaatcattattttttatggctgcatagtattccatggtgtatatgggccacattttcttaatccagtctatcattgacggacatttgggttggttccaagtctttgctattgtgaatagtgccgcaataaacatacgtgtgcatgtgtctttatagcagcatgatttataatcctttgggtatatacctagtaatgggattgctgggtcaaatggtatttctagttctagatccctgaggaatcgccacactgacttccacaatggttgaactagtttacagtcccaccaacagtgtaaaagtgttcctatttctccacatcctctccagcacctgttgtttcttgactttttaatgatcgccattctaactggtgtgagatggtatctcactgtggttttgatttgcatttctctgatggccagtgatgatgagcattttttcatgtgtcttttggctgcataaatgtcttcttttgagaagtgtctgttcacatccttcgcccactttttaatggggttgtttggacttcatgtctaaaacaccaaaagcaatggcaacaaaagccaagattgacaaatgggatctaattaaactaaagagcttctgcacagcaaaagaaactaccatcagagtgaacaggcaacctacagaatgggagaaaatttttgcaatctactcatctgacaaagggctaatatccagaatctgcaatgaactccaacaaatttacaagaaattcatttctttgttggattctgtggcacttaaaactgtttttccatagcattgatccttgactgaccacttaactggctataaaatttttcattcataccatcttcccttgaattatttgaaaatgctactcctctctaccttattttgctttgtttttgtatttggcaataaagataaagtttaatacacatgaagctggccataccacagtgagatagagttattactcaaacaacctctctgagactttaggggctagggtttttcaaagatagtttgggtgagcggtgggggtggttaggcttgcagcctagggttgcttgcagctgattggctaggggtacagtcatagggttgtagaaaattgtccttctgcacactcagtcatttctggtggggccacaggagtggttagtgggcccaggtggagccaatggtcgtcagacatggaaaaaacctgaaaagatatcttaaagggccaagcttagcttctgcaatagtgatgttatctgcaggagtaataggggaagttgcatagcctgggacctccagaataatggctggcaattgcttatgtctacaccttagcagaattcaggcccctctatcctcctagcctggtggtctctcatttgctttagaagtgtagttgaatttgggggaaggactgatatctctttcttccattcttttaaacttttattttaagttcaggggtgtaagtgcaggtttgttacataggtatacttgtgtcataggggtttgtttcatcacccagttattaagcctagtattcattagttgtttttcctgatcctctctccactcccaccctttaccctcccaaaatccccggtgtgtattgttcccctctatgtgtccatgtgttctcatcatttagctcccacttataagtgagaacatgtggtatttggttttctgttcctgtgttagtttactaactaaggataatggcctccagctccatccatgtccctgcagaggacatgatctcattcttttttgtggctgcatagtattccatggggtatatggagtaccttattttgtatgtagcgttttggaagtctgatgccaactatttttcttgtcattgtttttatttctttatttattggctaaagtctgcatatttttcttcttcatctgtaaaaatttggtatttttactttaacatcattttgaactgattattactaatcaattttctctgctactcattgagccctttcagcatttagattcaggacttcttttatttctgaaaggctatttgaattgtcctttaaaaattaattcttttccattattttacttatattccttggagactccagttatagtaaattggatcttctttgcctatcttccattttaagcactttctttctgagcctttttgtttattttatttttattttctttgttgtttttctattttttaaatgaacattgttatacttttatttgaatatattctttcttgggtatctcgtaatttactttttctgatatgattttgtctttttaaatccttttttttctctttttagtgtttgaatttatggtttaagttttttgttctgttttgctttgtttttgctccatacctcaaagtgtttgttcattaatttagtttggagtattgtgttaaagttttcttctttttcactgttactttttgggggttgcagaaggaggattgtatcagctgaattgtttatattctcattctctgatttctttttgtagtttttaataaacaaagactctttgcacttctacattttaatggtctaggttggtgatttgtagtagtttcttttttttttttaaatcatggctaaaaaatgtcctatgtagtcagtgtgaaaaaagcatagtttcattacaaagtgcatttttttttaggggaagattttataagggactaagttattagtcttccaattgtattgtattgtctcttatcttgctcaatctaaatttctctctcgcttctttttcacttcaccatataatttccaaagggcacttatttcttgcttttgattctcttcttgaagactgatgccaacctcttgaagactgattccttgcatactgtatgcatattctttccctgtgatcactgctctgatctacattgttgcagtattttcacacacacagggaagatgttttctgaaatatttttaaacaaaacaataacaccttgtgggaggtgttatttaatccaatttaaatatgtacatatttatatatagtctgtgtatatattatatatatcttttgtgtatatatttatatatatatagtttgtgtatatatttgtgtgtctgtgtgtgtatatatatatatatatatatatatatatacacacacacacaaatatatacacaaacatgtaataagtgtaccaaaacctatcagctggaagttttctttttctttttctttttcttttttttttgagacagagtctctctctgttgcccagactgaagtgcagtggcacgatcttgaattactgcaacctctatctcctgggttcgtgggtccaagtgattctcctgcttcagcctcccaagtagctgggattacagacgtgcatcaccatgcccagctaatttcagctggaagttttctaaaccttggataccaaattaaacttgacccggatatatattagtttggtgcaaaagttattgtggtttttgcattaaaagtaatgggaaaaactgcagttacttttgccccaaccccaaaattttatcccatgaagaagtaaaaacaaaaacaaaacaacaacaacaacaacaacaacaacaacaaaaactccttacctctattttatacatgtttgaggcttcatattcttttctgtgcccaaacaaaatttctttatttgttttccccctatctcatcataggaaaaatattatcctttggaagagattctacaagaaataaagatagttcaatgtttcctaagattgaaactttggcgaagatttgaacatactaagtgaatgatgtcttcacactttcttttccttatttctgtgcttctcattcctgatttgtgttacagagtctaaaaatcttctcattctagtacagagagcaatgcaactctcctaagagtctcctgcaaatttatctacccaagctaaagtgctcagcagtaaaaaaattccacctttgttagagggaagttttgatgaaatatagcacatttttactttgttagtatagtgggttaaaaaaggttttatggtctatatattggttgttaacagaagaatctcttgaggacagtgagctaacataaaagaatgaattttcaaatcagacttataagaatctgagatcttacctaatattcaagctttactaaataatgtcaaaaaaactcatgcaaagtagagtgaggactctggtacaccaaaggtcacatatcagatcctgtattttcaccttagtcatgcagttctgcccaaggatactagatcagatctctatatgacaaccttgagatcacctcatgcagtgggaatatttaaattatgaaacaccctcatttaataaatctaacactagtatagcctatttcacattttccagggagaagagcctgatatatcctggtttctatagtttacccttagttaggacatcttgtgaagtgcatttcagagattaagtctcttctttctagcaaatatctatagtccatttaaccaaatatctcattagcaaggaggtagaatggggtcagctgccaacatttttccccaggagcactcaaccccccaaaaggaaattaatcaatttcaggcaagctgctttaatttctttctttcattgatttgctgtgattttctcttttgtatttttttctaaaaccgtgggtattaaatacataattgtcagaaaaattgatgtaatggaaatggggaaaaaactcagtcatatattgtgatgttagaacaattcatttacctggttgcagctctggtctatctgtatataaatagcagacttcatgccttacgattcagtcacctgaagaacagtgtagtggccgaattgcttagataattgatattatatttatggtatctgagacagaatgaagattttttattaaatccctttgaagattagaaaataatgtcaatagtttgtatatttaatactatatatgtttatatattcatataacatatacacacttatatgttcatgtaatacacacaagcatatgtatacatataccatataagtcccttattattattgtagtaaatcaaagttctatatctatatactgcttaactacacataacttcctattattcttccctgttctttagtctctaattttatatagagtaagaattatatattattgtcttattttctgagcagaggtgtggtggattattccccaaaggtcttgttttctctgtttcttttatatttcatgtcaacattttcttgttgttttccaatttcttccataaaaatgtaatacaaagaatatcataatagcaatctttacatatgcattatttttaatttataaaggactaagaactgtttctgtgttctaaatactctaagtaatacattttctaagtaataaaataattttgagaaatgctataaatgtcatgttcatctttccattcataaaatactattctttctgctaccgtgctgtggtttctcccaatcaacagagttgcttatagacactctctgaagtcacgtccacccctggacaacttgatagatggcttttaagaaagaaatgaaacattatttgggggagggtggaacaatatggaagaatataaagcttcatccatcatcccacccacaagaacacaaaattaacaagtatctacaccaaaattgccttcatcagaaccaaaaatcaggtgagcattcagagtacctgcttttaacttcatactgaaagaggcactgaaaaggatagaaaagacagtcttgaattgccattgccacccctccttcatcccctggcagaggccacatgggatggagagaaaatttttgcacttaagagagggagagttcaacaattgtgaggcattgcattgaactcagtgctgccctgtcacagcacaaagcaaaactggactgaactcagctgatatctgcccttggaggaagtgtttaaaccagccctagccagagaggaattgcccatcccagtggttggaatttgagttctagcaagccttaacactgtgggcggaagtgctctggggccctaaataaacttgaaaggtaggctagaaaaccaggactgcagcacctaggcaattcctagtgctgagctgggctcagagccactgcactttggtggcacattgacctactgagacaccagtcagggtggtaagcgagtgcttatgcagcccctcccccagccccaggctgcacagcttgtgccccaaaagagaccccttccatctacttgaggagagcagagggaataataaagagaactttgtcttgcatcttaaataccagctctgccagagtaggatagggcaccgtaagagttgtgagacctcctttccaggccctagctcctggatgacgtttctagatataccctgggccagaagggaacctgttgccctgaagggaaagacccagtcctggcaggatccatcacctgttgattaaaaagctcttgggccctgaataatcagcagcaatatccaggttgtatgccattggccttggatgacaccctgagactttctggcttcagctgagactcagcacattccaagatgtggtaactatggggagagactcttgcttgagaaagcagagggaaacgtaaaggggactttgtctttcaccttagatatcacctcatccctgggggttagagcaccaagcaggctgtcctgaatattcttgggaatgatcaatgagttaatgaagtgattaagaagaaaatttaaaattttcttgaaacaaatgttaatgaaaacacatcatactaaaatgtgtgggatacagccaaagcagtactaagaggcaagtttatagctttaagtgcctacatcaaaaaaagaagaaaaacttcaaacaaataacctaacctagttcttaaagaattagaaaagcaagagcaaaccaaatgcaaaattagcagaaaagaaataataaaaatcagagcagaaataaatgaatttgaaatgaagaaaggaatacaaaagatcaatggaacaaaaagacagttttttgaaaagttaaaattgacatactttgagccagactaagtaaaaaagagagaagatgcaaataaataaaatctgaaatgaaaaagaagacactataactgataccatagaaattgaaaggattattagcagccactacaagcaattataagccaataaatttgaaaacctagaaaaaaatggataaatggctagacacatacaacctaccaagattgaaccatgaagaaatccaaaacctaaacagaccaataacaagtattgagatcatagttgtaataaaaactctcccagcaaagaaagtccaggactcaatgccttcactgataaattctacaaaactttaaaaaaaagaaataatccaaatcttactcaaactatttccaaaaatatgtgaagatggaatacttccaaactcattctgtgagaccagtattaccctgataccaaaaccagacaaagatacatcaaaaaaggaaagtacaagtcaatgtcactgatgaatattgatacaaaaatcctcaaccaaatattagcaaattgaattaaacaataccttaaaaagattattcctcatgaacaagtaggatttgttccaggaatgcaaggatggtctaacatacacaaatcaatcaatgtgatacatatcaacagaatgatactgaatggaggaaaactgaaagcttttcctctaagatgaggaacatgacaaggatgcctactttcaccgttattcaacatagtgctggaagtcctagttagagcaatcagacaagagaacgaaataaaaaatatccaaattggaaaggaagaagttaaattatcctggttcacagatgatatgatcttatatttggaaatacctaaagacttcacaagaaaactgttaaaacttataaacaaattcagtaatgttccaggataaaaaattaatatacaaaaattggtaccatttctatatgtcaaaagtaaacaatctgaaaaaaaaaaacaatttagcaatcccatttacattaggtacaaataaaataatataactaggaattaactaaaaaagtgaaagatctcttaaatgaaaactataaaaaattgatacaagaatttgaagagaatgccaaaaatggaaagatattccatgttcatggattgaaagaatcagtattgttaaaatgtccatactacccaaaacaatctacagattcaatgcaatctttataaaaataccaatgatattcttcacagaaatagaaaaaacagtcctaatattcatatggaaccacaaaagacctagaatatccaaagctatcctaagcaaaaaagaacaaaactggaggaatcacattacctgacttcaaattatgctccagagctttgattaatcataaccaaagcagcatgatactggcataaaagcaggtacatagaccaatggaacagaatagagaacccagaaacaaatccacacacctacagtgaactcacttttgacaaaagtgccgagaacacacacctgggggaaaaatatcttttcaataaatgttgctggaaaagcaggatatccatatgcagaagaatgaaactagaccctgtctcttgccatacacagaaatcaaatcaaaatggattaaagacttaaatataagacttcgaacaatgaaactactacaagaaaacattggtgaaaatccccaggacattggtctgggcaaagatttcttgagcaataccctacaagcaaaggcaagcgaagcaaacatggataaacaggaacacatcatgttaaaaagcttctacccagcaaaggaaataatcaaagtaaacagacaagtcacagaatgggagaaaatacttgcaaactacacatctgataaggtattagtaactagaatatataaggagctcaaacaactctataaaaaattctaatactctgatttaaaaaatgggcaaaatacctgaatagacatttctcaaaaggagacatacagatggcaaacaggtatatgaaaaggtgctcagcatcattgatcttcacagaagtgcaaatcaatgctacaatgagatatcatgtcaccccagttaaaatggcttttatccaaaagtcaggtaataacaaacactggtaaggatgtggagaaaaggaaccctcctcatacactgttggtggtaatgtaaattaatacaaccgctatagagaacagtttggaggttcctcaaaaaactaaaaatagagctatcataagatctagcaatcccatgcctaggtatatactccaaagaaaggaaatcagtgtatagaggagatacctgcacttccatgtttattgcagcactattcatgatagccaagatttggaagcaacctaagtgcccatcgacacttaggttatcaacagatgactggacaaagaaaatgtggtacatttacagaatggaatattattcagctattaaaaaaatgtcatcttctcacttgcaacaacatggatgaaactggaggtcattatgttaagtgaagtatgccaggcacacaaagacaaactgcatgttctcacttacttgtggaagctaaaaattaaaacaattgaacctatggagatagagagtaggatgattaccagagactaggaagggggtagtagacgggtggcggggggaagtaggaatgattaatagacacaaaatatagaaagaatgaataagacctagtatttgctaacacaacagggtgactataataaaaattatttaattgtacactgtaaaataactgaaggagtataattggattgtttataacacaaagaataaatgcttgatgtgatggataccctaatgtgattattacacattgcatgcctgtattaaaatatctcatgtaacccataaatatatacacctatgtacctacacaaattaaaaaagaaacaaaaaaatcttattattccatattggtgaaatataaggagaatttagtagtttagactccctccctccctcccttctttcctttcttccttctctccttcccaacagggtctctctgttgcccaggctggagtgaaattgtacaagcatagctgactgcagccttgaactcctgggctcaagcaatcctcctgcctcagcctcccaagtagctaggactacaggcatgcaccatcatgcctagctaaattttaaacattttctagagatgaggtctactatgttgcccaggctgatctcaaagagtttagacattttcaaaggagaaaatgtgcttatagcaatctgaaaaagcttatctcaattgactgaaaaggaacagttaagaaattaaatggagctttgttgtattaaaggaagtcttgatcttgatcacatgaaccgaagcacctctccttttccgtcaatatttgacttttaaaatctggattacccagactataaacatgaaagttgcttttttaaaactcctgtcatgctctctgacttgcaataatctcttgagctttctttcagaagtgacagtgctagtttggagaaaattttattttctggtaaagtgaattaatttttctagttacatatatttcattgtaaatatatttctagtgctagttgatggcaggagtttctgttgatataaattgtgaacttcaaaatacatgtttttaaataaatgttttccatcataccatatagtattatttttctaatgtgtctcaaaatcacatttgtggttgtgcattcagtgggctccatggcagagctggggaccagcggggctgccccacagccattgtaagtttattgtgagaaagttggacgcagccctggggactcctgtgagcagtatctcaggatggcagcactaggccaacctgaaattaatttttgaagggaagttatatttacgtcacaaattaaaaggttaaacttttttaaaaaaataccttcttatacattttatagaaacgtcatttgaaaaataaaaaagagatataacatatgttctgaaacagagtttctggaaatagtttctggaaaagaagaatgtgtaacagattttattggtatatttcattcctttcagtgagagcttttatttgaaaggtgtcttgatttctacacctttggagacaatcaacacggctggtgtggtcccattagaggtcatattaagaatacccatgagtgagctcctcttagtgggaagaggcgagaagtgaagccatatggaaaaaactacctctcttagggacacggtggtaatctcaatcatgaagatcaagaagtgaaggcaagtctagcccaactattctttagctgaagaatcagctaatgaagttatgtttaaatccacagtcctgggccccagctaaaaaaaaaaaaaaaaattcagtttatcttgcggatcccaggactgcatattttaacaagcatcctgagtcaattaagctgattctctgaacacactttgagaaacattcatctggccctttctgtatcagcatcaatatctgagtggtctgatctgagcaactgaggcagaacacagcagaagagcttcaagtcgctatattcttgtccaagaacttaacgtaattcatattacttaagtaattaatgttattaatgacatagaacagaattgggactctttttaagtctcatagaaaattagaaagcaatgtatgtactccatatatgtgtatatatacatataaaagtattatgtattttaaaaagcccatatgtttgcctcattatcattgcaacaaatcaaaattccagatctatatacagtcagccctttgtgtccataggttccccatcctcccatcttctttttctccctctctgtcaccagactatttcttctcctgagttatcagactaaattattttcctaccaaaatcatttcagcttttgtaaaaaaagatcaacctgcaaaagagattatagggtgtgagccaaaccatgacagtccctggtagaacactcttgcacatgttttactctccaacattatcgttgagtagactcagaatgcagaaggatgagctctgccaggaacgtggggttgcttgtttccctgaagactagttatgactgtcttttttgaaccatgcaatcatagcagtgtcttgacctttaatattgatgacataatggtttgttatgttttaattaagctctaagaatatttctggcaatttagtattacctctcctgtggcctacacccagaagttaccctttcaaggacgacgtaaaatatgattctgctaatgctagtgttttacatgccagtcttttattcagctcatggtgttttcttttctcctaaaaatactttatagcaaaggaatcacatctcaaaaagaaaaggcatttattaaactaagggtagaaataagaagaccaaaaggaattgccaagaaaagcttttactaatgcttcacattaggaatctgcagaagcctgtgaatgaggaaatggccagatttagggaacttgaataattgcctttggagagcaaagttgtattaatctcattggctttttgatttgctattttcctccccatcttattcacttcaatttttgtattttcttttttcttagagtgctaactttcatgttgcttttctaaattatgcactacccctgctgtctgtcccattctaattaggccttttctatttatacttacaatagtgtaaaatctcaagacacaacttttcttgctcctagagtaggtgagccacaaatgagaagttcagatagatgcagtttaacagagtcagcaagaatactgacatacccatgagaaatctgccttccaggtctgacaggtgacacctttgcaatgatcagccttaatggttgatctgcattactaacatttccttggtaatctgatgtcacattgcaagcagctcaatattatagggtttttatcctacatcattagacgtacttcataaattttgcccaagaggcagacttggcttttacatatttctgtttatttaatgaaaaatagatttcccttttttcttcctatgtgatttgtaatactgcatattaatagatattgaatagaaaatacttgtatcatattctcaaacatttgaatgtgctatataagctctattcatgtcaagtaggacaatgattttatttactttttcaattattatgacatcatttttattggtaggactatttttgcatggagtagaaaagggcagccaatttaaaaagcttcttacgatagaagcattgtcattgttctccacctagtacctattgcagtttttcctaaagtaaattgaattaactggacaaggagcttggtgacccaaattttacttcagctatcaggcgaccttctttgtagcaaaagtgaatcccttagaagtcttttgacctttgttcacagttacacagctttcaacgttttctggtttaactcagagcgcagcacagagttacaaacgaaagagacaccttgcccctggggcacaaccaattcatttccagataattcatacctgcaaaactctgacttgcctgcaccagccacagactccactgttgattgcagtgttgcagctaaattatctggaatcaaggtccagtctatatatcccagatatagttttggagaaatcttttctctttatatcgtatattataagaataataatataaactcaatcaagaaaagctatttttaaaatactaaactgaaaaatttatctgccaattttaattgcactttggttccccctgtatatgctgatacccaatctcaatgtgagactgatttttcttctcatacttcccctctgtttgctccttacagcaaagttccatcaaaaaaatgaatattaactaaaaagagacgaaaaaagggaaacttcataacttactgactttctataaaacatcctttatttcctagcaatgtggttgaggtgcgttagaggaagacaagaaggcaaaaactgaaaacgtcttctctagaaatgacagagttttttctgcctacattcaacttgaataggccttaatgtttttgatctgtttgagaccactactcaaatattctgtagagttcacatgggaccaaaaattgatttaagacatgaaaattagacctgttgacaaaagctaagggaagtgaggttatttcacctggaggagaaagacaaggaaggcatgcaattcgagcatggaaagggtattgcataaaatacggatgacagctattccatttgaacctgagtttcacatttaattccatttgagcaaaaatgcagttcagttttaatttataagaggagaaatttggaatctatattaaatcttcttaactagaacaaaaaaaaatgaaaattaaacattcttcagttataattagaaccaagattgtctttgcttaataaggcctgaaagcaaagacgttttttagatgagaatgggtatgactgtgtgcttagtacttaccatatctcagaccctttgaagcaggagtaggcctctagaaaattatgaggacttctgtgtagtctcactgctttttatgtatggcagagaagtacaaagcaaaagaaacctttccccagaaaaacccctggaatacaaccaattcactcaacaggtaattcatacctagaaaaatggtttggtagcaccaaagactccaatgctaatttcaacgttgtacacaaattatcaggagtcaaggtccaggctaacacagcttcgccaatgtaatgatcacaacagtacaagtgatgaaacagaggcagaaagaagtagcttgaccagactcacacagccagtaagtgacaaggttagctgagaatcagtctattcatgccaaagcttatattctttccattattttacaatatatacctaagtgaagtttaaaagtcctttgcaaactctggattctaccaatacatgtcattaatgatagataagaatattttagttttgttttatgtgctaagtagaattcaaggttaataataggacaatgaaataactttctcactcacccccactccctttttttttaaaaacggagtctccctcttgttgccctgtacggagcctcccttttgttggagggcagtggcacaatctcggctcactgaaacctccgcctcccgggttcaagcaattctcctgcctcagcctctgaagtagctgggattacaggtgcccgcccccatacccggctaatttttgtatctttagtatagacggggttttgccgtattggccaggctggtctcgaactcctgacctcaggtgatccgcctgccttggcctcccaaagtgctgggattacaggtgtgagccactgtgcccagccctcacttccccgttttaaaattctaaaaccctatatctccttatggctaaatataaagtaacaattaaaatctcagagagcgttcataattcaagcttttatttatccaattgttcttatcagaagttcttaaactgttttttatagagcagtaaagagtataaaagagaatatgtgagaataaaatacttcctttgcaaaattcaatatatttctgaggcctaacagaccccaatgaagaaaatatccaccaaattattaacttcaatgagaatgagagttgaggcatatagtataatatttctataattttttttgctgaacatagcatggtttaatgaacaataacctttgacttcttacagagaatccatatctctaaatcaaaatgtatttgtgttcctctctgcttatatagttacatatatcatctcagcccaaagatatattttttgttgcaaatttaaggtgattaaatggtttttaatggtagcaatgttgcagttttaattacagtgtttattatcatgaagaatttaatgtaaatatatgacaattagcagtattctattggggaaagctgaaaataatttgtcccaatctggagatttgctgagacccataatatgcatacactaattcctttgccctaacaccaccactgtataaaatatctctagggattttaaaaggtaaaagtgatattcacagcaggagtgacacagcatataagggaaacttaaatttggcaggcttttagcaggattttcccccattaaatcacagtagcataaaataagatatgtaaaatcacctcattacatttattttttaactaggatttgtttgtttttaaagatccaggaaaaactcaccaaattcctcttctcataccctactctacttgaaatcctgtaagaattaccaactacatattgatgatttccatttttgatagataatttgagtatgtaactttaaaaacatgaatcctataaactaatgagcaagatttcattatcgaatagcccattttgcattactaaatggactacttttcttaactaacttggcacttttaagtatataaagaagcaaacaataatgatttttaaaaatatttccactttccaagcctttattccatttcctgaattttaacctgtcaaaaatgaaacgcatgcctatggaaaaggtaattacttttctccttctttaacttcttcttaattaacttttaatctatgctgttacagagggagcatgtcttaatactaaatgtgtctaaaatgtaggagacagagatttaaatcatttagataaacatctgcctagcacagaggcataaaaattacaaaattaggatatgggtggctgagtgccaacagtagctgccagcaaaagcaagatattgccttcatttaaaaaaaatcttttgcttacaaacaaaccaacttaataaatgacttctaaccatacactcttatattggagcacatttcttgttttatactacataaaattctaaaaacatgtgaatgagaaattgaagggaaataaccatgcaatcatttatgaaaggcatgttttaatagagaaaaaatcaataaattggaaaatttttaccatgaagtgaagcactattgctttgtttagttggagtggattctgtcaacagtaatttaaagtaatcagttcaatgatatgatccctggttggtgttcagataattactatacttatgtctagtaattttcagctattaaatggaatatagagtggcaagtaaagacaggaagctttgacccttaataccccctttactatatgtgtgtaatttgtcttctaataactgaaataacgtgacagtaaagtccatacacacaaaatggaaataatcctgcatcctttattcaagcctggttaatcaaaatgtcttgaatttttttttgcacaagatgtagtagaaatacacacacacacacacacacacacacacacacacgcatagagagagagagagagggagagaagtcatttataagcataccttggagatactgcagtttctgttccagactaccacaataaagcaagtcacacaatttttttttgtttctctgtccatataaaagttatgatactgtagtctattaagtgtgcaatgaaattatttttttaaaaaatgagcattccttaatttaaaaatacttattggtaaaaaaaaaaaattctcacaatcaactgagccttcagcaagttgtaatgttttcactggtagacagtcttgccttgatgttgatgactgctgactgatcaggttggtgactgtggaaggctggggtggctgtggcaatttttaaaaataagacaataaagtttgccacatagactgactctttgataaatgatttctctgtagcatgtgatgctgtttgataacattttacccacagtagaaattctttaaaaattggagtcaatcctctcaaacccttctactgctttatcagttaagtttatggaatgttctaaatcctttgttgtaatttcagcaatgttcacagcatcttccccaggagtagattccatctccagagaccactttctttgctcatccataagaagcaacttctcatccattaaaattttatcatgagcttatagcaatttagtcacatcctcaggcttcacttctggttctcctattttcaccacatttgcagttaattcctccactggagttttgaacttctcaaagacatccatgaaagttggaataaattccttccaaactcctgttaatctttatatttcgatcccctcccatgaatcttgaatgttcctttccagaaggttttcagtttacttttttttttttttttttaccttttcaagatccatcagaggaattattagctatggcagctataccttataaaggtatttctcatataataagacttaaaagtcaaaattgcttcttgatccatgggctgcaggatggatgttgtgttatcaggcatcaaaacaacactaatctccaatatctttatcagagctcctgggtgacctggttcattgtcaatgaacagtaatattattaatcttttttttggagcagtaggtcttaacggtgggcttagaatatttagtaaaccatgctgttaagagatgtgccatcatctaggctttattgttccattcattaagcatagatggactatatttagcataattttcaaaggccctaggattttttgaatggttaatgagcattggcttcaacttaaagtcaccaactgcatttgccactaacaagagtcagcctgtcctctgaagctttgaagccagacatcgacttctcctctctagctaagaaagtcctagatggcatcttcttccaatagaaggctttttcatctgtactgaaaatctgttttttagtgtggccaacttcatcaattatcttagctagctagatcttctagataacttgctgcaacttctacatcagcactggcgcttcaccttgcactttatgttatggagatggcttctttccttaaacttcatgaaccaacttctgctagtttccaacttttcttctgaaggtttttttttttcctctctcagccttcatagaactgaagagagttaaggccttgccctggattaagctttggcttaaaaaaaatgttgtggctggtttgatcttctatccagaccaccaaaactgtctccataacagcaataaggctgtgtcactatcatttgtgtgttcacaggagcagcactgttaatttccttcaggaacttttccattgcattcataacttggctgtttagcataagacacctagctttcaccctgtgtaagtgtacatgccttcctcctccagcttaatcatttctagctttttatttgaagtgaaagatgtgtgactcttccttttaacttgaacacttcgaggccattgtagtgttattaaatggcctaatttcaatgccgttgtctctcagtgaatagaaagtcccaaggagagggaagagagatgggggagtggctgttccatggagcaagcagaacacatacagcatttattaattatgtttgctgtcttatatgtattcagatcatggtgcttcaaaacaattgcaatggtaacatcaaaggtcactaatcatagaccatcataacagatataataataatgaaaaagtttgagatactgtgagaattaccaaaatgtgacacagagacaaaaagtgagcacatgcagacggcaaaatattgctgacagacactgtctacacagggctgccacaaacctccaatttgtaaaaagcacaatatctgtgaagctcaataaagcaaagtacaataaaatgagatatgcatgtatctcctctccctctccatatccaaatgtagtaaaggaaggaaaacaaacaatatatttattaaaatactgtattgagaaagggaggtagaggcattacaaaccagaaatttccattagcttctgagattcaaaaggtggatgaagggtattaaatgtataacacaagttaagggaaccccaggaaactgctacagtggtgctgaaaggttaatgaattcttgacttgttgcaggacatggggatcacagtccttttctctaaatagtttgtgttccactgtcttcttgcttccagtagcaaatgtaaaatctgaccagtcagtacaatggttttacctttcaaaatatcttgctcgggaggctgaggcaagagaatctcttgaacccaggaggcagaggttgcagtgagccaagatcatgccactgcactccagcctgggtaacagagcaagactctgtctctctctctgtctatatatatatatatatatatatatatatgtatgtgtatatatatatatatatatgtatgtatatatatgtatgtatatatatatatataatcaagaatttttgtaaaaaatttcatcctcagacttctgaatggttgtcttttttttcagttagtggattattatttgtttgttatttcaactccatttgttacccttttcttcttctgaaatactgttggcatgttagatctctgggatctgtttcttatgattatcatattcttgtggggtttttggtctttgttctaagttatttcttccatgtgatcttattacaaatacaagtctgagccatacctggccttttctaatttaaattccagtgttttattttataatttatgaatcacaatcattatagattttctgactatatccgtttgatggtcctcattcattttatgttactgttttctttgagttcttcatcagttctagtaataatttattgggaactatcacttaaagaattttggatcactcaccattcctcaggttacttataccctttaaggttatttttttttttgccatattttcattatatgtgcccccagccttcacacatggggatattatgggttctgagctaaggcagactttcagtggaggatggtgaaataaaatggaaggcacagtcatttttgctcccgtggtcaggttatgttatctgtcaaatgtgttattctctcttgaagcatctgggtactgcatccccagtcccctctttttttcaccctgagtataagtaagagccctgtatcactcacaggacctgcgggcaatgcagcccagtaatgcaggtgagtgcaaggtgactgatttcctccaagcctaagagagtaactgggatcaagcaacctttgaaagactacacaaagccagtgtgccctctcatcagggagatttgtagatttcagttgattctccttaggaaaaaaatttttccctataccatctgcagaatattagattcatcctccggctctacccagatgcctccagcttgcatgcaccatattctaaatgactccaaagagagttgggaggaagaaggagccagggatgaaaaccttagttcccaaacattccttattttgaaaaggagacaaaaatattgtttattttgaataatgtgactatatatctctaaaacctaaaggataaaatgaaatgctttttaaacataagataattcagtaagattatgggttactataatgaatgtccaaaaataaaacagaaaacatagcaaaataaaaatcgaaagaaaaaggataatgtataataacaatacaaccataaatctcttggaatggaattaataagcaatgtgtaatacttataatgataaaactataacactctcttagaaaacaaaatgacatgtaaagagagaggttttctttgttcttgattggaatatttagcactgtaaagagggtagatatcttaaaaatgtcttcatgaaatcagaacaaatattcagaattccaataggattgcttttctcgggcatgggagtgggacagagagttggaatgctacaacacaaataaatctcaagtacctgatacattacatatgagaggattcagaaaattccttcccaaaataaaatatattataaaactagaattaaaatatgatgtaaatgaagaaatacattacagaagcaatgattttcaagacatcagacatcaggctatgaagaactatgctacttgagtgatgggaacaatttagggaagtcccataaggagtcttcagctaaaaccttgagatagcttttgggaaatggcatatggcagactctctaagaggagaagttgaaaagtgactcaagtttgtgagacagagtactaagagaggtaagtccttcatagagaaactcgaatatcttcaaacggatctcctgaagcatttagcagagtactaatcaacacatatttatgaggaaagtacataaagcttggaaagaacatgtgaaaggattagaggaagggaagcagtgccaaaagctgagatatggtgctgggaattatgcgtgttataaccagacagattggaaaaactcataatccacagggcactaggttagtactcaggaaagtctcataatttcatttggtgtattagtatgagttttccagagatatagaaccaatggaatgtatgcatgcgtgtgtatacatatactttaagaattgattgtggaggctggctagtccaaaatctccagggcagaccagtaggctggagactcacagaagggttgatattgcagttcaagtctgaaggcagtcttgatgcagaattttctcttacatgggggtcctcagtttttttctcttaatgctttcaactaattggatgtgacccacctgcattatggaaggtaatctgctttacttacagctactgattgcatctaaaatataccttcatagaaacatctaggcctatgtttgaccaaaaactggatactatagtttaacaaagttgacacataaaattaatcaccatactcagtattttacagtactcagaagttgcttcagtagtgaggagtaagcagccctaggttgagcactgctctggacccatttaacaagttagaaggcaagactcaaaaggatggagctataggaggaattttaaaaataatttaacacccaacaagataaagttcccagtgtttgttatccaataaaaaagcaggaaaatagcatacataatgaataaaagcatgcacacacacacacacacacacacacacacacacacacacgcagtgtgtagtattcagaagaaagactgctacagtgatatgttaaaatgtattatcagcatttctattgtgatctttaatagacatcttaaagttacatcaaaaaccaacctcctgggccaggcagagtggctcatgcctgtaatcccagcactttgggaggccgaagtgggcagatcccttgaggtcaggagttcgagaccagcctggacaacatgatgaaaccacatctctattaaaaatacaaaaattagttaggtgtggtggcacatgccttaatcccagctactcaggaggctgaggcaggagaatctcttgaacccagtaggcagaggttgcagtgagctgagatcgtgccactgcactccagcctgggcggcagagcacgactctgactcaaaaaaaaaaaaaaaaaaaaaaaaaagaaaccaaaaccaaccgcctgacctcactacaacattaccacatccccaaacatgcatttcccactacacaacccatttcaattgatggcaacacaatcttttcagatggtgagaacaaaaaccttgaagttattattttactcctctctttctctccagttccacatctaattcatcacaatatcttgttggcaccaccgcacctgttgtaatagcctcctcttttttttttttttttttttagtctctgctctcttatagtttaatctcgacatggtaaaacagagtgattcttgcaacatgtgactctgatcagtcactcctatggccagtctcaagaaaggattttcattttattcaaatagaagctaatgtccttccagtgacctacatgatctgctcctccgcttttcttctgacaacatctcctatgattctcctagctcagcactgtctaatgatgaaatgtaatgtgagtcacatatgcaattttaaagtttttagtagcacattaaaatgttgaaaataagtgaaattaatttaataacattatatttaacccaacatttcaaaaacatcatttcaacaacatgaaaccagtataaaaattcaacaagtaatcaatataaaaatgatttttggtatttttttcatgcacagccttaaaaatcagaaatgtatgttatactaatagcacatcttaaattggtttagctcaatagccatgtgtgataaatgggtactatatcaaacagcacagtgccagctcttgcctctccaggcacattggtttcctttatattcctggaacatgccacccatacttttgcttcacaacctctcttatctaatgtgctgaaatgccataataccacatactgggtaatttataaacaatgaaaatttatttttcatggttctggaggctggaaagtccaagatcaaggtgctggtgaaggcttccctgtctgcttccaagatggcgcccttttggtgcatcctatggagaggaggagcactgtgtcttcacatggcaggagaaacaggtcaacaatggggcaattactagttccctccagcttttttatcaggtcactaattccattcatgaaggctccacccttatgacttaatcacttcctaaagccccacctctaatactatcacatgagcaattaggtttcaacatatgaattttggggacattcagacagtaacacagcctttgcatcagttgtttcctcttccaggaactgcttcctccatatataaacatggattgttttcttacctccttccagtctttttcaaatgtcaccatttccatgaggccatgccagattactttatttaatgtatcatttattatgttttaataatacataaattacttatttataatgtttattatctatctctcctctcactgtaaactctcctatgagggcaggaattttcgactgttttgttaatttatatactcccaacttctcataatctctattccatagaagttcaataaatacctgctgaatgaatgagaagaattaatgcagtcggatattatgctctcattccaacaacctagagtcatgtactgattttgagagatattcaggatattttggcaaagaacaaaatagacatattgaataattgtggaaacatatatccttttattatttcaaaacgtgtctttggatatgagtatagctgtgattgagatgacatatcatgtttataaagaaagcataatatctagttgctataattaattgcgtctgtctagagagtagaaatctgtggagagaggacactttcatagtttttaattatacttatatatatttagctttttaaataataagtatgctccttgtgataatttaaaaatacttataggtttaaaaactggtaatgtcataaaatattgggagcaattattctcttgttctaaaaattaactcatttagggtgctaaaatctatttcttggaggtcccctttgtaaaaccctgtaggtatttttccagaaatattcggagacctctacattgtatgtgtattattctgacctccttttgtatagggctatctgcgtttcatcattttaattccaaggagtgattttataaactgttcctcagttcatagtctttgcaattaaattgtaagttgacccactaactgaattacagaaatcagatataaacaaatgaacagatttcagctgttcatttgatatattggtttgaattagttttaatgggccacatggcagttttctagcctgtaattgctattaaacagaattctgtaaattcactgaagatgtttaaatactctgtgtggtaatacaactgatttgtgttttgtacaagttaataactatagattgaattaaaaagaaaatatgaccaaaaaagagggtctatttaatgcagtttttgttttattactttggaagattcatatgtcttaatttcaatttttcttttatttcattttttcaaaataaaattataagaatataagaataaataataataacagtaacttgtatttctactgtgctaagagctttaaatattttttctcatgtgattcttacaataaacctataaagttgatataaatattatctcagtttttacagatgagaaagttgaggtttaagaaggcagaataacttatctatgtccacagagctaacaaggttagaatcaacacttatatattattgttagtttcattctaaaactgtgtttttaagcattatgtcactaatatatttatcctagtgaaaataattcttctgatcatctttaaaaataaataggcctaaaattgcaaagggattttgacctcaaatcgattataaatccattatatgaaactgttatatatggtatcgcatcacaatacttagaacaccgactggaacatagtaggtatacaataaataattttgaattaatgaaattatgaaagttctcatctaatattctaaatctttacagtgaagggaaaaataccttttaaagtgggaagaacaaaagcaaatggcacagggtgttagtatttgagaatggaatagtcaaataaaagggattcaaattcacttgactggatcatttagaaaaactacaaataaagctggaaagtgtcaggctattccatagtatgcctactttacagattaccaaatacatatagtttatgtgagtttgtatacttaacaggggaatatttatttcctctgttaattttatgcatgttgaaatatgtgagggcctggttaaaataagaagccctctctgtagcccagataaaatgagcctctcattcttctccattaaattaggagacattggttggcctttaaatatcattctggactagttaagcaaactcataatgtttgacttctgtttgaccagctcctctctccaaactttgtcaaccacaaaatatcgtatgacacattatatatacctgatgatactcaaatactcttcatctttttattctctaccactttactagtgcagattatcatctgttctagaactaatgatgaaatcaccttcaaattattccccttgtgttagaagtccagcttgttgaccacttcttcccactatcaccatatttatcttcctagaacatgtgtctgttcttaaatcttgctaattccctgtcaccttttgctaattccaggaggaagtgtaaagcttcctcatgaaattaaagaagtctgccacagccacctttcctggctcaccttcccacaatcctccagcaaacctgaattgcaatcataaagaccaactctggctgccccagataaccaagcaccatctgaggctgaatcttgtttctaaaatgctgtagctcttcctttgttatcagtcaaaacccttctcaaacatcaaggctcagaaaaaatgccatctgtttcatgatgtttttcctagtctcccctattttactcctaccttaaaattaagcatttccataaaactttacttatacctacatttattgcatatctccttcccatatttattatagttgtcattattctttccttattggtttcaaactctttatggacaggtaaagtggctcatgtaagtgtttctcttccagtgcctagaacaggacaatatttgcagcaacaaaatattcaatataataaaaatatgttgtttactgaaaaaacactcaataaactcaaaaactacaataaaatattttgtacagaataaagatagcaaagaaaaaaacataattctccatataatggaaaaggaacatgttaaaacttgtattgataactagatgaatatagatggatgttttactggaaaagggaaatagaagagcagaaaggaaaacacatcaaaattattctttgatttcaactttccaaggaaaaattattttcaggtactaagtttgtctgcattgcaaaggagtgattttgtaatttccagaactgtcatcctttgttccactgttgtccttcacccagtatgctctctggggggttttaggagattgcacaccaggagcgctgggcacaatggcactgaagtcttgcagtgcaggaagcctcagcaatcaattcccacgctttccaggtggtgctgtttggttccattcacattaacttttcagctttctatgtgaagaaagcctccagatagtgaagagggagggagagcaataagaccagtgattacaaatccatcactttcattgttccagagccagtagcagaacacagctgatagacaaagcactggttttgttcaataattaggttgtttcttagaggagaatatgaagccttttcaatattttactctttttagaaaatatgtatattgtatcaaacattgtgtagcacacaatagaaatggaggttttaatagtagtccttattgtgaacatcaaatattaaaggcagttttgattagatttggggaagaatcagctctactgcatgcataaagccaaaatatgtgggacactggtccacctgagaagcaaggtagatatttcccaaattaagggtaattcaggagaggtattactattgcgtacacttataaaatatactcaaaatttgggcaaagataagaaaaggatttttaggcatatgggtatgtgtatgtctttctgaaaaaaaaaaaactaaaattttaagaatgctatcataatgatatacaagtaaaatagtctggatgtgaatacatccgggtcttttcaagatggtccttgccaggattttgttgaaatattattttcatgctatcaaacgtcctaagtaaatgtcattgtggtttctttatttactttttgggcccctactttctcaccgtatttccaccaagtctgacaccatgttagctgtaagtggggcaaagagatattataaaacattcttcagtgattagagacataaaaactataaaaaataatgtgttactttgtaaatagaattcaaattagaatttaaccttcaaaatatttttttttggaaagtgatgagaaaacactgcatctatatggaagccgtgcagtataacagaaaatgtcctgttgtataaggatggaacacagaatttatttccacaactatcactggctcctaagacattaaagctagtcacttaatttctggtgtctatcaatcagttcttaaaaatggaaacaatgatgcaaattcataacaagagatcatacaaatattgggatgataaataatatgtgactgtattttagttgcccagtatgccattttgtgattatttttcagaaaggattcattcctgaaagggaattacagaaaataagcactattggtgtgtactgtattattagatatttttacacaaaccattatgttgaactcagaataaaaggcatattttaactggacatagagccttgatttgttctaataaaaccctaatttgcccaagttttatcagtaaccatggttcccacatagtactcatggaggtggccatggtttttattttctaataagactcactgtggtacaaggtctgactcagagcttttcctaggaatataaaaaggataaataaaaatgtaaaagaaaaattatcaaactgtcccttgataactaaatggttgatcataaattggagtgtctatgcaaatgaagtaaataattaaaatctccaagaacagcattgactaggtggttgatgactggcaattataaaagctgaatttttaatatgcatacatccaaggagccagtaaaaattagctcccagactaatggacttgcctttcttccgaagcagaattttaatgagagcattatttataacggagagcccaagaaccagggtattcttgcttagtctcatttttttttccctgacaccttatccattaaactatgaacttctttacagaagaataatactttattccctaagaagtaaaggtcaaaatgacctcagaaattcgttgcattatatatactctaaagacatgccacttaggacaaaagaaatcataaagcctgtgtttctaaatacccaagttgtatatgcttttaaaatatatttcataagatcaaattacattccatatagttttgcccttccacaaattttctgtgtgattatttcctacataagataaaatgcaaaatctttgaaggacacttaaatctttttgcatatatttttataaggcttgagaatggttttaatcattccgatacgtgtatattgttaagctgctaatttctttgaggccattgaaagggtttaatttttccctagaaacaccattttgttattggcagtctgtgttataaacatcacagagtttaggttgccactttcctttttgatatttcaaccggagcgatgtctggttttgctttcatgactctttcccccacagttgtaactaagcaaggactgtttggcagatagcatctaaggagattttattgtctgggtgacagctcccttaaactatgagtcaggcaaaagcctggtccaaggatgagtcagagagtggtttactcagagctgccttaaacagaaagtcactagttcccatccaattctatcccttcaccctcattccagtgccaacctaaaatcatatgaccaagggagatgggtggtaaaagcattatcaggaggaacatgataaatgaggtctcattagtctaagcttgttcccttctgtcacctttttttttgttgtttttaagccctcagtattttagaaacttctatatctactcatatatactgaagaacctaaattttctaaaaaaaatcatagattttattaaaaatctcagaatgtaggtacctttctaatgtccaatatcagatagacaacagacaaatgcttaggataattaggttctttatatcaaccaaggcaaggccaggagcttctcactgagactctttgttcaataaactggagattgtaactttggttaataacattgaattgtgagtatagttaagtttatttttatatgtgttttggcaattttgtgtttcttctcttttttaattgcctatttttatcctttgcacattttcctcttggggaatttttttttttttctgattggtttgaaatacctctttgtgcattaagaccatgagttttttccttgcaacaagtatttttcaagtttgttatttgccttttaatttttatacttgtaatgcataagtatgtttatgcttctgtgtgatcaaatatacctatactttccctaatgttttatttcttatttttatatttagaaaagatgcccctactctgataccagatgaatatttacttatctttttctgtaattcttgtttgtttacaacaaatgtaattcattttggcatatggtatggagtagatctttattgttttccaaatactaagccagttgtccaaaggctacttatcaaatgtcattctttctccactgctttgaattatgtgatttataacatagatcttcgtagctttaatatatacaaaagcaattttttttctagtcggttccagccatttatttgttttactccagtattaggaatattttactatttctagaaaactggaatatttcctcacctagtaagtattgttttttgtctttttagcatcaaatgagctgatcatatagattccctcttttgatatatcaatatactgatgtaattaagtctatattatatcagtagagtttctaacatataaccacccttgctttcttagaataaatcctacttggttatggttttattatattaacacattactaatatttttcagatttctgcatatatatagtataactgagaatgttatgcagttttctttttgatctgtcattgcccagggctttataattttttcttcttaattcataatataaattggaaaatatagtagagaaagttataaaaatatggctgagtcaactaagaaattcaatgattcaccttcatctgccctacccggaaactgtacaaataaccaaagcattataaaaatcgagaaaatctaaaggtctgcaccagtactggaaactaggaaaggagtctatccacacaaagaatattgagtagtttctgctgtatgtggtgcatataacaaatgaagacttttgtgatagataactcacaattccacatcccaagaaaatagtggagtatctcaggaatatagttatacagctaggaagatcttcaatagcatctcctgatttgaataggcaagggctcaaagcaagggcaggtctgtagatagataagatgcaaaacttctgcccaaatagtctatgctcagcacattaaatacaagtatagtcatattagctcaaaagccttcaggcagtcggacttctccctggtatggcattaaaagctataaataataaagtaattcagtaaacagtataaggcatgtagaggataagcttgagatgatcatacagaatataggagaaaaagaaaaaataatgaaaacaaccaaaggaaaaccatttgcatagatgaccgaccttgaaaaactaaggtactgatttttctatattaacccaacatgaactccaacataaaattgggagttactggtggatgtctccatgtttactgcaccaattatacagaagaggcagctgtcagtcagcctttcctatcctccttcaatttggtgttgtagattgctgaaatacactacaatgtttttgtgagtatcatctttccttcatcatcagttcccatttgttatatatatttctttggtcattgtaatcaggatctaggatgaagaacacaatttttgccttattcttttatgtctttatttacttaaggcaataacactgtaatttagttagaaacttagttcattaactcaaaagagaaattataactaattttaaactctctgagtttaggttttaaaaattagtgaaatttctcattggtttcaaaataaattaatcataaatatgtacaagctattttttaagaaacaatatcttaatcataaaagtcacaaattgaacttttttaaaagcattatttacaggaaggtgctttttttcttgctgcacttttctaaagataaatacatgacccttaacatttccagtttccagttgtcacacatctttacaaaggcaagcacaaaatttgcacctgttatatgagagaagtaaatgtcctttgagatactttgacagatacattataacaaagtaaagcaaaatttttagtctttatataaaaataaagtagaaatatctaattaaggatatgaagaaagctggtactatttctgatctttctaatgcccaaatgaatgttgtattgtttcaaagtttcaaattctattaaaaaattgctggcagatatgttcttattaaacatataacatcataccactcctacaccccgaacaatcccacccaccttgagtacaaatcattttcaaaatattgtttgtcaggaatttttcttcagctatataccatttaagaatgacactaaagggaaatactagactagggaatctgtttagggaaatctgctattgaataaaattggcatagatttaataatatgagtttgaagatagaaatgtaggtgtttgataaaaatttaggtaacagaaatgaaagcatttgaaaatagacatttaagatatttaaaaatagaatccaagatgatgtcattaaaaactgtattatcagaaaaagtagaagacaatatattttaattaggaggggtaggactttttaaaaaatgtttaaaaataaaaatgtaatgtattttaacaataggacaggacaaacatcagttttttaattaaaacccaacttggatttagtttctatagtactttagatacttgtatttccaaaataatatacagacagctactcagcatatgtgtgaatatgaacacatacaaatatattaggccatttcaatttttcatcacaaagttaaaatttctagtgacaattagtggttcattattccttttagaaaagtggctgaatataagatcaacatgaaaagataccttgcagtcctatatacttgtaacaaacaactagaaaattaaatataaagtaagataacacttaaagtagcaataaaaaatcaactacctaccaaaattggtcaacaatatggaatttctctatgctaaaaactaaaaaatattattggtggaaattttttctttttttttttttctttttttttgagacagagtcttgctctatcaccaggctggagtgcagtggcgcaatcttggctcactgcaacctccaactcccctggttcaagcgactctcctgcctcagcctcctgagtagctgggattacaggcgcccaccaccatgccagctaatttttgtatttttagtagagacggggtttcaccatgttggccaggatggtctcgatctcctgagctcatgattcacctgccccggccttccaaagtgctgggattacaggcatgagccaccacgcccggccggatattttaaaagacctaaatatatgcaggaatatttcatgtctgtgcattggaagaactcaatagcataaagatgtcaattcttctcaaattgatctataaatttagtgaaataccaaataaaacattccagcagtttcttttatagaaagacaagtgattctaaaattcttatggcaatacaaagggtcagggatagtacagacaagctttaaaaagaacagagttggaaaacttacactaccagatatcaagacctactataagtcttactttaataatgacatggtgatattggctcaaaaatagacaagtagagtaatggaacaaaatagaaggcctaaaactgagacccatataaatgttgccaccacttcaacagaagttacactgtaattgcaatggattgaatgtttgtgtcccttctaaaattgatatgttgaaatcctaatgcccaatgtgacattattaggagtgaggctattgggaggtaattaggtcatcagggtgcacctacatccacgcaaatcatattagtgcccttaaaatggaacacaagggagttctctcactctctgctatgtgagaataaaatgagaaaacagctatgtgtgatccagaagagggccctcaccagaacccaaccatgctagcactctgatcttagactgccagcctccagaactgtgagaaataaatttctatgttcatgaaccactaagtctatggtattctgtcacggaaatctcaactaagacataaatacaatggaagagaggttgtttttatgaatgatataggatcaatttcatattcatatgacaagtaataaactattgctccaaacttatacaatacacaggaattaatcctagataaactatataccttaaagtgaagtgcaaagcaataatttttaaagaagataatggaagggaatagtctaatcatctttgacttttgggtatgtgaggatttattaaatgggccacaacatgtattattactgaaagagaagatagaaacactttcaattatcaaaatcaagaaattccattcattaacgccattatgaactgaaaagacaaccagagtgggagaaaatacctgaaaaaaagctagggtacagaaatatgaagcactcctgtaagtcataataaaaagacagttttcaattaaaaaacaggcaagagatttgaacagtacatatacaaaaaatattcaaaggactaataaatatattaaaaggcattaaacatcattagtcatcaaggaaatgtcctttgaaaacacaatgagataccactataaacgcaataaaatgccccaaagtaaaacagcagataacgcaaactgttagcaaggatgcagagtgggaaaagaatattaataatagcattattttcaatagtcaaaacctacaacaactttaaatttccatcaacagtagagtcagtaaataaatggcatagcttcatacgttgaaataccatatacaatgaaaaataatgaaatactgccacacaaaacaattgaattttataatcttttaaacattataatcttttaaacataggagtgcttcatatttctgtaccctagcttttttttttcaggtattttctcccactctggttgtctttccagttcataatggcgttagtgaatggaatttcttgattttgataattgaaagtgtttctatcttctctttcagtaataatacattttgtggcccatttaataaatcctcacatacccaaaagtcaaagatgattagactattcccttccattattgtacattaattatgtacaatagtacataattaataccatttatgtaaaattaaaaactttattgataaaaatcaaaatagtgtttactttatggggagatagttattgagaaagggcatgaaggaggcttctggacgccgtaatgatctacaagtcaacttaggtattttcacttgacataaactcaccaacttaaacgcttgtgatttcagcactttgctgtaagtatgttatatactccaacaaaaatgttttcttacaaaataaaacagaaatatgcagaagaaaaacttcatatcctcaggggaataatgaaccatacgtccttaacacagaggcgaaattccacagcagccccactcctgaagtccaaggcagggaaatacacacatgatgataattaagtgaaactgatttatttttatctcagtatacatttttgtagcgctatatgacttcatgtgttgtgcttaaggaaatgcattcttatatctaaagtaaggatgaacagattgtaaattcaagaactgtgctggagtttaagacttttttatagtaattgttaattttcttaagtaaagatttctgccttgattacaactaattagcaaataaattttctttctgtcatatccccttatatggaatcaaaaacttattaagcatatgtctatatttgaatgcatttttacatgtgaacatctcttttatatatttaaatgtatatttgacatagtagagtatatatttaaatgcagacacacacaaatacatatgcatttaagttttaaatgaatagtaaacagtgatatggataacccaaaaatcgtttctatttgaatttggaatgtcttgcatgatttttgaggtatatttatcttcttgattacagcttgtttagactgatattaaaattagtctgcactacttgaagacacaacacctgatcttgaagaattatatctaaaacatattagttaacagaaagaaggtatctagggattaagtgttttacactaatattcatccagaaagatcagcaacatactgataaatggaaattaactgtaaattaaattcaatcattaaaataaggacatgcctgaaacaaaattaagaaattggcctaaagtgaaaattagggtatctcaatttattttaattcttcttattttattctgtgtgtgtgtgtgtgtgtgtgtgtgtgtctgtgtgtgtgtgtgtgtgtgtgtttgtgttgagagagtgtatgctacaataaaaagagcacagcccttagattctggcaaacagatgtttgactactgagtctattagttttaaaatatggtagcaagttacttgacctcttgtagttcttattatagaatgtgccttgggctgtgatcgtgagaatttaaccacaatggcatatgagttcatagtttgcttttggttgggcaaagttaataagtaagcaagggacagatcatgaggtagagagatctaggctgaaagatgataaattcactttgggatatattcagtggaaaccatcaacttgtaccctgatcaatagcaagttggatttagtgatatgagctggagacatagttcagagtcatcttatatatgatggactttggaaatggaagctttggaaatgaacccaggccgcctggaggagtgtgcagcatgagaatagaggagagcctggaatctagaagcctaagaataacaacatttaagggaggccaagaagagatttattttgcatcttataatctgatgatacagatgtcattagtttgattacatgtacaaataaacagagcaagtagagaaaaaatatttattaataataacaggcaaccacaacctccgggtacctaggggcaagaatataactgtaccttgtgagggactggagccaggaatgagaagccttcaagggatcccgagaggatgtccctcactcttgtttctgtttcaacctgaatatcttctttattcttctacaggcaggcttcatttgttcttctaaacacatgtttaaaaaagttaacactgaagattcccagttttatgtctcatctatgcaagaggccaactcaaaacaaaagtagagttaaaggccttattctcagtttttgggaaagggcattatttcagatacatatcttaaggcttttcactgattttcccagcactgctgtctccaaagtcatctagtcacttgtcctgagagtgctgagttctcccctccccttggctgcccctgtgcaggcacgttggccagccatgtgccaataattctgcctcaatgaccactttcagacttcaattaaacaccatgaaggcgggtatggaatcaggcacattgtgcagctgccaaaatatccagatgatgtaccctagaaatataggggagtttgatttccaagaagcaaacttgaactgaatcccattccttcttccctcccaggattagtcagagtcatagttttccctgcattctgcccaccaaaatcctgtatggcaaaggatataactctgtagcaacttgctgttccttttgtgtagtagccaatgcaggaatgccttattccctgtctgtccctgcctcacttctctttctctcattgcagctgctctgggcttgcatctcttaagtaaagcgtttgcacattaatccttactttagcctctcttttctggggaactcaggtgatgagaggcagcttattgcttagatgtgttcctgtgtcccctctgattctttctgcaagggagaggaaggcaaagtattcccaagaaaaagacccttccacatgcctctgtgtcttagaaggcacaggggagcttgtttccagaaaagaaggaagcattgccgttaggagagagaccccaaaaatatctgacaaagattaaaagtatagtcatcaagaattattctaggccaggtgtggtgtctcacacctgtaatcccagcactttggtaggttgaggcaggaggattgcttgagtccaggagtttgagaccagcttggacaacatagtgaaaccccatatctacaaataataaaataaaaattggctgggcatggtggcgcactcctagagtcccagctattctggagggtgaggtggaaggatttcttgagcctaggaggtcgacgctgaagtgagccgagatcacaccactgtaagagcctgtctcaaaaaaaaaaaaaaaaaaaaatctgttatttattgctccttttctgtgtgtctcttaattgcaattatcaatgcttttattttacttttctctttaaacagttcaatgaatttgattagatgagttattactataaatatagtatatttctgtgaaaaaataaccctttgaggaaatttattataattgatcacttctgaagagtgaggaaatgacatgataaatatctttaggggttgttgttttcagagtatttctctatgaaattaagaaacaaaaccttcaaatgtaattctacgcccttatcaaaatgatttccttacaaggaatattttggatttccagaaaccatacaatcactaattcagtttaattcactaaggtaaagtagggaagatactgcactattgcccttcctgcagtagaaaaaggcagcaacaaccaacgagaagctgggttagcgcttggtaacagtcttggtgtgatctgtggaatacacgtttaggtctttcatggcacctcagaatctctgcccttccattgcttgttctaagcctaaggtacatctaagatagtcaagagaaaagatcatcatagcaagatagaaagacatgacatacttcaaaattagctctcccaaccactgagaaaaaaagaaaaatcactaacttttctctacttcccacctcaccatcagaaggcagtgtttagctttctacctttcctttttatgcattcagcaagttgtataaagcttatgatatgtagggcaccatttaagaactataaatatgaactaaattatatatcaatgccctcgagaatagtaattttcacaatctggtaaagaaaagaaatctctttgtttgaataatttgttgtgttctgaattcatgatatttaaaaagctaaattttgctacagttaaaatgttttcttatttatagcaattcttaaataagccatgttagaaagtttggattccagagaaggcattaatgcaaaaacttaatcatcatgttaaaattcccaacaaatttcaagcaatacctagaacctggcaattcctattgaaatggcagtgcttagggcaaattggaaagccagctaagaagttttctaccggcaagatgaaagataatgtgggaccaataatataaatcattggcttggaccacctattttattaattgccttattttagaagtcagatttttgtctcagaagaatctgggaatgggagacaagagaaaagacactgactttttaagtgtcttcccaaccccaggtttttgtccttgtttagaagagaaaagagaatttcaaaaacaaaactaatttttattattttaagcagctatttaggtctctaaatagaagccaaatagggtagatgaaggaatgtggactctgcagtcagtcaaattggatttgatatctactttttatcattcttcactgaataaatgtggacaatttacttaacctctgttaagacaaacctaacagaaatatctcagtttgtccatccttaaaagggtcatgataaatatttatgttaatttgtaagaattcaattatatcacttaataaatgacacatacagggcagctggcatacagtaaacaaaagtgaggctgagaattcattggcagcagaattatctgaagacttgagacattaaaaccatcaacaaactcagtaagagactctagtcccagaaatttctcaaataacaagttctataaaacaagatccatttgaaaaattctaaccacattaaggccaggcacggtggctcacgcctgtaatcccagcactttgggaggccgaggcaggcggatcacaaggtcaggagatcaagaccatcctggctaacgcggtgaaaccccatctctactaaaaatacaaaaaaaaaaaaaaaattagccgggcgtggtggtgggcgcctgtagtcccagctactcgggaggctgaggtaggagaatggcgtgaacctgggaggcagagcttgcagtgagctgagatcacgcctctgcactccagcctgggcgacagagcgagactctgtctcaaaaaaaaaaaaaaattaaaataaaataaaaagaaaaaagaaaaattctaaccacattaaagctattttaaatattttatgaataacttagggtaacaatattttaattgtctaatttattagccgaaatcttcaagacacaagcttttcagactaaagtacccaatcaaaacaaacataacctttacttaacacctgtttttgtaattgcaagtttctttaaccagaatcacatggttctcaaatcagactgaacaggaaggcttataaaaatacagatatacagatggagagtcagccccagagttttcaattgaataggtgtgggatgtaagtttttcaagttctcaggtgatgttgatatgcctgatccagaaaccacactttgagaaccactgaataagaaaatagtatctcagatgctttcacatacagggctatatattaatgtaaaataaacatggacatatattatgtacataaaaatataatattagaatttaaatataatatatattacatttaacatatatatatgctatccaattatctcttttgcttcactgaaaaccataattcaactgagatatctaagtaacatacttccagaagtaggatcataccaagactccaagccgcattagccaaattttacctaacaacaaaatctctgttgttggttgaattgtgttcccccaaaagatatgttcaaatcctaacccccaattacttatctctgttttcagtggtacagaattgggaataatgacactctattgggtgtttgcagatgtaattacttaagattagatcatactgaagtagggggagccctaattcaatatgactgatgctctcataaaaagaagaagggacagggacagagagagagaatgccatataaagacagaggccgagattgtaatgctgcatctacaagccaacaaccgtcaaggactgccagccgtcaccagaaactaacagagagacataacattctccctcagagacctcacaacatagcacacaccttgatctcagacttgtagtctccactactgggagaaaattcatttctgttgttttatgccacccagtttgtgatgttttgttatgacagccctaggaaactaataatgcccttcttcccccagtacctgatgattctgtctgcctctaaaatttgcctcacattgcaacattttttagtgctctctcctactcattgtatttttttttttcatccttaggagggtttctttaaagaaggagaggattcagggaaagagggtggggcaaattgtgaccatctctgcctaaatcattagaactcaagagagctggggccaccatggagacacttctggccacttccttctgattccacatcaagttcctcaggctctgggccctgttttaattgtcggcctgtggctttgatatcctcttcttatgtctttttggcactaaaccttgcctttcttcctggctcttcttgcccctcgcttttggcttggatacctctgccatgtcctgcagctggatcgaggaaaacgttccacttgcccttcatttctggctcctactgctctaatttacccagttcttctctgactatccctgagtccactcttaacaatataacaatctcctcacccaagaggtccactcaactctgtttttccataaataaatttctcctcatcaatcttctttcattaaataaaatgtgtctgaaacccaaagacacaagatcttttaccttctcctccacttcttactgtctcatgacttttgggaacctgatacgttgactcttaatactactttagttatactgccatttttaggatatgattgccctgcttctgctcagtaatctccactatttttgatgtctacttctgccctcttctcttccttgtcctatccatctttctgtcttcaggacagcatgacccattcatcactgtcacactgttcgtcttttcatcattgccagatacagtggttctcaactctggctgcacattagaattacctggaaagctttaaaaaactagttctccgatggctttaccttcagatattctaatttaatgggagaaggccttaacatcacatttcttaaaaatcatttatttgcctggtaataatcactggcctaccattatgctcaacagattcaacctttatgatatttttcttacttcctagcctcatagttcttcactttcaatgttaagcattgccactttgtttctcccaccccatcactcagacttgccttacaactcttgataacttgaaataactctaccatttaccaacataatcacaaactctgacactgaaataattgcagtcttctcctcacctttctcacttccagtaaataagctctaaattttttattttgaccctattttgttctttgacttttaaaaaattaccttacatgatgaatttactttcaggtctaccgaaccagacatgtggtcaaccttgtcaataatactaccatctattaggaaggagggtttattctgaatttgtcagatttccatagaggggacggaatgtgtgatttctaggatgaaagttttagaagaatacttgagacctcttgtccagggcctctcatagacacatccccaaaggagtgtgtgattggtaatcatctgactggtaagctaagggaaagaacctgtgggtatatggatcagtctttattcctctcctgagttaaggaggcagttttttttttcttatttaccaggccataagatcatttttcaactctgccaatggctatgtgggtaagccattcattcatggagaaaatacttagatttgggtttccaatctacattttctaattcagctatatccataacaagtctcgtgttctgatttctgtgtgattccagtgattttcttaccattgtttcccaacttatgagaggaagaacctcaagaacagactcaactaattaacttccattcattctgcttttgttgcatatctgacctggggatctggggatctgtcccccaacaactctttttttaaaaaataaattcaagttttattctagatttgggggtacatgtgcagatttgttacatgggtatgttgcatgaggctgacgtttggtatatgaaacttgtcactcaggtagtgagccataatacccaataggtagttgctgtatcttattagagaaatgcacaaagtcctgcttcttggatccactgtaattcttttaaactaagctagactcttattattgcatcctttttaaaattcctagtgtatgcttactattgatgtccttcctcatagcaattcctaccttttctattctactaaagctcttatactaaatccacatcaccgagactttcagtgaataacttcagctcatacagttttgagaaaaccatataacatttatactctttattttcccttcactttaaaatttattttcatccatcttctcttcctttacatgcctcccttaagaataaccattctttttccctcagtacctcttcacaagggaaagattgagattctcagtctctcccctctctaagacttcatttcatcaagtcctctcatttgtttacatctgtaacttctccttctttacaaaataatttctctgcctaagggcatggtcataacaaacaaagccaggaactaaaaacaaaatcctcaattctgttactctttgaaatgacttttttgttttcctcccttcagcacgtaatctttgaaaaaaaaatcatctagattttatgacttttttctcacaccttacaacatgaactccccctaaaccaatggaaatacctcatttataattcatcaatagaatcataaagagcctatcaacaggttttgcttttctcacattcagtctctctcctttctttcctttatccaacccaccagtgttttaggcttcagatccttgtatagatgataatatatggttgttgtcactgccccaactttatatgtacatttacaattactgacctaggctctaactcagcaggtctctcccccaatttatcagcttactctgaattccctacttcaataagtgacacacttatttcctaatgactcaggctcaaaatgtcaatgccatttcatacattcagttactaatttcttcatcattcattatgtacctgcttcttgccaaggaatattttatgtcctggggattacaaagcagaataaaacaatatctcttttcaatgagcttatattatattgaagaagaagactgacaagtaaacaaagtatgtggtaagtgctgttttagaggtagcactgaaagactgttagaagacaaagcagagagcaattcatgttgtgtgagggagttggaagaaatgcttcacagaaagcaggtgctttacttcagtctttaataagaactaggcagttaaaaatagagaaggtaagtccaagaggctggtagggcagaacttataaagtcaaagttgcgtaaagccatgagaaatttggtttgactggaatataaaagcaaaagaaagtaggacgaacaagagtgagtcaaaagacttataattagccaggcatggtggtgccttcctgtagtcccagctgctcgagaggctgaggcgggagaatcacttgaacccaggagacggaggctgcggtgatccaagatctgacatcaagccaatgcactccagcctggttgacagagggagattccacctcaaaaaaaaaaaaaaagaaagaaagaaagaaagaaaaagaagaaaagagagttatcatgaaagtctccatatgttggtatggagttagtgatcaaaattgcttttagggcaatggtcctagcaacaacatggagtgagaaaaatacaaaactttgattatacttcctcaaattcccaaatataaaatcatctgttacatcttgcaaatgtgtcctttacactgcctttaaaaatttttcccctactgtttatattccactcctcccattctggtttagtagctcattacctttcctttgaacatccagactacaaagagaacaattccaatcatgccattcacatagtcataagctgtccaggacacttcactgtctaccacactgaaggtcagttattcatcatgatgttgaaggcttttcacagtgacatagctatctaattatctgctaatatgaagtggacatggtcagtgtcacaaacagcacttttgcgtgatatttatacgtggcagaagcttttcctcccctacatctttgatttgtgtttctttaataccttgaacaccatcttcgccctctgccttttgaaagcctgtccatccttaaaaattgattttaaaatacatctccttttgagattaaaattttaaattactccgaacatatgtgattgtttctttatgctttcatgaaacattgtactttttatatgtgacttaaaaatttatctgatgcagccatcacaccacttattctcatacagcgtaaacttctgacagtgacactgcatgactctggctttcattttctttcatttcatttcaaaatattgccttgcacaaaactgtattaattaaggttgttaccaattccagaggttactacttgtctttttcttcgaaacttcatagttcaagataactatatgtttagtcatgataatttattatgtaccaagcaagaagtaagcaccttaaaaactatcctcagttgctgatatggtctggctctgtgtccccatgcaaatctcatcatgaattgtaatccgaattgtaatccccatgtgttgggggagggaccttatggaggtgatgagatcatggaggcagtccccctgtgctgttctggtgatagtgagtgagttctcatgagatctgatggttttataagaggcatttcctcccttattccctctcttgctgccttgtgaagagatgccttccaccgtgattatgtttcctgaggcctccccagccatgtggaactatgaacaattaaacctctttcctttataaattacccagtctccagaagttctttatagaagcatgagaacagactaatacagttgcctatattttcgatgtctcctccctactctactgcccctagaaagcattaaaaacaagcaaattggatcaatcacatttcaaacttcatgctcagaaagtgtcttcaggcactattgtactgtatgagaaaaaataaagttactttcagtgaaagaattggcatttttaactttgcaatgcccaatgaacaacatgattttgttctattttttactgctcaactcattgatgtcaagtagttactaccagattcaaagagagacactttacctcaaactgcagtgtttacactttcttgtgatttttcattcttagattctattatgtggtttcttcactcctttactcagttctgtcttgatatatcagagcctcaggcactgtactaatatatatcctaaatatttttcttgattccattatataaaggctcccattcttgcaacaaaatgataatggtgagaaataaagagttaaatgcagatttttttgctatcttaactttaaggacgctatataataatgtagaaaaaatgtacagacacacatatagtgaccaaataaaagtaaggtgttattatgtaaaaaagtgatggataccattcaattcttcattttttacccctacttaacatgacaataaactattagcaaacatggaaaattgattatgatatggattatgttaattcagtcattcagcaaatatttattaagtattcattatgtcccaggaaactgtgcaagttcttaaaggtatatagataagaatatatagacatttttctaaaagatgtcacatgataataaatgtaaatcagcaaaggaaagagtggaggtgggaagaaattgagaagtaatgtatgttgggaattataggtgattattcttaagtaccaaaaagagacagaaagccagaggagatgagaacctaattcctattcaacagcaggaattaaccagggaattaaaagaaacttccagttataagcttgaaaatgggagtcaaaaattacagcataagtaaaatttagtgtgccaaccagacactgggtgctatagacaaaaaaatatctagacaaatcttgcccttttttggaagctgaataaaaataaaacacatatggaggcaatgaacaggaagaacatctagaagatctagaagaaaaatactaaaaatagtattctgcacaaattagaaaaataaattaaaaaataaatgatgccatcaagaatatccaaaggacatttactttaaaagacctgatatgtaaacagaaaagtatgaaaaaatgcagtgtgaaaaggaagaggaatacaattaaaaataaattgaaaggttattaactatgtaatagcagatctgatacaacagcaaaggaatcgctatgtggaagattattttacagaccttttccagggagtggaggaagaggatggaagcactcacattgtgcaaaggaacaaaaatattggaaaaaaaaattagataaaagatggctgttatggaagtctgtaaacaaagagccatcaccgagatgaatggtattctgaagaaagtgcaaccatacctattcccaatcttacttaacatctgcatatgcagtttgaaagagctcatcagatacaggtgaaaaaaaccacactgaagcctgttccacaaagttgggcacctgctcccagcactcacagaactatgtttattctaatagatacattctagaaggacattttaattgaaagaataaagaaaaatgtacaagcttacaggaaaaaaactacattagccatactaaacaataaacaattcacttccaaaatatgaaaggccagggcacaacaaagacagatgcctgacaaaatatcactcaatattttttgaaagaataatattctagaaaattataaattaataaaattgaaaaatcagaaaacaagtagaaaacttgaatagaaccataccctggggaaaaaaattgaaacagctgaaaagatctaacctctaaaacagatgctgggaccagatggctttatgaatgagtcctctcacccgttaagtgacccaataatgccaatactgtttaaactattccaggatctgaaaaatagaaagatagcctgctcactgtataaagctagtataacaatgatactaaaatatgggaaagaaaatgaaagaagtaaaaatggcacaccaatttcactttggtatatagatgtaaaaataatataatatttgcaaacttaaatcctgcagtatattgaaataacatcagaatcaagcatattaaagaataagtaatagattcaaaatagagaatatattaatatgctctgtatctattccattcccaccttctcaaacacttcgactgtagagtcctttatggcagagtgggacagaggttgtttttttgggcactgctgggtcttctgtgcctatcccagtatcttgccagagtaatcaataaatctctctcagtatgtggaaaattgaatggagaggttgttggaggctgaggggaggcatttgtaatagatacaagtaaagtttagcaaattaaaaattgataaatttcctcaacagggtatttttacattatgtaccaaaagccttagaaattcacaatttctgagctagtaacccatcttctgagaatttattctcaagaaatggtaaagatcatgtacaaacactttcatcattctccttgtttattatacaagattttcccctgactttcctttaaatgatgcaggttttcacaatacatgcttcggacctttctctacagtgtttctaagcctctttatcctggctcatagtttaaattaccatctctcaccgatgatctacaaattttgcctctcattctaacctatattccaagtccagaacactatatgtaacaacatttttagcatcctcccgcccccttggttgtttcaaagacatcttagcacagtatttacaatattgaatttatgatcttctctcccaaagtttgccattctctgaggttctctaagaaattccatccagttcttcaaatttagaagtcatcactaaaatttcaatccatgaccctccctaaatccatccataaatccctttaccatattttattgatataatattctaaatatttactaaatatcaacttctctttaagacctctactacttctatccaatgtcaagttaatgagtgtctgctccctgggcaactaactagactctgtacacatatgcctgccattctaatacactgtttacactgctatcctagagattcaattttttaatgaggaatatattcattgataacatatctatacacaggaataagcttgtacaaataataaaatactcatctatatacaaatcaataaaagcttttgcaaaagagatatatggagatatgaagtgtgatgatggtgataaaggagaatgaacaaagagaaagaagtggaagaggaagataaagatgaagacgaagaaaaaaagaagaatgataataagaacaagtataagaaagacttttaaaataaaataattatctacaaataattttaaacactaaaaaagatgaaagaacagcaatattcaatttcttcgcaaactctgagaagctcaacaagtctttcaaaagcaaccactaccggaaaatagactgtgacgatcagatgtagtgcctcagagagaggcaccttcactgtatgtcattaatacgtctcaatcacagtgtcaagggtcaaagaaagaaagagtaaaatatgaactggtccaagcagaagatagaaccaataaaccaaccaaataaaataatgggctattgtgacatggatttagcaccagcagttgcttgtatataaaatattcccctcaaccccaattttctttgcatactttattccttcttcttcagatctcagctcaaatataattttcttactaaagctttgcatgagttccaaaccccatgtaacattgtttcgaatatcctgattttactttcttagtgtttatcacagtgattatttgcagacattttattaaagtctgtttcttcctcattagtctttgcgtcctttgagagtaaaaatatatactcatataaacacagggcctatagagtgccttaaaggcattctataaatatctgttgatgagattaataaacaaaaaatgagaacaaataaatgaacaatccaaaatctcgccatactggattattacttttagtttagtttctgagtttaagtctgtcttgaggtcataaaatgttggctacaattaaatgtttcatgtgtgataaaaatagaaaaaggaaatctgtgatacataaaaacaaaatccaagtttctccctctattccctacttcaatcccactgagctaaccagtgctaattaacaacatgtgtataaattcttccattcctttttccttgttcataataataataatagctgatatttatggagtacttattatatcccaagatttgttctaagcattttacattattatttcatttatttctcaaaaatctgtaataaaactactaatactactccattttgcagatggaaacactgaagtatgaagatatttagcaacttaccaagctgggaaagtcacacagctggtcagaaacagagccagtattcaaataaatactcagatgatttggcaccagagtcctctgtgactttatgctgggtctttctcaatgtacacactaacttgctgtatatacctgcataacaatgtactgagaagcattcaatcagtaatgtgtttacaaagctgttagaaccacgcctggcatatagtaaacacttattcagtgtatgcaattattgctataatgtttatttgttttaatgagatataatcttgctatacattagtctataacttgcttgtattacttagcataagtattggatattctctcttgttttctagtttacttatgcatttaaatatgtctgtacacacatagaaatcattttacataaataggttcctgtatgcttagaatctcctgtttcctacaattcctatcttcttccctttatccactctaatgaacatattaacaacctgatcataatgtgttttatgaaatattattattaatccaactgtacctccaaattcaacagaaaagaaaaaacatttccaagaacaacagcaaaaatcccacaaacacacttccagacaaggtcctttggtcattgtacaatacaatacctacttctgtgcattttgctttacttgttcaaatgtatctgatagaaataactcaaaatcaatcaataggattctattttattattttattgactatatagtaggcaaaggagtaagagtttatgtcaaaattattttcttgatgagcagtcacttcatttccaggtttttgccaccataaatggtgctgcaaaaacatactcagatataaatttacacatgctgcttttattgcaaggttaaggagcacatcattttaaatgttaatagatgttaccaaattgcttttccaaaaggctgtaacgattcacatttctaccatgagtaaatgaaagtactctcttccccacatgactgccaacagcaggtgaattggtagttgtcactttattttgcatttcactgactagtgagtttgaaaatcttttcatacatttattgtccatttatatttccttttatgtgaatggcctattcatatcctttgtctgtgttactatgaatatatatataaatatatatatatatatggccctttatctgtttatctgtcatctgcattgcaaaatttttaacaaatcaaattttttcctgttaccttatttattgtatcttttgccatggaaaagctttatttaaaattttgataattaacttattcatattttatacttctgccaattattaacttattgcctgtcagcttcatacccaaccttctaaactcagctctgtgatcctggagctgaaattgcaatttccatttctgtttaccagtagggtccgtgttgagctctggccacagtgggagctaagggagatggcaaggctggaggaggaagccaggacctggccttttctatgtactccttgtctacttcctgtgtgcctccagaggactcttgtgccttgattcttcatcccagcagctctttttatggcagcagctaaatcaatttcaatttttgccaaactcatagaaccattctcattgcaccctcttcagagacactaacagcacctgaggagcacctcattttagaggtttgagtttaagcccttcatctaagtcttttaagatttaataactcaaacttttatttggcccctcttccctaggtattgtagttgcttggtacagttaccacctctctgatcctttagttctctcttttaacactttcagctacctagttagtaattttatatatataatagttgtatcttaaattatatgttttggaataaatgatgtggtttctcttcaacagtgatataataattcataaattaagttgggttatttgtattttcttaggaagtaatctatttgctctggattttcaactttattgccatagtaatgcttgtattttcttattttatatgctattccttctatacattttatttaatctcttctatcattctaatgtatatatatatatttcacttgattaaaataactggattatctatattattggttttgtgggtgcatatgtgtatatatgtgtgtgtatgtatatgtgtatgttgtgtgtccatgtatgtgtatgtatctttgtgtgtatgtgattgtgtactcatgcacgcgtgtctatgggttgatgtttgtgtatgtatatgtgtggggttttttaacagccatatagcacagcataatgataaaaacattttgtagttgttaagagagtatagctattaacttaatgctctagtgcagaattcaccaaactttttctataaaaggctagttttgcaggcctatagtctttgtctcaacaaattaactctgcgattgtaataccaaagcatccataaacaatatataaatggcatgctctggggtcactctctatttgaatctttgccctctatcccatgactttgcccaactaacttaccttttagtgtctatatctcatcttaaatatcaccttcactaggagcattccatgtttctctactggatccttattatttaaggtgtggtctgtgcacaaggaacgaccatatcacctgggagcttatgagaaattcagaatcttgggctccatgcagtagtgtgtcagagttggttcacactgatttgtgaaagcagaatacgcacaactcttcccaaatcagagttcagtgacattgagttggtagcttgaaattgtccacggagggaatatttataccatggcagtttgcaaatgctacaaatgagagtgttttatttaagaaaacaaaaaaaccttgtttcttgcagagcattggcttaccccagacctactgaattggaatctgcattttaataagatctccagggcatttatattaatattaacattaaaatttgagaagcactgcagtagatcattttttcccaaagtacatgttagaatcacatggcatgctaattaaaatacaaagtcctgaaactcatgtgtacatagattcagaacctctttaagtggagcctcagaaatcctttttctgtaaaaatatgcgttataaacaagctttctgcttggttcttaggcaccctaaaatttgacaattattgttctacaatatctgtgcccagggcatgctttgttttctaatttataatagagcagaactgtagaatcataaagaattattcccaggccttgagacctactcacagaacttacacaatttgtatggctgaattttggaattattatggactaatgacccttttatgccttcattttcctccttttagaacaggaatgtatacagttgttattctgtgcctgcccaacaatgtatatttggtaatatggggtagatgatttgtctattttagtttcacaggtctacagatagagaggaatggaatttaaggagctacacttaaactacgtcccaggtgcatcatccacacctggatctagttaggtagccggtttctggacgtcagatcgttgccaattggatgaaacttttgagaggacttggggaggggctgcatgtgggaggactgcttaaggactttctaagttccctcatttgcttaatgatggtttcagaatcatcagggttggagtgtggggaggatgatgaggtggaaggaactcaaaagttcttagcacattggaaatctagctcagcactttgtaaaataaccatatttttaaagccaacccccttcatagcgtttatcaaagtccctacattgctggggatctcacatgtgtaattcacctcttgagaattgtgtgtttctctggccggttgttttttatcttttttccctagctcatcacatataacagagaaagcagacacacacagaaacccccccagaaaccttttctccagttcaactactaaccctttcatatgctccacatggaaaaagagcttcaaattaatcacacgtgtctatcatacacggtgactggtgttcactttggagtgtggactctgttgttgtcaggcttagctcaaactttggatttaaatatgctattaactctagtagtgtatttgacacttagttaattttaaggaaatatttgttgagcgaaggaaagccacctattataaaactgagaatattttatatttcagggtttttcctttctgaatatgtgttttcatcctattttaccaatgatcttaaaaattcatgtattatagaaaaaaatgaaaacttgtattggcttcataatttgggaagtaaatactatcatataaaatatagatccttaatgtgcataaagtttcagttatgcaagatgaaaaagttttggagatctgttgtacaacattgtattatggtaaacaatatacagtagagttaaacatttgttaagatagtacatctcttgtgctttttaaccacaataaaatatttacaacccctcagaaaccttggaaaaatgactgtttctatgggggaaaataaaaccctattaaaaataataatagtatatatatcctaaagcaggcagtaaagtcaataataatgtaaaacaattttctgaatttgggaaaattgaattatagaatgtaatggtgagaataattaattgaatatataatagaaaaagaagtatttaaattttgactctatttgctctgagatttcattcttattccctttggcttatcaggggcaagtgagattgactctgaactttaatatttatttgtattggtatattagtgtttccctctgccattatactatatttcctttgcattatttccagtgaattttatgatgctggtagttttacatagagaggttggtttttttaatgcaaaaaaaaaatgtagaatttttttcaaggaaaatgtaattctgccaagtactttggttcatttgatgctgcctgtttaactctgttcggctcaatcactgtgttggacatattgtgacaaaggctcattttcatcaaaaggaatccccagagggtttgctgcttcaatgaaagggaattcattaaatatagtctaatgtaaggtgattggaatatatatattccgatacacatatgtatataattgcattttagtcagttcttatgctactgggagcgtttttttaaacactcacttctaaatgaagaatgctgcatgaaagctttttctctttctgaaaaacagctggtttcttcagcaattcaacctagaacaaagaaataaaaaatactacatgctaaagcagatccgcagtaaaaattttgtagaggcaaggcaaagtaacattaataaatgaagctaattaggcttgatttgcatatttaactcatcttaattacacaaggattcagcaaacattttaaaagctgcaatcaatctttcacagatatggttagttatttacatgaaataacaaaaactaggagctttgttaatgattactctgtttctaatttatatgccagtgagatcatttcagtattaataatggaatatattttttaacaacctgtaaacccataaggttaaaattccaaagaattttttcacaaatatgtttttgagaatttccagaatatatgaaatgttatataaattgctctattgtattaaaatgttttaccttgttcaaataaaaaaagatctttataaaattcttttgacattaatttttaaacttggaaactaaggtagtagccataatagagacaagcagaatatagtaggtgataagtaggagaattttttcttgcagctggcataaactttaattctgctcacccttggatacaatttgctttctcatctttaatagtacttttgactggtcacagaatttgaaattaaatagggggcataatgacacaatatgattctttttaatttcagtgttttatttagataaattattttgtaaaaatatacgcaggaatgctgtctctgtgttgtgatgtgaggggctggcaggtgcacttgaagtggctaagtacagaaggttctgtggacaagaacgcaacagtgcacaaaactttatgctgtgcagctgtcagatggttgtgacattccattattagggctccatttcttagatttttctctccatgagtgtccttttataacatcaaaaatcttgacccttttgcttaaattaccttgaaagggtggaggtcatgtggttaggaaaggacagctggtgaagggtgcatttaccaaacttgcaatgtgtgtgtgtgtgcgtgtgtgtgcattagtttaaaaatatgtattaaatgcttcccacgtgctaattcatcgttgtggttataattatgaagtgataaagacggtacactaaatgtcatctctgctatcatagagcttgcaatctgcatattatgactatgtaattgttaacatttattgagtacttgctttgtcacgggcagcaatcaaagcactttacaccaattcacttgttaaatccccaaaatggcactatcatgtagatactatattatttctattttacagatgagaaaactgaggcttagagtgttccaagggcacagtaagcagcaaagcccaaattcagacccaagtagtttcgctccagacactgtgcttttaatcattacattatatgcttgtatgatatccaagtctgtttagatatgtattcaaatatgtaaaatatacaacttttcattttgagactgcatataagcccaaaatatattcatgcaatataggtacaatacaataaatagtataaaataatgtcacagtttaccttttgcaaccagttaatgttctaatggctattgtattcctaagacattttatgagtagtagaataaagatatctgtagctctttgcaaggggttgaattgtgtccccttaaatccatatgttgatgtcttaatcctcagtatcttggaaggtgactgtatttggagataaggtctataaagagataattaaaattaaatgaagtcatcaggttgggcccaaatgcaatatgactagtgtcctcataaagagattaggacacagatagacacagatgaaaggccatatgaacatatagggggatgacagccatctacaagccaagtggaaggactcataatgaagccaaccctgcctacactttgagcttggatttctagcctctacaactgtgaagaaataaatctctttcgtttaagccacccagtctgtgccactttgttatggtagctttagcaaactagtataaacttaattgtgtctaaggatgagaacaccactcaatatctgaaaccaaaaagctgaatgtataatacacttaagtgtggaagaattatactggtcagagttacccattgagcaaatccaattgctgattttatatccagtttttgtgaagagtttactttggattgtgctggttacagaggcaggagttggttgaagtcagttttagaaaagtagcttgtattggtcaatgagactttttttttgccagttacagaagtagaaaaaagttgataatagcattagaaacatgttcactgtagtgaatcctgaaccagttggctgactttcaagtcgtgtctgttgttatttgacttttacaggagtgctcactgaagttacttgtcattgattaattagataggtttaaaacccactctgattgtttacttgtaagcagggctgtagaactgttgctaattgattagatgagtttataactagttctggtgcttgtgagcatggatagagaacactgagtcttttcctgggagagtggtgacttttaaaattctcagcagccaacaaaaattaataggtataacaaggaatagagaaaaagctacaaattaatctataaataacaatatcccttacttgtgtaggcattatgttaattgctttacataaatttctcccactgtaaatggagatttaaaatattactaatttcctatggtagagatgaaaagaattgctatacacaaagtacttagtaaagtgtttatacgaataagagatagtatcaataattttccaataagctgagttttaaactctgcaacttcactcaaatatcacattcttaaccaccacaataataataaaatgcatatatattatggtttcatttatatgaactaaggtagatacatgagacagtgaggaaaggggattgtatatgtatgaactagtccatgaaatatacaacaaacatgatttatggtagttgcctctggaggtggcctaaaatgggagactaacttttcattggagagtgttttgtaatatttgactttacaaccatatttttatatttcctttctcaataaaatatagttaataaaaattgtagggatgtttttactaagaagggcatgagagaatgttttggaatgctggaaacatttcatatcgcaatctgaataacaattacacagatatatacacagataaaaatgtattgaggtaagcccctaagatttatgcattttagtgtatgtaaattatatgtcactgatatggtttggctctgagtctccacccaaatctcatctcaaattacaatcctcataatccccatgtgtcgaggggagacctggtggaaggtgattggatcgtgggggcagtgtcccccatgctgttctcatgatagtgagtgagttaacatgagatctgatggttttataagcatctggccttttccctgcttgcacttctctcttgcctgctgccatgtaagacatgcctgcttccccttctgccatgattgtaagtttcctgaggcttccccaggaaaattaaaccttttttctctataaattacccagtctcaggtattgctttatagcagtgtgaaaatggactaatacaatcactaatataaaaattgatttaacatatcaaaaaggcattttttttgttttctctgacatttaatttatttcatttgtttaacttttaggttcaggggtacatgtgcaggtttattatataggtaaattgcatgtcacagggatttggtgtacagattatttcatcacccatgtaatacgcatagtacctgataagtagtttttcaatactcgtctttctcccaccttccaccctcatgtgggccctgatgtcttttgttcccttctttgggtctatgtgtactcaatgtttacctcccacttaaataccaaaacatgtggtatttcgttttctgttccttgttgctatgttagttcacttaagataatgacctccagctctatccatggtcctgcaaaggacatgatctcattcttttttacgcctgaatagtattcatggtgtatatgtagcactttttttcttcatccagtctaccattgatgggaatttagattgatttcatgtcattgctattattaatagtgctgcagtgaacatatgggtgcatgtgtctttatggtagaaaggcattttaaaatctagccttggaggaaaaaaaatgagtgaagtggactcacttcatatttttgtcttaaaattttttcaaaagaatatggaattcattgattaagtaagtcattataatgagaaaggaaattcataagcattagcactttaatgattttagtgataatatgcttggctacttattttatgatttaattttggcctaatttttaagagttttaaaggtttttttgtctgaaatatgacttttgatgagtattacttaatttttttttcaaattttcacatgacactattgacactaaaaagacttttactattttgagggaacaagcttaatctttatacatagggttcacggtcagtcaggctaggctagcttgtgttatggtaaaaaacaacctccaattctcacaacatgtgtgtcctgcttcagttctatgtccttcatgggttggaagatgggtgtggggcattcctgctggtcttcccagggatccaggtggatctctcagccatgaccttgaatgttgtttgtttctgccagagggaaaagggactcctggagggcatttgcacctatcattaactgctgaaaatgcgaagttgggaagagcctgagaggagtattctatgtcatttccattcaccactcttaagccagaactcattacatggtctctcataagcccatggagggttaggaggtgcgtatctacccagaaaggaggaatattggaaagatttggcaaacagcctcactcactccatcttcttgcacataaagggctaggggactttggaatcaggcaaaactggaaaagtgtcatgactctgccactttttatttgtgggttagatgccactgttttcatctctagaatgtgaattacaatagtacctatctcctagcattgctgtgaggattaaatatgataacaactgtaaaacatttagcataatgctttaggtatgtaataaacacttgatgaatgtaaagctgcatcctccacctggaatcaccatttccctatagttgtttaaaatgttaataggcaatggaaaagtcaatgggtgaatatgctcccgggttagaactacactgaagcaaaggtgttggggaataagaaagtgcacgcatttcatgtcatgactgatcagaatgaaaataaatattgagaagactaagctatttgtccaataataaagcatatctggtgagggtggttttttgtttttttttttttgcaatttcatttataatctccatgtaagtgtgcttactttttcattcaataactgtatcgtatcttaccagagatgtcttaggccttggggatgagaagacggaggagtggatgagtttgtcttgtggagcgtaattttagaggcaggagactacaataaataaggagaaaaattcatgaagtaattttgttaatgaggagtgatatgaaggaaacaaaatggggtgacctatttgtcaagtattggcatctgtgaatataattgaaccctgaaatatcagggatgtgacacagtggaagctcagttctcattcatggactacccaattgtaaggtcccgaatggcagcttttctctctgtggtggttgagaaacccaggttccttccagtttatgctgcctcatcatctagaggccttctgcgtatagcctgcaaagaacggaaaatcaggagtttggcagattatggtggatattttctaagggccaggcctatgttggacttacttcacaactgtctgtgttagcagtggaagagatcagagttaccctgatttaccgacggcaaatccataggtgtctggagcaaattcagcctttgcctgctcagaagaaagaattcgactgaggggcataaagcagaaaaagagaccgagaccggggcaagttccagaacaggaagaggagtttattttaaaaggctttagaataggaaagaaaggaaaattcgtttggaagagacctaagcgggctcatgaaggatcaagggagaaaagggagcaaaaaaagggaggcctttaaccttgttgctaggacttcatgggcttgcctctttcccatgattcttcgcgtagggtgggcttcccgcatgcgcagtgttttccttaccctttggaattgagcacaggcatgcagtgtgtttagggaggtatatgcatgcccatctgaggttttttcctttctccagtggcatgtgccccccagaatgtcatacttcaccgttttgtctcttaacacacatgcccaagaagctgcttctccctggggcctgcattcaattaacactttaatgttcacaagcgtggaccatcaggagattgtctctctctggctaatagattaaatatcatttttagagaggcaatattgtggaaccatcacccaacatttcagtgggtgatgggagaggcttctcctgcccagctcttgcctaactacctgtagcacctgcatttcactgagcagaactcagtcacatggccacgcctgacctctagtctggctgtgtgcccaggaggaaaaataaaagtgtttcatgaaacagtttctgctactctaatgactggttgtaagagagacgtcaggaaattagatctcagacagcatgaaaaaggttgtgtttgagttgaaagcagcatgggaaggataaggacatgtgtatatctagatgagaacatctgcaataaaggaaacagaaagcacaaaggcgggagcattccaggcagttagaaaacaggaaggccagtgtgacagctgtatgttcttgtatctaactgtacttagagttattatcctgacagtacaaaggagttgtctggatcagatatcaaaccatttactcagagagaagactgtttattttctattcctcaattccttatgtagggggcagggagggctgggtgagaaccgggtgtaccttgtgggtacagaaggaaaggggttatgtaccacgagaaaggaaaccccaaaccatgaaactcaattttctttcttccctctggggagtgggggttggagggagagagggaaacagagagagagagagagacagtgagagagggagggagagagagagaacattaaagaaacctttgctctgaaatctaaacaaatcttcccaaaaagaaggaaagcatcggtttgcaatccttggatgtgaaagaatgcctcagggtgagatgtccctgtatctccccaggggtctctatctttagggttgctattcagtcattctttaactcaggtgccagaactctgcttagaaagccctgaccatgaagaaatatgaaaatattcgaggaacacagtgaaaaggaagagtggtaaaggatgaggtcagatacagagacaagagccgaacaatacagggccttaagacacaggcagagagtttggagttcttttagtgcaatgataattttttggttggctgtatgcaggagcgtgacatggtctgattcagcttttgttggttgctctagtggcggtgaaggggatgactgggagtggggtggagtgggagaaggaggctcctgccatagtcagggtctgtaggatgatggcctgcccccagagtggtgatagtggcaagggatgaagctgggcagagtagggctgtattttgaagaaagacttgtagtagataagggttggggctggagtgggggaagaaaaagaggtattcttattcccaggtttttggttgccttggtttgtttgtttgagcagctggtgatgccatttatatgtataaagatttcgtgaagatcaaaatagacagttgggaagtagtaaatcaacaagtcttcttttgcttattatgtctgacgtgctgcatcagacaggtcaccagcaggaaagaggggactcacggagtaagctcaagtttaatgtttacagaggtatgggcggcattaagggagctagcacagcagccagggactcgcaacaatgggaaatcatcactgcccactaccactgtgtctgaaaggggaggggaaggaaagcattactggatgcagtgtgcaagtggccatgagaaaggatacaggagctgtggaatttggtagagaataaggccaccgacataatcacagctgaacgggaggtagcagaagtggcaatttatccattctctctttgtgcttatccatatcctacaggcgcttccctctggctgaatccaaccagagcccagaagtcctaagaacataggcaatgtagttagtagagagcctggcatagggcggggcagagccatgcggagaatgaatctgagggcaacagaacaaacagcacccatgtccacaagagctctttaagaaggcaaatagacattcaaagttggaactcagggagaagtaagggtggatatgtcaactggaaaatattcagcatttcaatagtatatgacaaatattaagagccaatatttgtcaggcccttactctgtgctaggcaacataccaacatttcctgtgcattattatctcaattaattctcctaacaaagctataggttaaatgccattatctcattgtacatatcaggcaactgaagcacagtaaagcaaagcaatttgtttaaggtcacacagctattaggtggcagatccaaaaattaaatgtggccatttctacccccagggtcagtgatagagatcattattacacacagcttctctgtctgaatcaaatgctggagcaatgcatattgggtcacattattattattttttttgtaaactcttctttcttttttattttttctccttttgaaagacaactattctgacaagaattcatcaaagaagagattccaaattttaatgtcccagtttgagtattgcttttgattaaggctgtttgcagactagaatgttagtaaccctcacattccctataccacaaaaagaggagattcacttttatcttgggaacaaagctgtgtagaaaagctttttaaacttattttaattcatgaaacatttatcttcgagtcaggttttgttatagcagcacaaatgtggtccgtcagcatttcctttataaccccatatttccagggtttttcaagagtgccatagagattctactttgaattaaaacttggcattcagaatttgaaaaaaaaagctactacacttttcattaccaattaatcaaatagtttagcgattctcaagttagaaaaggaccaaatgcaaaactttcattaatacaaaaatattttaagacaatttgctaatttatatctttgtaaaaatattaccactcagtatacaagtattaatattacatcactgtatattagttctcaaaattaaccaaaaaatttctaagataatataaaaaactatgacatcttatgctttgcctttttggctttgtaagtaatttatttctattttgagaattgggatgatttgaagttcttagcataattggtttaaagttataacagtgtcaagatactgagccataataacaaggatggttgagattctgagagagtatcaaagtgtttcaatttatttttgtgaaatttaaatttatgtggggaaattttgcactctgtgaacaaagatttgtagcatgaattgattctttaaattgatatttggaagttaacttgctgagtacaatgacgataatgaggaccaagtagagattagtttagttataaagcctttccaactttgcttggttcagagatactccatgaatggccaataacagtgaggggcatcatgatgatctacctttggtagctcattttgcaatctcttctgtaatctctcccagccttcaaagatttaaggttaaataaatacaaggtagtgaatgagagtagatgaagacttttgagtgaatctactcttctgactgacttctttccagccacactggcttccttgttgttccagaaatgtgtgaggcaaacatctacttggagacatttgctctagtttttcttcctacctggaacacttttcctccagaaaaactcccttcctatactttggctatactcccttactatactttcattggctaactcccttactatactttcattcttggctaactcccttactatactttcattcttggctaactcccttactatactttcattctttattcaaactttatcttctgggtgaagccaaactggataactctacttgataatgtgatttcccttagttcccaaatcccaaaattcctactattactaaccctgcctgacaatttcttctcttcagacttattatcttctagtacattttatgcctttatcacaaaatgcccatctcctccactagaatataaggtccgtgagaataaggttctttgtctatttgttgacatatcctaagcacctagaattgtgccgacaaatattaattactcaaaaatatttgtcgaatgaacaaatggttgaatgaaatctgaatttccaagcacatagcaagactctccaagcaatagtccacatatgactttcccttgttctacagaatttgggttatttccctacaagagtcaagaatgcccgttgaacactggtgttcaaaatgaaaggccccacatttagatatttagatccctattataatgtgttataggtccatctttcccggaaacatttaaactgaagctgggatgtttttgtagttaattttaattttagctattatttggataagttaaattgaatgaatagatgtgaagtttggttctcacaaaacaaatgcttattctgtatttaaaaatgccactgtatatattttataaatttttatacaggtaataatgttaatgctgaactgtgaaaattcaggagctaaaatgtgattctatcatttaaaaagaaaaagagagaccccactgcctacccccagcagcagtagatatgctgtgctgaaaataacagctttctaataagggagttcttaatagtctttggcctcagggcttgaaagctatgctaattgagaaatgcagccacttagtgagagtttactaccagctcagtggtgtaaaagcaacaacagtagaatttcagtgtagataccagtactatggtatgctccccgctctaggtctgtactattctgaatagtagttgatagcaaaagctagaattttctatggtgagaatgtattaattctgggaggaggggctaaaaattactttaaaacttaaaagcatctttgaattcctttttacgttccaaaagaaatttatttgactctgtttctgctttgtcttcctagggtatatgtgagcagtcactttatggtcacatgcattctatcaatgatgccatttttgatcccagggtaagttcagttctcccagtaaactgtttttaatgcttcatatatacaaattcatttttataaaacaaatttccaagctaaaatggtaagttaatgaggtgagaagaacaactttaggaattagttgtaaacaataggaaaagtctataggtatatagggttgcagaattttaaaattcacacacacacacacacacacacacacacacacacacacacccccacacacaccccaagtcgtagcaggagtgacaaggaattctactgtagtcaactttacttaaacacatttttaagagccttttgtccaatttgggcttcaaaaaaataggtgggctatagactgcataaaattttaatgaaaaatcattaaaataactataattgctctgtaatttttctgtaagaaaacctggagaagaaaaagcagttaaagaaaaaagttttctccaatttagaacagaacagctttgatttgacagctttttaattactcatggaaaagtttcaaatatgtccttcttcataaaaactgatgacaaaacaaaaatattttatctgccacttgaggtattcattcaggtgtaaggatgatttcacaaacaatgaaaattgttggagagtcctttgagttttctgtggtttgaatgtatccctccaagtttatgtgtcgcaaacttaatccccaatgcaagagtgtttggaggtggagccttataggagatgtttaggtcatgacactggcgccctccctcctgaatgggttaatgtctttgaaggaagttgaagctgcaagttcagtctttttgctctcttgctctttttcctccctccttctgttatgggatgacacagcacaaaggccttcatgaaatgatggtgccatgctctgggacttcccagcctccagaactgtgagaaataaatttattttctttaaagttatccagtttgtggttttctgtaatagcaacagaaaatggattaagacagttgccacgtgaattaaggatgtctttaaaagggttcagatagtaatcaaagaaggatgatttaagtctgttctcagatgaaagagatttgactacatagatgacctctcaggttcatttaaactctatgatttaattatatctaacattttggttgtctcaaagttcccagtagagtgagaatcttaattccaaattccacttcttttccaattagctataaaagaaatctgatggattacttacatctaacatcacaatgatagcatagtcaaaattctgttaccatcctgctagtatcattcttttagaaagaggaaaaatgctcactaaaaattatatctactaagggaatgttgattgctccaattgaaattgtgcttgtgtcattgtcaggcctgggaattttaatgatgggctcaaccaaaattacattttaatagattggtctttgtaagaaatattctatctaattttctgtagtgagccaattagttggaaagtattatagattagttctagataccaaggaatattttatttccagcagggtatggaaaaatttaagcactatggacccattatgaaatagaatatagttttatgctgaaagtccattaagtggcgtatagcttcacatgccctacaaaaattaaatgggagctgaaatgaataatattttgtaaatcaggcattttattttggcaagcaatataataactgcaaaagacagcattttacattctaaatattaaacttaataaatatggaaataagcaaattagatttattgaattagcaatcaagagagacatacattaatttcccatatttcaaagggcaagataacagatatgaggtttaggtgtccaatatcaaagtagctaattttttttattattatactttaaggtctagggtacatgtgcacaacatgcaggtttgttacataggtatacatgtgccatgttggtttcctgcatccatcaactcatcatttacattaggtacttctcctaatgctatccctcccccagcccccacccctgacaggccccagtgtgtgatgttccccaccctatgtccaagtgttctcattgttcaatcccacctatgagtgagaacatgcggtgtttggttttctgtccatgtgatagtttgctgagaatgatggtttccagcttcacccatgtccctgcaaaggacatgagctcatccttttttatggctgcatagtattccatgttgtatatgtgccacattttcttaatccagtctatgattgatggacatttgcgttggttccaagtttttgctattgtgaatagtgctgcaataaacatatgtgtgcatgcatctttagagtagcatgatttataatcctttaggtatatacccagtaatgggatggctgggtcaaatgttatttctagttctagatccttgaggaatcgccacattgtcttccaaaatggttgaactaatttacactctgaccaacagtgtaaaagcattcctatttctccacatcctctccagcatctgttgtttcctgtttaatgattgccattctaactggtgtgagatggtatctcattgtggttttgatttgcatttctctgatggccagtgatgatgagtattttttcatgtgtctgttggctgcataagtatcttcttttgagaagtgtctgttcatgtcctttgcccactttttgatgggattttttttttcctagtaaatttgtttgagttctttatagattctggatattagccctttgtcagatgggtagattgcaaaaattttctcccatcctgtaggttgcctgttcactctgatggtagtttcttttgctgtgcagaagctctttagtttaattagatcccatttgtctattctggcttttgttgccgttgcttttagtgttttagtcgtgaagttcttgcccatacctatgtcctgaatggtattccctaggttttcctctagggtttttatggttttaggtctaacattgaagtctttattccatcttgaattaatttttgtataaggtgtgaggaaaggatccagtttcagctttctacatatggctagccagttttcccagcaccacttattaaatagggactcctttccccatttcttgtttttgtcagatttgtcaaagatcagatagttgtagatgtgtgttgttatttctgagggctctgttctgttccattggtctatatctctgttttgatactagtaccatgctctgttggttactgtagccttgtagtatagtttgaagtcaggtagcgtgatgcctccagctttgttctttttgcttagcactgtcttggcaatgcaggctcttttttggttcctgaactttaaagtagtttttttccaattctttgaagaaagtcattggtagcttgatggggacggcattgaatccataaattaccttgggcagtatggtcattttcacaatattcttcctatccgtgaccatggaatattcttccatttgtttgtgtcctcttttattttgttgagcagtggtttgtagttctctttgaagaggtccttcatatcccttgtgagttggattcctaggtattttatctttttataactattgtgaatgggagctcattcatgatttggtttcctgtttgtctgttattggtgtataggaatgtttgtgatttttgcacattgattttgtatcctgagactttgctgaagttgcttatcagcttaaggagattttgggctgaggcgatggggttttctaaatatacaatcatgtcatctgcaaacagggacaattcaggagcaggttgttcagtttccatgtagttgtgtggttttgagtgagtttcttaatcctgagttctagtttgattgcactgtggtctgagagacagtttgttgtgatttctgttcttttacatttgctgaggagtgctttacttccaattatgtggtccattttagaataagtgcgatgtggtgctgagaggaatgtatattctgttgatttggggtggagagttctgtagatgcctattaggtctgcttggtgcagagctgagttcaagtcctggatatccttgttaaccttctgtctcattgatctgtctaatattgacagtggggtgttaaagtctcccattattattgtgtgggagtctaagtctttttgtgggtctcaaaggacttgctttatgaatttgggtgctcctgtaatgggtgcatatatatttaggatagttagctcttcttgtttaattgatccctttaccgttatgtaatggcttctttgtctcttttgatctttgttggtttaaagtctgttttatcaagagactaggattgcaacccctgctttttttttttttttttggctttccattttcttggtagatcttcctccatccctttattttgagcctatgtgtgtctctgcaggtgagatgggtctcctgaatacagcacactgatggctcttgattctttatcgaacttgccagtctgtctcttttaattggggcatatggcccatttacatttaaggttaatattgctatgtgtgaatttgatcctgtctttatgatgttagctggttattttgcccattaattgatgcagtttcttcatatcatcgatggtctttacaatttggcatgtttttacagtggctggtactggttgttcctttctatgtttagtgcttctttctggagctcttgtaaggcaggcccgggtggtgacaaaatctctcagcatttgcttgtctgtaaaggattttatttctccttcatttatgaagctttgtttggctggatatgaaattctggtttgcaaattcttaaaggatgttgaatattgtcccccactctcttctggcttgtaaggtttctattgagagatcctctgttagtctgatgggcttccctttgtgggttacctgacctttctctctggctgcccttaacattttttccttcatttcaaccttgatgaatctgacaattatgtgtcttggggttgctcttctcgaggagtgtctttgtggtgttctctgtatttactgaatttgaatgttgttgaatgccttgctaggttggggaagttctcctggataatgtcctgaagaaagttttccaacttggttccattttccccgtcactttcagatacaccaatcaaatgtagatttggtcttttcacatagtcccatattgtttggagactttgttcgtttctttttaactcttttttctctaaacttctcttcttgctttatttcactaattttatcttcaatcactgataccctttcttccacttgatcaaattgtctactgaagcttgtgcatgcatcatgtagttcttgtgccatggttttcagctccatcaagtcatttaaggtattctctacactgtttattctagttagccattcatctaatcttttttcaaggtttttagcttccttgtgatgggtttgaacatcctcctttagctcggagaagtttgttattaccgaccttctgaagcctacttctgccaacttgtcaaagtctttctgcatccagctttgttccattgctggtgaggagctgtgatcctttggaggagaagaggtgctctggtttatagaattttcagcttttctgctctgttttctccccatctttgtggttttatctacctttggactttgatgtcggtgacctgcagatggggttttggtgtagatgtcctttttcttgatgttgatgctattcctttctgtttgttatttttccttctgacagtcaggtccctcagctgtaggtctgttggagtttgctggaggtccactccagaccctgtttgcctgtgtatcaccagcagaggctgcagaacagcaaatattgctgcctgatccttcctctggaagctttgtcctagaggggcacccgcctgtatgaggtgtctgtcagcccctaccgggaggtgtctcccagttaggctacacaggggtcagggacccacttgaggaggcaggctgtccattctcagagctcaaatgctgtgctgggacaacgcactgctctcttcagagctgtcagacagggacgtttaagtctgcagaagttgtctgctgccttttgttcagctatgccttgcccacagaggttgagtctatagaggcagtaggccttgctttttgggcactttgtttacctactcaagcctcagcaatggtggatgcccctccccctgccaggctgaagcctcacagttggatctcagactgctgtactagcagtgagcaaggctccatgagcgtgggaccccctgccccgagccaggcacaggagagaatctccttgtctgccggttgctaagaccttcggaaaagcatagtatttgggcgggagtgtcccgtttttccaggtacagtctgtcacggcttcccttggctaggaaagggaaatcccccaaacccttgtgcttcccgggtgaggcaacacctctacctgcttcgggtggccctctgtgggctgcacccactgtccaaccagtcccagtgagatgaaccaggtacctcagttggaaatgcagaaatcacccgtcttctgcattgatcatgctgggagttgcagactggtgctgttcctatttggccatcttggaacagaactcgctaatatgtttttatttgcacactttgttcataccaaaaggactattacaatatagctccaaatcagtatcccacagcctcattaaaattttccattaattgatcttttctttgctgcaaatatttattaactactaatatttttaaaaaataatgtcttgttatgatgactgacattttttaaggaaatttttggtcacttatattaattgttttaacaattatgttttatgtcacatacctgctaagcaatgtcaggaggttgagaagcagctgtgactgcagagtgcagggactcccacaggtctcttgaggacatggcattgagacacagttcatattcaaacaaactattaaagttgtatttaaaaaatccatatgtggtacatatatagaaggcaaaaattttagttatttggtattagccttgctcattacttggtgcctttagggatagacattcatgttgcgttaccatttaaagttgcatttagctatttacataaacatagtttggggaaaattctacaatttcagatttgtaagtaggaatcacacatgtaaaactcaatgttatcaagctagcaatctagattcacagaaacaagggtaatgtcagtaagatggtggaataaaaagtaaccctcaactgggcacagtggctcatgcctgtaatcccaaaactttgggagactgaggcaggcagatcatgaggtcaggagatcgagaccatcctggccaatatggtgaaaccctgtctctactaaaatacaaaaaaattagccaggtgtggtcttgtgtgccggtagtcccagctactcaggaggctgaggcaggggaattgctcaaacccgggagacagagattgcagcgagctgagattgcacaactgcactccagcctggcgacagagtgagactccatctcaaaaaaaaaaaaaaaaaaaaagtaaccctcctatctccgcccacaagaatcctgcacccatccacagacaaaagtctatcagcaggagtttcaggattcaggtaggaggctgcagagccccagtggagcccaagacttaggaggattattttgagagtacagaccagcacccacgtagctgatctgctgattatgctcccaggttcaagcctaggaataacctcatttcccaaagggcttggctagatccttgtttggccttaaacctgtgccaaaaccatttgcccaggcatccaagaggaaccacacagactactgcctcagtgaagagacttgtctgctcaatgacagtggtcttcacactgaaactgaaagttgttctttggcttggcactagcctccctcagctgaggttccacatgaggactgcttgtacaaggatacagaaggagacttgcccatattctctcaacctgggagtctaagcctccataatgagttcactaacctccatttcacagcagattttgaggtgcaccagactcagttccagctccccttactacttttggggaactatgctgtctatgcaaagacctgctgggaattgcacactcacgtgggccagtgagacaggttcgtcagctgctgtcacacagcagatcctgagagggcccagaccacttgtgcaggacctgccgggaagcacacctgtatggacacagttccactgcgcagagacctgctgggaagcacacctgtgtgggccactggaaaatatttcagtcttaggttcctgctcagctttcatcaacagcctagggaccctccttaagtcttccccaggtccatctaggacagagagccatgtcatccttggaacctttgtgagattcacagcaaacctgggctgagaggttcctctagtgctaagacaacttcagtgatcacaggctcagggaacacaattagtatttttagatctctggaagacgctctgaaaaatgataggcacagtaaagccagactgtgaagactggaacaaatacccagtctttcaaaatgcagacattgtcacatgtccactattatcagtaatattcagggaaatgttaccttaccaaagagagaaaataaggcaccagacactgattttaaagtgacagggatgtgtcatctctcagacaaagaattcaaaaatagctgttttaaggatgctcctcaaacttcaaaaaatatagagaaacaattgagaaatttatcagggaaattttatagagagattgaaattttaaaaaatcaaacagaaatcctggagctgaaaaatataatgaatgaaataaaagacacagtggagagcattaacagcagaattgatcaaacagaagaaagaattagtaagcttggtgacaggctatttgaaaatacagtcagaagggaaaaagagaaaagaataaaaataaagaagttacaggatcctacaacagttgcctgtcaaagaaaagctcagaagtaggcttcactgctgaattctaccaaacatgtaaaaaaagagctaataccaatgtttctcaaactattccaaaaacttgaagaggatagagttcttactaactcatcctatgagaacagcactaccctgataccaaaaccagacaaggacccaacaacaacaacaaccaacactattggccaccattcctgatgaacatagatgcaaaaactctcaagaaaacactagcaaaccaaatccaacagcacatcgaaaagatcattcagcatcatcaaatgagatttatcccagggatgcaaggatgattcaacataggcaattcaataaatgttatatatcacattaacagaatgaaagacaaaaattatatgatcatctcattagccatgggaaaagcattcaataaaattcacaatccctttataataaaaaccctgaacaattaggtatagaagcaacataccacaacacaataaaggccatatatgagaaacctacaaacatcatactaaatagggaaaagctgaaagtttttcctctaaaatctggactaagacaaatatgcctatctttactatttctgttcaacatagcactagaagtcctagccagagcaattaggcagcaaaaagaaataacgcgcatccaaattggaaaggaggaagacaaattgtctctttttacagatgatatgatcttatatagagaaaactctacagaccccactgaaaaactgttagaactaataaattcagtaaagatggagtacacaaaatcaataaaaaatagtaacatttctatatgcaatagcaaactctccaaaaaagatatgacaaagaagcccatttacaataactacaaaaaatctagaaataagtttaaacaaaaacatgaaatgtctctgcaatgaaatctacaaaataatgatgacaggaaatagaagaggacactaataaatggaaagataccctgtgatcatggactggaagaattaatattgttaaaatatctggatcagtctcttctcacactgctataaaggactgcctgagactgaataatttataaaggaaagaggtttaattgactcacagttccacatcgttggggaggcctcaggaaacttaaaatcatggcagaaggggaatcaaacacatccttcttcacatggtggcggcagaagtgctgagcaaaagggggaaaagccccttgtaaaaccttcagatctcttgagaactcacacactatcacaagaatagcatgagggtaaccgcccccatgattaaattacttcccacccatccctcctagacatatggcgattatgggaactacaattcaagaggaaattgagaggggatacagccaaaccatatcaatgtccatactgcccaaagtgatctacaaattcagtgcaatctctatcaaaatactaatgacattctctataaaaattgaagtaaaatttcaaatctttttggaaccaaaaggctgcaaatagccaaagcaatcctgagaataaagaaaaaaactggaggtatcatactacctgacattaaaatatactacaatgctaagaaattcaaatattcttaccataaagaaatgacaagtgtttgaggtgatagatatgataattatcctgatttgagcattactcaatgtacccatgtatcaaaatatcacattgtatccataaatatgtagttacatgtcaatgaaaaacaaaatacatctttaaaaaagattcacagaaacagataggcaataaacaatatttatatatggccctgaaaaactattgaattgaattttatttgttaaattgaattttaattctcttatggtattagagctcggatgtcttaatttctccttgatttctccattggaagtagatatttattttaaacctccttttaaagtaatctgtcatgagacattttaaggaactataaaagctacttattaagtcatttttataaagcaaagccaaaaccaaaaaaggaagatgacagtaatttccagaaaattattaatagccacagaaaattcaatctaaaggaaaaaataaaaacaaaaactgtaaataatacgtggcaggaaaatgagcagggagcctcacctgacttcaaatttccaggaagttgacctaagtcttactaggatggacattccatagggccttctagaagctcttgctggacttttccatttttccttatttttattttgcattctagtctcatcttgaaattagtcatgtaaatctttgatatttatgagatataccaatatgttttattatttctttgcctataactaatttctttcttttctctccttcctgcagggtttcattttatcttgctaacgatagtctctcatagttctttcagggaaagtgtgtgggtagtaaactttttttggtctttgtatatctggaaatgtcattattttattttcattctgttatttcctctgtcactattgttgctgatgagaatcaactataaatctaatagttgatcctttgtagataaggttggatctttctcatacattttaatatcttgcatatttagcttttaatttttctatgctgtgtctacatgtagatttgcttcttttttgtttttctctggacttgatgtgtcttctcaatatgagcacttttgtctttctacaatgctggaaatttttcagccattatgttattaaatattgtgttttgtcaattctctctagtatctcttttaggaattccttttatatctctgttgaatcttctcattcacttcatgtttctttttatatttcctgtgctttactactttgtgtggcatcccaattaatttcttcccaactgtcttataaatcaatctttctttagctgaatcctgtttaattttattctttctactgagtttttctatttcaattactacatttcttatagaaatgtagtattttagattcttttcaactttgtccatccttgtttcattatgtctagtttgattttaggcatatattaatttctttttttactttttgatctataatttctataaattttgagtggcaggaatatttcttcattatcttatatttccttgtttcctagaaacctgcactagcattttcacctcaactattccaatatgaattccaaatcaaaaagttcactgaaactcttcttgagctctgtattgttgtacccaatgagtaattttcattgtcacttaaaatgttctcctctcttgagccctgagaaataaaatatccacaggcaccgcttctcaatctactgtgctggatcctactttattacttgactgctaaatattatagtgtatcaaggctcaatcttaaatcctgttatctagcagattctctttataattcatattatttaaacttgtaacttttaattttatttatatgatgatgattttcaagtaaatcccactctgacccccaaagttaccattagtcattttgcaactcagcctaaacatctgatatctcattaaaatatgttaaaaatgaaacttgctttcccataatccacactgattcctttctccattatgtcatcttaataaatattattctattcatctagatgcagaagtagaactctccgtcatagctagcaattgtcttggggatttttgtctgtttacttttttcaaaaatctctctacaccagaattcagggaaaagaaataagaaaaggatatttccaatttcattttacccaatatctccactatgtagcatagtttgttttacatatttaatattcataaaaggagatgaataaataaatgaatgctgaattcggaacaaatataagcacaaggctttcattatagcattgtatcattagatcttatttatttcaacttgattaggcttccaaattctgcggatgcttagctgcaaactaaagttatttaattatcaggacagattcgctgttccttagaaagctactgtggcatcatagtttaccatgcctttggagtctctgtacaattgtccaatttcagttatatttttctcctattggtacttttcggattctggctttgctattcataagacatatgatcttgagcaaattatttagctcatctttaaaatgagtgacaaaagaacagagaatattagataatacatacaatgtgttttaaatagtgcttagtaactagaagatggtactactgctactactgctattattattactaaagtctgaacatctctaatccaaaaatctaaactccaaaatgttccaaaatccaaaacatgacaccgtaaggtgaaaattcaacacctgacacctttgctttttgctaatttagtgtacacaaactttgtttcatgtataaaattatttaaaatgctgtataaaattaccttcagtctgtatgtataaggtatatatgaaacataaattaatgttttgtttagacttgggtcctatccccatgatattacattatgtatatgcaaatattctaaaatttttaaaaagtcagaaatctcaaacatttctattcctaagaattttgtataaggcatactcaacctgtactattgttaatggagataatgttcctttctagccatttgttttcaaataagtagaagtaaataaaaaataatcacacacaaatatgtataatataaattccttatagtctataatttaattttctataacataatagtagtgtaaacataaacttgccatacatattttgcacttaagcaaagttcaagaacataaaatgttaaaattatcctaaaaaagaatgtgtaactgtatgaaacctgagctaaatcctactaaaaaaataggtataaacttcagagggagtattttgtttcttttatatctggatatgttatacaataattaggcagttaaatgttttaaatttgatctaagataggttaattgcttttcctaagttgccggtaagtagacataaatgcatcaattcacattacctttttaaaaaaccagtgataaacaaaaaactgcaattgcctacctaaaaaagtgatcctgtctccactttagcaaaggaagttgaatttctgatttctcaattttgtttgttacctaagttcaaacagcaagcactcaatatcaatctctggccattttatataaagaaatgcaaacaacaattaggtcatacagtgattgatcccctgaaggacaaatgatgtcaggcagtatttatgcaccaaaattatttcaattttgcttacttttccagcaatccaccttgatgtcaactaccatttagctgggccaataatattgatatttgatgtcagttcttattcattactgcaccaagatgatgcataagtcaaaacttttagatgtgtggtgaaaaacactaaagcaggttctgtctatccaaggaaattggaaacaacaatagaatataaaattaaggcatatgtaatctccatttttattttagaaaatatttaaattatgtcaatattcctacatattcaaaaaataattttatatctcaagcccatcctatactatgtgattttttaaactaaatattttatgaaattaactttttgccttaatactttttgtactttggaaagaaaataatttctagtaaaaagtgaaacgctttaaaaaagtaaagcaaaagaaaagcatttgtataagcagccattaaaaaaattaattagaatataaggtaactataataaattaatagaagtattctatctttatttctactttgttttggtgttagaaatctaatactgtaaatgactacagataaaaatgatacatttaagattctattgcaccacccccaaattttaacctccaatcactcctatagtcaaatggagttcatttcatacatttgtcattttgttgatgggtctatgaaaattgaaagcaacataattatgtcatatttcttgacatttcctctttgaccaaaaaaaatcaatcgtttgttttctatatatgtatctttggataactttaaaaccttttggcatatatgaaaacagttcagtagtgaaatttctacttagcaaccctttacatcaactgtgtcctggcactaatctaaatagtgagagttcagcaatgaaaaataccaagtcctgtcctcaggaaccttatattctcttaataatcagagacaataaaccagtaaataagtgaataatctcaggaatatgaagtgctacctatcaagaatcaatcaggtagaaaacagcaataaggtgagagttggggcttaaaatgcaatgatcagagagagattctctgagagaataaagaaatcctaaaagttctgaaggaagataactcaagcataggcaataagagaggccaagttcctgaagtggtgacaacatggtcccgtggaggaatagcaaaatcgggacacatagagtgaactaggaatagattaaacaggtggaatatcttgaatcatatagataactgattggtaatgtcacctatacaaagataacccagctatgagaagtttgtaatggatttttttatgtgactaataccttaagtttttttaaccctagaattcttagcataattctcagtatagaagcactaatcaataaatattcattgactaggaagtgtcagaaagtcactgtaggtcagaactgaagggatatttaagaggacataggaccatgtttgctgtgacacaacaaaatttattttctatcattgattttaaattttattttgaaatttaatatactttgcagactccccatgattgttttgagcatatgactgccaaaactagttcaaaatattttatttttttataagaaataatgtcactgatcaggatatttgaccactcagacaactggtcttccaatacagtaaaatctcatttaaacaggtttcacagtacgaaattgttctaagtaacgtgaaaatatcaacataaaatgatacactcctctctaattaggatttattatagccagtcttaatttgcatgtgatttaaaaagtataaaaaactacatgtatgataaacagcatgaatttttaagattgttttacataacagggataatgtctaatgcatgaaacattgtttttgaagcacataattagagcaaaaataattgtcacaccaatttactcataagcacaattacaagaaaacttgattatcccctttaatgtaattttccccacttaattgtatgttggtggatgaatgtgaccctgtgagtccatacttgaagaagtgactgttagttaacatgcaaaaccacgggcagaacaagagagtctgccctttctctggaagagatttaatttgtataccaagtggctctgcagggaaactgttttaaaaggtacatcttccagcaggatgggctggaatttcctggagcacctttcaccttgcccttgggctgtcatgtgcatcatcaccttgctctgccatttactcaatagctagacctaaacactcaacagttttctaactaaaggaatttaatctgctacctagattgcattcagaaacctaaattcattgaatttttttctgaaaccattcaagtttttatatatgttttctttttttttaagatttagcaaatattccctgacttgttatttgggtggttgtgaagtgaaagaaccttttgtttctaactttaatacctggttgcatttagatcccttattccacctgagctggagaaagttaggaccacagagaatcttaagtatacactctgtttctttttcatgaggcttgatactggaattggctgcagtcatttaaaatgttctctttttagtctgagggatagaatttttttctaaggaatagctggttttcaatttttacagactgaaatacaaagttatgaaataaatcaagtcattacattatgaattgcttttctatcatgttatgttttgtatacctaaaatggtaaaaacagacttttttggatgtgtgaggttgtaacttcgccctctccagggtattatggatacaattccatatcttcaaagaaatatgattgttttactagtgaaaaaaaatgtagaatttctaagaaaaaataaggctagcaaacagaaggacagtctgttagaaataattcttaaaaaggctctacattttagttaaatatatatagctccaccctgtaatctgtttttataaatcaaattatagattttggatattttatcaagtcacttcaatatgaagtacaggaagaaagatatggcacctttcctcacccatcttaaggatcatagccaaaagtcctgtaacaaaagacaggtttacaagggaaaagtataacaaatgtatttaatcagggttttacttgacatgggagccttcaggaatgaaaacttaaaagacccggggaaaattgtctattttgatgcttagatttaatgaagaatggacaatcacgtagaaatgtgattgggcaaaagaatataatctaatggtaatagaccgagggaagaaatccagtaaggcctgactttcttttccttccttctttccttccttccttccttccttccttccttccttccttccttccttccttccttccttcctttttttttttttttttttttttggcgtttctgtatagcatttctttcacctggcaatggggcaggtcccacctcgaatcacgtcttcaaaatagaagagatggagtgagcttgctaggctttacggagaagggagaagggagaagggatggattgagcttcctaggttttatggctttctttgggggagagaagtttccgtttctatgactcgccttagggaagaggagttctggtttctatgactcattcatgggagaaggagggtcggaagacaggaaggtggagaaggtcagaggcccttccaatttccttcatttcaaagtattcagcacaccaaggagccatacttcagggtgtcgtgttctgagctccaacagtggcaacagccaggcctggtttatggtcatcaacatgaatcttggtattgtaaacattatgatgacacaaccctattcatatattatcaactttatgtatataatggaacttctctgaatttatgtgactgtacttatgcacatattaagagaaaataaatccattgcaggttatcccagcaatgttattgcagtgagcactatattaatcaataataattagctactttaaaagactcttgccaaattgaggaacaccttaggttactatcacaataaataaacagatcttacagattgtgtatctacatcatgtaatatcttctgcaatgatcaaacagcaaaagtacattgttgttaacaatagtaattaacacattgctctcatctttgctagatgatttgttttatttctctatggtgtataaaacatacatatatatttttaaaaggattatccccaagtacttaagaaatgattattttgaaattactagaaatctgaagttgtaaattttttgtagtaagttctctgtaagtgtttgtgaaactgaattcagtagataaaaatattttttcccacaagggaaaagaaatagatttgatggaattttgcagtttgccactatgtcagctgctaatatggacattcaggattccaaatccctctttgacctctaatcactgctgcagaaatctagtgcttctctaattgtcaatccctgccctctgcctttcatatcttggagaatataaaaggactgacttcctccctggataaaggacaacagattaatgaaattaagtgtctgcctcattaaaattgtcatccctggtttactatttcaagtgcagtatcaactgtggctagcttttactcttcagggggtccagtgatgttcagtttcttatgtaaatttatgcaaaaactactccaacaatatcacatgctgttcctttcaaaccccaaaaggaatgctgtgtttctttatctggtagatggaaagagcagagtgggagtgagctgagttacaggttaacaaacagaatactggtctatccaaggaggaggagagtttggaaggaaaacacaatatttattttcaattgtgttaaatcaaagattcacctgtatgtatttcatttttatctgtaaatatttccaaaatgtaaatttacatggcaatgcattttattttgtttaggaggattacaaattagccaggatgattccatagctcatgaagatctagaatcatgtcttacccttttccctactgcatcagtcctgtcctcttcctcaccacacaccctcacccggcactaggccattctggcagggaaagcttgtctgggtgatacttaatgaatgactaatcatgttttcaaaactctttataaaagaagtttcatcatcttaaagtatgtacaaatttctttggtcagtttgttataacaaaataaaaagtagaccagtggtgagatagaaacagactgttctagaaaaaagggtgggttagagcagcttgattaaatgtattaaaaagtggtagaatttagtatttggcaaattgatattttaaagcacttaaatgtcctttaattctcaagttgaatcacccatcatcatgggttgttttaggaagtaaaattatcagtgtaggcttcattcaaatgtaaataactatggcataagtgcctcatttaaaaatagttgttcagaagaaaataagctgacgggcagggggaaaacctctcaagttataatcatttcaggaaagtacatcctgtgtatatgtctatctgtgtgtatgtgaattgcccagttgggtggccacattaattgtgcatatgtgtcatattatgattgctttaagattggttgggagagttattggcatgttttagttaaatcttatatttctcagtttaattgagaaagcaacaagagagattttaaaactctaagctctactcaaggcttttcattgtctggttatgctcactagtgagccacaaccttctccactgtcccctaacccttcttatatttaccctcaactttggccagttccaagattgctgtgccaaaatcaattaatatgcatccaaattgaatgaaaacactccaaagaaatatctttaatctgatttacatatgaatttattcctgtcttcttatctaacggatttcaattcaaccagatttagtttcagatcccaactatcacttaccagttgtgtgaattagaagtagcctaaattttctcatatgtaatatggtgatattacctagtgcctcataaattcatcaagtttaccttgttggatgctagatattttgtatttttacaaatagtcttgaactttgttctggaatgctgtcaagttacttagaaactggttagtacttccagatttgttaggtgggaaagaagcagtgctcaaactagggctaattacttccccgctactaaagcggggaagtaccccttctttgtcttctaatctacccagtgacctcaaatcttgaaatttttcattctgtctgttagggcagtcctcactttcccagtgtaatctgaacatcttttcgtgttccctctaatcatttcaggtagttcttcctaggcccctaagtaatttcctcacagtcatatgccaatcattactgagctaaatactagaggaggtttctctgcagatctccagggttttctctgtgcaactctcacctcacctcttctgtacactctgcctcgcaaattctacctgccttggcatccctggaccctcagcttcgtttctttaattagggagtctgctgtgctttgtttcagttccctgtccttgtgttatgggatagaaatcgtcaaggtagtatgtcaacgtagtcttctctggctgacttcattcgttttcatctcttgatgattattgccctttgttacctaatatgcagtgtcttgtaaaccattgttttctatattttgtccaggtttttggttgtttcaggcaggaggatatacctgatccctttgactccattgtgactggaagtcttttttagcatctgtttttaagtgtcaacagatttcaccagaagatatgcaattgtaataataatagcattatttttaacatttatagttagcccttcctcctatacaaaataaaagttggcagtatgtttgaagaagaccttaattatagttctgcttggaccatgaatttcatgcgaaggcttagacaaatcccttaatttctcaagactttacttttctattccatggaatactttgatctggacaacttttatattatctttcagaaatatattgataatcactaacattttccttttgaaattgagaaaaactatagactatgaatgcatgacttataaggctttttagagaagcaaggatttattttcaacacctggtttttctgaactctgaaagattctttgtgactcaatacttaccggtattaacaaaaaaccatgagatctgtagaggagaaaagaagagctttattttcttaacaataatctcaaattggggaggcatagcctacaatacaagtgagcgtgccttccaatgaacaaagtgggggtctggcttcaatagagaaaattctcaccccagttctcaaccaaatccatttatgcaaatgaagcattcaaacttattcagttctgattggttgaaatagataagccctgattggcaagcttccaagccccaaactggaagtctctagcagccggtgtgagagtttgagggtcgtggccacagtttatcttgacaacaacagaaactggtttggattaatcacagaaagggaggttttgtgacacttttacaacacctttctgagaacatggagtactttctgagaacacagctccctcacttggctgtggccacctggttctgtattaactttgagaacctcagtcagccatgaagacttcattttgtctgttggccagaggcatgctttaacactagcaaacaccacagcaaacctgagatctttcttctgacatacagagtgatgccaaactgtaaaaatttaacaccactcgctcttcagatgtggagtagtaagcttcaatttttacttcatatctctttggttttatttcttcatattccagaaaccctactgccctgctttgacattacagtatgttactatgtaaatatatcaaaagatattgctgcaatgtgacaagtcacatcggcagaaaacaccaagggcctataagacaaagatctcatacatgaatatctgaaataatgccaataatgacactgaaaatgaagtaaactcacatgagagtcagaacatttttttagtgcttttagaagaggctcactgccagagggagaatgcatcaatttcatatgccatgtaaggaacttccatttctccttgaataaaacgttagtttcaaaaattgtctttagagtagaaagactctctgtgatttattaaaccttcttctccccttcaccttcagaaatccactaattttgcatcgtatttggcagccaggaagttgggccagtctatattcaattccttcaggactgtgctttcaatttggcatctgcaaaataagcattatgctaggtgtcgtgggagattcaaacaagtaaagatctagtcctttttcttgataaactaggctaggtgtggtagctcaaacttctgagagtttgacaacagtctgagaaacacagcgagaccccatctctaccaaaaaaaagtagctgggcatattggcatgcacctgtggtcctagttgcttcgggaagttgaagtgggaggatggcttgagagcaggagtttgagattacagtgagctgtgatcatgccactgtactccaacctgggtgacagagcaagaccctaactcaaaattaaaaaaaaaaaaaaaatcaaactctatccacaaagtaggtaactatttgtttgtataaggtaacatgttataagtgccaaaagtggctaactaaaagtcagtggagaaaacttatatttacacaaaaacctccacatagagtagctttattcataactgtgaaaacttggaagcaaccaaaatgtcctccagtaggtgaattgatagagaaagtatggtacatccagacaatggaatgttactcgggacttaaaaaaaaaatgaactattaagccatgaaaagagatggcataaacttaaatgcacattactaagtgaaatagccactctaaaatggctacatactgtatgactccaactatgtgacattctggaaaaggcaaaactgtagaaacagtaaaaagatcagtggttgccaggggctggagggagggagggatgaatagacagggcatagacaatttttagggtggtgaaaatactcttataatgatggttacacttgtctaaacccatagaacgtacaccaccaagagtgaaccctaatgtaaactgtgagctttggatgatgaagatgtgctaatgtaggttcaccaattgtaacaagtgtaccactctggtggcagatattgctagtgtgagatgctatgcatgtgtaggggagacaggacatatgagaaatcttcatactttcctcttaattttgctcagaacctaaacctgctctaaaaaaaataaagactttaaaaataatcagtgggtatatcgggtataattcttgaaagagttctattgcaaatatgagaagttttgctttgactttccaggtatggaaataatgattcattcattcatttgttcaaatatttactaagtatataatataaacccaaaactgaatgtgtaaatgatctggaacagtactgtccaatagaactttctgtaataaaaagatgatttttaatctaaaatgtccaatgtgataggtgctagctacatgaggagatttttaactaattaaaaataagtaaaactgaaacttcagttcctcagttgctgtagttacatttaaagtactcagtagccacatgtattaaacaatggtctagaatgaaaagacgggcatgtatataagagattgcagttttgtaacatgaatttatggaagcaacagaaggaatacattgtgtcacttagaggactttagaagaagttgtgttggagccaagttttaagaatggttgatatttaccagaaaaataaataaggaatgagtatcccagtcagtggaaactaagaagaaaagcatgaggacttggtgcatttgaggaatagccaatagagtaacatatggggaaatttaaggaagatgataggcaggaaggaggcaggtcaaatttacatttgagagtctcaaatttgcatttaaaaatgactgtcatggctgggcctatgccttgtaatcctagcactttgggaggcctaggcgggcggatcacctgaggtcgcgagttcgagaccagcctgaccaacatggagaaaccccgtctctactaaaaatacaaaattagccaggcgtggtggcagacgcctgtaatcccagctactggggaggctgaggcaggagaatcacttgaacctgggaggcggatgttgcagtgaactgagatcgtgccactgcactccagcctgggcaacaagagtgaaactccatctcaaataaaataaaataaaaaaaataaataaataataataaaaaaaaaacctaccattagcatagagcaaggtttggcaatactgattttatggactggtaattccctgttggaggtgggggctatttcgtgcattataagacttttatcagcatccctggcctccatcaactgaattccaggggcactttctagttgcgaaatcaaagatgtctctggacattgccagaagtcctctgggaagaaaaaatcacctctatttgagaaactttgctgtaaaaatggccttccaaggctgggtgtggtggcttacgcctgtgcactttgggaggtcgaggaaggcagatcacttaaggtcaggagttcgagaccagcctggccaacgtgacgaaaattctctactaaaaaatacaaaaattatccaggcgtgatgatgcatgcctgtaatcccagctactccggagcctgaggcaggagaatcacttgaatctggtaggtggaggttgcagtgagctgagatcacaccactgcactccagtctgggttacagagcgagactccatctcaaaaataataataaaataaaataaataataaaatggcctgcaaagatagagggttgaagtgaggaagttcactgcatgtgtcccagtgtgagttgatgacaggctaaaataagggatttttggaggcaaatttcaactgaatagaattggaaaggaaagagatggagaatgggataaaaagctctggtgattgcctggagtttggatccttttgttgaaatggaaagtgcagcagaaggctcaagttgaggaaaagattaatttggctttgaacaggatgacattgaggtacgtggggaacttccaagtgagaaatgctatcagtagttggaaataaagacctggaatttaagagagagttgtgaattggagatgtagattcaagagtcataaacatcttaatattagttgaaatcatgggaatactcctttgtgcttccagcagtctggacttaatgacgactcatagtttctgactgatctccaaatccacgctttttgaatcaattcaacacatagcacctgttctttcctgatttcatatatgaaaagactttgaagtctacactggcctatttactgttagcgcttctgcctcagggcccttgatcttgctcttccctcttcctgaatcactcttcattctcacagcacaacttggccccacaaatccattaggtcttaattcaaaggtcacacattcctagtcttgacaggctatttgtatttcaacaccctgtctgccaaacattccttgtctacatttttaaaaattctccatagcttttaacatttaacataccacatattttactgatttatttaatttattgtatgtttctttacagaagcatgcccgttccgtgaggcttgtccaccacctaaaatcggcacaggctccataaatatttgtttgatgaatgaagagataggttttctatagaatgaggcaaatttgcccgaattcagtcaacctcttacttataacaaacttgagtaccacaagaaagcaatcttcacttgtttttcaggatctcagagacacagtcttgcactagataataccttcttaacttactgagactagtggccttcaacattccctttaacgtatcgatatttatgtacaaaacacataagaactttttttacatcatatgtaaaatttacattcctcagtgtgagctccagaaactttggaatttttacacattgttaacctcatcattaattcaccacattccccatggagtagtatgttaatttctgctttgtgctctgacattgtgccgttttcgataaaaatgacaccttcctgccttctcttccctattatttgtccataatcttcatctatctaaaacattacatttccagaaagctgtattcacctgatgaatttatcctagtgttccgctcctagaagatactttcttagattctacagtcttgaattaggtgatcaatttgtattctaaacaatacctacttctagcatttaactcttctattgtaattgcctagttactcctctctctgacaatcaaccagaagcttgttgaggtcatatattaattgtttttcttcctcttggtccaagccagggtcacagtagagttcagtaaatattagttgctttatatacattgtctttatttctagttactcttctgccttgtcaatttaaacacctgcttgcttgatttgttctttgttaatacatgtggtacttgttgacatgctcctaaagctctgttagctgttttggtgtgttttaccccaataacaaagtatgcatgtttatgcatctaagtggtttcatgggtcccggagttcggatgtctgacccctccaaatctcatgttgaaatttaatttccagtgtaatggtgttggaaggtgggacctagtaagaggtgtttgggtcatgggagcaaatctctcatgaatagattaatgccttccctgagggaggggatgagtgagtttctactcttatttcccacaagagctggttgttaaaaataacctggaacttcctctatctctctctctctctgtctctctgtctctctctctctctctctctctctcactcttgcttttctctcttgccatgtgatctctgcacacactggctccccttgccttctgccatgaaaagaagcagcctgaagccctcaccagaagcagatactggcgccatgcttctatagtctgccgactgcaggaatatcggaggctgggcaatttataaagaaaagagctttgggtggctcacagttctgcatgttatacaagaagtatggtgctgtcatctgcttttggttagggtttcagggagcctccactcatggcagaagaggaaggggagctgacaggtagagaaggggagtgtagctgtcacatggtgagagagaggaagagagagggggtagtgccaggctggttttaacaagcagctctcacagaaactagtagagtgagaactcactcactacaagaatgataacaaaccattcatgagtgagccacacctatgactcaaaaatctctcaccatgccctactctaacactggggatcatatttcaacatgagacttagtggggccacactaaccatatccaaaccatagcatcaggttttcaattccgagcctgtgttttgctaaccaaatgactctgggcaagtttaataacttaaaccttggttgtctcatttgtaatattgagcagtaccagtacctaaccataaagatgtagaattaaatgagatagtacatataaatcactttgtacaagttattgtaatgatgtagtgctgtgttgtgtactttagctgctcggtaattatttttgagatttccagctcatatccatggagcatgattggtgatatggtagttgttaatgcctaacagactgatgatggcataggaaagaagtatacacccaaaattacaaacttatccacatctttccagtgctctatatttcctccttctttatacttgaactttctaagcattcccaaatcttaccttctctttccgttctaattccataatttatttgctttatttgtgccattagagtattgaggaaatggtgtaatgagctattgcttaatgctgcataggcctgtcctaagagacatgctaatgtatcagtactaaaaatgtttgaaatactaattttcctcctaatgagcctaaacattttattatagttataccttaataccaagttgcaggtcattaccttcacatattgaaggcagctgatgtttcccggacttaatgtctctgccatttgcttgatgacccctcttacttgcccattttgcatagcagaattttagaaaataaaaattagatcacttgacaggtactgtgtgtgatgttttgatttcattatttctttattcaaaaatatttttctgatgataaaaattaatgtatgataatttcatgaaatctaactttttaaattgaaaagaacaaataaaattaatgtgcattggcttactacctgaagataaccatttctgatttattttcaatatatgctttgtgtatacatacaacatagacaattttgcatgctgctattttcattgaactacatattttttcgtcattaataatcttcggcaatgccattataatagtttagttatatatttatatatgttatctaatgacatatatatttggaaatgccaaaatatagtttagctatataattatacatgttatagttttatatatttgtgtatatatgtatgtgttatctattgatgattttttaggtttctacagttttagcttgtaaataatagtgtgaggaacatctatgtgacaaatttgtatcttattgactatttaatgtatcctgatggggaaatattttctatatttttaaacttttgtgatatactctagtagttttgagaaaataaaatgtaatacagtggataaaatcttggactctgcagttaaccatacatgggcttgaatccacactccaaatcattctaactaggtaattttagggaagtgactttatctctttaagcattattttcctcatttgtaaaatacaattgttgcacataaaaaataatcctataaatattgagcatatgtcatggcaaaaactgttaattttagttgtcaattactacatccaccagtaatacaaatctgattgtattgcagttttatcaacatcaatgctgtcattaaaaatctattctaatttgatagaaaaaaaggacatgttaattaaaaaaccccaaatcaaactaatttaagcaaaattagggtgttcattggctctatagaggagggaaagatcactcccactgcctttttattcttttctgggctctttggctggtccaggaactgaactgatataacagatgaacaggagaaaagcacacaagttttattaattttacatttacatgaggattttcatcagagagcaaagtccaaaggaatggccaaaggaaaatgcttttatattttttagacaaaaaatataaatttgtaaagaaattacacaacaaggggacctggctagggtagtaagttctaggggagatactgggagatacatgagaggtggaaagctagtggaagataagggttatttgggggagattatttattcaggcctatttcaaggctaagtcccagtatctggtgataagaattcttctcacgccctggtactgggaaagcaccccttgcaaaagaatatttaaagcctgctgcatgcaagaaaagacaattcagccattctttttctgaaactataatttctccaatgtttttatctcaaaatagtcaatataccaatttggcatatttgaggaccatacatcctttacttcttcagctcacaaacctagacttcagactgagcagttggcaactggcatttagatttagcaggaaccaaaactcaaataccacctgacttcctgaatggtcttactcttattagtttctttattgtactagacctgagcatcagaaggaagattacacatgtatatgcatattacacattttctgaaaccttttattcagagaggaaatagcttatctctctcacattagtttggaaaatacagggaggtaatcttattgctcctacctgagccagattcctaccccttaaataatgactccatccagggagatgaatttctatgaggacaccagctacagtgtaggaaatgagaggcagttcttcaaaaaaagtgagatagcaaacctatgactgctagagtgatcttgggctgggtaaccaagctaagtggatctactccaaataaaacactgtttgaatttatttcactcaactatagtcctagggtcagtgaaaaggttttcaggtgtttaatcattctttcttctgtctaggtctcatttcaagagcaatatttgtattgtcttagtggttttcctctttatttcttgtatttctttttgttatatttaagacaattttttcaaagtttattgccagttgacttttaaatttattttgttctggaaatgccattttgctgaagaattaacagtgaacattaagtccttcagagcatttggtgtggtttctttaatctctaccatatttttaattatccccttttccctgttgttgcttaattatgacttttttctttgtgattatttttgtctgtttttgacaaacctttcaatttgtctgtctacacttttcaaagagcggcttttgattttgttgatgttatctcttattattttaataactttaattttgcttctcattcatcatatattaattatttctaccttttctattctgtagaaaagagcgtcttcaatttaattctaatatatttattttaaatttcgctttaaaaaatgcatctgaaattacaaatttttattaataatggcttcagcttccttcaacaaatataatatgaattccttcatttggattaattctgagcactgaactctgagcttttcttcctgctcaaattcctttctaatggcctgggtaaagtcaagcctacacgccttaacatcttgttaaatagggcttttttgaggcctgtttgaagcccagtatactgtggcttactttccaacctgactctagcatagcgtcacatgacagataacagaccctttatcttaacctaagcatttgtttttactgagtccaactatttagacaaagcttaactctttcaaccaattgctaactaaaaaatcccaaaacccacctatgacttataaggctctacttgaagatgtcctgccatcttgggccaaaccaatatgtatctcccatgtactggtttattatattacctgaaattcctgtctccctgaaatgtataaaaccaaactgtaacctgatcgcctcaggcacacttttacaagatttctgagactgtatttccccagcatgtggttactctcatgggctcagaataaatctctttaaatattttggcagagtttcctttttctctctcttttttttttgttttgtttgtcaccagttccaaacttgtaatttattttgtgtttttttcttttagcttccaaacttttttttaaacctttggtgtaatttttagtttctaatttaattgcatcatcgtcataaaatgtggcctttataacacttctttgtcatttcttgaaacttattttgtggcttatcacatacttcacatatatttgatgatactatatatttggcaaatactgttttccattttagatcaagctttattttttgaaggggtggtaaaatgttgtatatctttccttttttgcattatctatcattctgatggacttgtattacaatcttccccattatttgggaaaataatttatttttatactcatgataacttttaaaatattttaaaacgtcatttgtctttacatataaatttattagttataccttgtggctagagtattccctttattattctttagtaatagactctagtaatttcttttctgtaattatttttttctgacactgatactattctacaagcttcttaggaattagcatttaatgattttattcctttattttcactcttgaatattttgggaattttgttattgtttctgcttgtttttaatgtttctcttgtaaattgcacatagttgtattctttattatttaaactattttagttgtttcttacttttaattgttaagtatatcccattggtgggggggggggggtggggggtggggggatgtgacagagagagagatatatatttctgtattggtattgccataacaataacttgtattttctgctaatcttgttttatttgcttctttttaacttatttcctgaattttgcttaagataagatttagattaggttagggttagaattagagttagggtttggattcagcattttgtctttgattttaactaaatcaactttgattaaaaattactgaatttttgcctgggcacggtggctcatgcccgtaatcccagcactttgggaggccaaggtaggtggatcacaaggccaggagatcaagaccatccttgccaacatggtgaaactccgtctctactaaaaatacaaaaattagccaggcacggtggcatgtgcctgtaatcccagctactcaggaggctgaggcaggagaatcacctgaacccaggaggcagaggttgcaatgagcccagatcaggccactgcactccagcccgggtgacagagtgagactcggcctcaaaaaaaaaaaaaccaaaaaaattactgattttttaaatatttgtgctcaccattatatattttgaccaatgctatacttaggattttactttttcatggtgaaatacaaacattaatacttctttccataagatatttaaacatttgtattcattaaatgaaaatgcattcaatccaaagtgatatttaactaaagcatagaattttaggttgaggttttttcccccggtacaatgaggacattatcccactggttctaatatctacttaaaaaattaattgaaatgtctttaaaatattttaaataggtaatctgtcatttttcacttgtaggtaaatatctcttcgtccataatatcccacatttttcattacactctgtttaggtgcagttttatttttatgcattatactcaatatttggagcgcaattttagtcttgatattatatttttcttcaattctggcaaagtttcagccattacacctttggatactgctgttctgactgtctttacattatcttcttttggaatgcttataaaacatatattggaatatgtaactccacccccaccctcaagtctcttaatggtttacatgcttttatctttcaatctctgtgtctacaatctagctaaattttccagattgtgatattccaatccactcactttcttttcaactttgtctagaatagagtacatcctatctatagagccctatttcttcaatgactaacattttaattctcttggatttctcaagtcattttagattgtgtttgtttcatttcttttttatttaatgagtaatagctctttattcaaatctttgagactcacactttcaaatctttgagactcacactttaaaatctttttcagtctttcataattttaatctatacagatcacttttatcttccaattattgactatattagctttagatctccttgcatgttatggaaaatttttggtagcttcttttgagtaagtaaaaggtctgatcatctcttttaactccctttatttcttttcctctttctttgtgcttacccttccataactttcagtattgtaactatctcctttgccccaggtctcccaggcccctagttccagggtgacctaggataggctttacgtttaatgtagatgaaatctgccctctggttttgaaaccacagatccagtcactgagtgtgctacttggtaaaggtccaggtggcaagactgtgtgttaactccagagtccttaaatgtatagattaacaaaaattgtagcttcaaacaacattagccggcaacttttgtcagcttcattttgtcaggaaatcttaccccagccatggttttagcagtaagttgatgtttatcttccatctgacacaaagctcttttagtctctttattattccacacaagctgaatgaccagtctgcttccaaacccaaaacccagagcctatgttttcatccctattctctattttgtgtttctgttctgtttttacttagtgcatagtatgcctgtcatcctgtcctcaaactcttcaaggcctcatacttttaaaaatcgttttttagcctcactctgtctttgagacatggtacagcttagtgactctaaagccacatggccttaaatcctggccatttcttttttaactgtgtgaactgtaggcaacttaattaagctttctgtggctcaatttcctcattcataaaatggaggtgatcacctattccatcatagttttgggtttttttttttttttttttttggtttcctgatatatgtatatatctgtatacaaatgcttggaaccctgagtgacacatagtaattacccaattagtgttagctattactagtttttaattgtctcatttcataggtattttttaagaccatcttgaccagggtccttccataaattatttaattcttctagaatatatttagttttatattatgaggtagaatcacagtttgactcatcatatagttgtgagagtcagctgtgacattatttacaggtatgttataagtgataaagaattatgcaaatgtacgattttgtgtcttatgatcacaaaaacatttttttctgagttttagctcatttaaatttctatatttgtgaaaaaattcttttaaattacatacaatcaacattgattactttctactttctttatatttattcattcaattagtgatttaaaatcaaatacctaacatgtagcaggaactgtgctgggtgctagagattcagtgttacagaaagagctccagacctaaatggaaacttctttgagagctttccatgcaaacacatttagtaccttcccattctcagtttcagtacttgtaccagtgacatattttaaagtctcatgagactgggcacagtagctcatgcttataatcccagcacttcggcaggtcaaggtgggaggatcacatgaggccacaggtttgagaccagcctgagcaacatagcaagaccctgtctataaaaaaaatttaaaaattagctgggggtgttgacaaacacctgtagtttcaactacttgggaggctgacgtggaaggatcacctgagcccaggagtttgagattacaatattgaactgcagtccaccctgggcaacagaacaagatcctatctcaaaaataagatttaaaagtaaagtaaaataaaatgaattaaaagctcatgaaataaatagtaatatgtttggcaatgatatttgaataatatataactgttatctttgaggagtttaattatttgtagttattcacatttaaagtattaaaggattataaaaatacacaaaagctttaataaatgacgtaactccccatttaatcattgtacatgtgtattatatactttaatgtaaccacagtttggcataaatttttccatgttttacattggttctataattgttgttttaatggctttataattatttatctaagatattcatatagtcattctacaattatctattgaacatgaactatattttattctaggtcactagaatgtactgctaaacaaacaaaacaaagttccttcacttagtgtttacaacattctcatgtatacatagttgatgtaaaatcattcatttaatttttctagtatgcagtataactctttgacaacagaatattatatatattctattgttcagccttcaggaatcactgaagaaaggaaacaatgtcctgggcctaaaatgcttttattgttcagtaaattgactttccaaaagaaaaaggtatttatatatataacatacgtgtatatgaaacccagcaagttgaaccaagaaactacttagctgactcatcaggttgaaggttcaaactacaatcaaattggacctgagtcttccaaaataggttaatatcctatttcttttagagatgcaatataaagacatagggactttcatagaaaaaattatgttactatataatatttcttaacctgagcactagccccgtaatcctaaaagttaggataatgcccaagtttgaaatatttgttttaaaaaattatacaatgccataagatatgtttatattaaggaatactattggtttataaaatagtattttaattatttatttaaattattaatgacctcattaacattccagttttctccttttctttcttagttttaccatatataaatacatttggaacctctgtgcagagagatagtagttcagtctgcttgtctctctgcatctgttgataacaagtttacataacagttgcctcaagcagttttctgaacccaccacagcccaaggtttacttcttccatattagattattattgcaaatttcacttgtttccattttgtatttataaataatgctacattggttttttcataatacatttttctttaatttataataaagttcagaagtaatagtaaaagtttcagaagtttggacatttttgtgatacttgatacctattgctaaatttttctcttataaattctcagcagcctagatgaagctagattgatcttatgttattctactctctaatttattattaacttcatgtctatatggttttctcattataggatctttaatttggtggtgggaggcttaacagaggcaatcaggagtggtgactattcattttcatctcagctgtaccctttgtccacttggctaaattctactggcataattaaattcatttgagtcttatgaccacaaagcatttttttgggcttcggctcagttaatatttctatatttttgaaacaaattattttaaatcacatagagtcaacgttgattactcttcattccctttgtattcattcattcattcaattgtttattcaaagaccaaatgtctaacacgtagtaagaactatactggatgctggagatgcagtgttacaaaaacaatcatagctctcaatctgagctttctgcacatccaccttcagtagcttcccatcctcaggatcagtactactaccaatgataaccagaattgcattttagagatttccaaacctcttgagtcttgactttcattaagattgtcatgaaatctcacctatctttaaaaacattttctttgaaatatttcttaatttacgttaaatgccttaaactatagcttgactgtcataaattgtaggtaaaatgacttttccctaggttgtcaactaatctccttcccacatctctccatctccacatccctcaaaactcaaactacacagtttggattaacaacattctagtttattctgtctcgaggaaggagattggcagatggccctccaattttcctgaaatgggagaaagaagaaggatacagggcattagaatattctaagtattgattctggattctctgcctcttccattgctttctgtcttgtaagtgattcagacctatcagggttggaattaatattcacctgcaaaactgctttggaaggacttggaccaaaataaaacttttaggtaacctttgtggaagcattactcatctatcagcttaacaaatacttggttgagctctgctatgctccaaacactgtaatagacactgcatctgcctcactagctaactggatatatagttaagctgttcttccgttaccaagtatctttcagttctcaaatctaaatgcaaacttatttctattacttaaaatattaccatatttggctgggcgcagtggctcatacctgtaatcccagcactttgggaggccaaggtgggcagatcatgaggtcaggagatcaagaccatcctggctaacacagtgaaaccccgtctctactaaaaatacaaaaaattagccgggtgtggtggcaggcatctgtgtagtcccagctactcacgaggctgaggcaggagaatggcgttaacccgggagacggacattgcagtgagccaagattgtgccattgcactccagcttgggtgacagagcgagactccatctcaaaaaaaaaaaaaaaattttcatattcattttaccataatgcatactttgtcatggcttttaagtttctaaggcaatggaaaaagtctagctaaaggatgttagttattcaaaattgcttgaagttgctatgtactagtttattaatgaagcatttagcacagtacctggctcattaaaagcatttcataaatattgactcactttcatattatcaaactattgcacttgatcatttgacagcaatagaagtttcaagtattaaatgtaaaaatattaaaactatttacctactcattttcacacaataacaatgatgaaactattttttattttaagtatacttcctcaaattttaatattcaatgggataaagtatacttcaagattttctttaatccatagactccagacaatgaaagaacatcaagtccatccacctgcctgtggcaagaggtgcatccagattaaattccgataaaaacttacctactctgttcccaaaattgaaaaaaatttccattctgtgacttctctcagatcattgaaagcccttatatttggaaagaattctttctaatttctaacattaatattccttgccgatactgagaactgttctttccttttctgaaatgaaattcactgattcctcacaattcttataatacatgtttacatatttgagggcattccaagttctccatgttccttttaagtcataaaaaagattaagcatctcatttattagattggggacaaggctgttgtattactgtgccagtgacaacagttatagaattttaaaactaattgcattcattgcattactggtgtgtttagagaaaaacaatgagtccacttgaactgtaatacaggatgtactatttttacagaaagaatagaaatcaaggagtaagtgagaaaatatgtgagctagttcaaaatgataaggaaaattataggataattaaggtattaacattaacattttaaataacgtagggagaaaatgagaggatagtttttaagttgacattaaaaaatttgaactgcagctgaaagggaaactgtacatcaaatgggaaacagtatattgatgttttataaacataattgatgattttaatgtggccaatactcattcaatttgtgagtggacaaagaaattaaatgaccagaatgatgagaatgagtgaagactatgagttgctggggagcagaaacccctcttattcaccagcatatctccaatttctgtcacaaagtagatgctcaataaacatttcctgagagaccagcaggaggcgtgtagacagaccctgggctccaaactgaactgatgagcctgggccactgctactatgctgcaaaactatctctccccaccttccattgccatgtcacttgaatccattcacccttccttctgttttccttcccctttatccaattaccttcttccttgttccactacatgttaccaaagcaagcccaactatgttttctgagaattttgactaacagactacaataggcaccatttcattgccatcaacttcacctggtccctgtcattctacctgctatgcgatattcttctctcactgtgtccattttacttcctacctctttttgttttttctctatttgaggtataaattatcaatgctaactaactgtgagcataaaagctgagatatgcatgtggtataattttcccacattcacagtttttatgtgtcacatatatcatatgcattatatgatatatgtatatatatgcaaattatgagtgtacatgtttttgttttgttacatcttctaatgtagttaaaatgaaaatgcttgtctgaaacgttaactccaaaaatttagtgtaggattttatatattaagaatatcattttaataattttatgtccaaaataaagttattaacaactatttcttagtttagaggaatgtaatcttatggctgtaataaaactgtaacacttaccttttgtctataggttactatatgtatttgtatatatgtagtgtgtgtgtgtatatatatatgtgtgtgtgtgtgtatatatatatatatatatacatacatacacattttatttttgtttatcttatattttgaagggtcacatgatagcatcctgtgatgcctgtggggttacaaagctgtgggactttcggaagctgttaccaattgtgtccatcgatataggtccaagtcctggcaatgaggtgaattttgattcatcaggtaggatcatttttgtctaatgtttctgactaagccaataacattaatatttgttctgaaactattttgtttctccttaaatgtatgtatttctacgtaaatgtctgttcttaatattacattatattacattacattaagatatattttatcattacgtatagcatgtcatatgaaagaattatattcatatatttaaagtcagaaataatataggtgataatgtgtactaatctagatagcataggtttgttagcagtgccatgcaaaatattcaaacctccattcctcagaatcatcatccaaggtaagcaaattcgattttctaaaggcaaaatagctaacagtagagaagaacaaaagtttagcaaaaatgaacctgaaatatttttagtgtaataatttaatgttaaaaatttaatgaattaccccatattgtgtagagtttacaactaatttgagataaacatttatcttattgttgcaattatgtgctgtgcattctataatgttattatatttagtttttattccacaatgatataagtattatcaattagataaaatattttatccttgttgatgaggaatagtgtagcagctgattttatgaaccacacaataattccagttgtccatttataaggttaaaaatacagttgcatctgcatctttaatgatagagtttactaaataatgtatatatgttattgaataatatattttttctttgctattgtgatacatgttttaaactattttaagttttgagaatattttgaatctttgagcattatttgtggtaaatcaaagttgtggcgatagcaaaaacttgattttaggtgaagaagtaaagaacaaataagaagaaaatattttattgttttaagatagtccacgtttattctttagtccagaaagtatgaatataccaggagtaattctagagccagaagataattgtgtgtttcttgggactggtttcataatattgccatcacatatctgaaatttagaaaatggtaagtttgtcttcttaacaaactttaagttatgttcccattacagattggcatatgaaccacactagtaacaatggcttctttaaaaatgttttagtaatattcttgttaagacatttatggtctgccagaattaaaaaaagaaaacactcttcaaaatagaagtctcaactatgggaatttcatcttatattgcaaaagcctattaaagggtcaatttatagtttttggcatatataatctacattgacaccatagctctaaaggaactcttacagctttcacttgattttcataaacatttcacatccttaaatccctttttattatcttgagctagcattcaagtattcatgtctttgaattttgaactccgaaatttcaaaattttgtctgtacttcctaatagtagaagttaaaaggtgctttgaaatatcattacaattaataatagccatgtattttattgtcattaaatatgttgccacttgctctttgccatccttgtcatccagcccaaaagttatttgcatacttagataaacatgattttaaataaattacagtacctatcttctgtcatacaggtcagtgtgattttaaggcccttggtacatcaaacctatttttttctctccatgactgatatatacttggtgatacactaatattaagaaaagcataagaatcagcagtagaacagcaagaaacatcaaagacaacacgtatgaacgagggactctaatgaaaacactttatcagtctgaaggaatatgatttcaacctgaccttcccatccctttgaccatttctttaaggaacataccataataaattttagttccatgtgtgtgagaaattactgtcataaggattttctcattgaataatgagaaatctgtgcttctgtacaagacaagtcctcaatgactcttcatttaaaaggttgaattatatcaaaaattgaagaaactggggaaaacaaacataaaatctaatgagagaatgaagaaagaggtgaaagtcacaaagttaagtgctagaaattatgttcatctcaagagagtaaagaagagtgcaaattaagagccaaacaaaattgaaataaggatggggcacataggtctcttctagttgcatttattcaggaaaaaaaatgatttaaagagaagtgtaacaaaattgtatcatgaaaatatgagaataaaataaaatctaatttagtaatctcaaaatacacattcatttgaatatacctttatttattcccagtggcaagccaatacaagcctatatgatgtaatctttttcaaaaaaagcaagaatataattgaccctattggcaataatgaacatgtattgagggctcacattagttatgtctaaccattttttctagtcaaaactctgtgacagaactaaattgtgcagttatatacacctagcgtgttatttgtcacaacttatataatgtgaggccaggcaatggtctgctgtctccgctgtgctcttggactattgaaaacacacatgtaatgtcatcataatgttatgtaacacatgtggaattataaatagcatcctgtctgagatatttcatataaggaatgtgggtggttattagatactttaagtggccattacataaaagttgctaataatatttaatgtctctagatcagtttaatttaagggtgtctcaaggttgtgaggtgtactgtttaaaaagagttattttcttatgaaatgacagatctttataaataagggatttcttatcactgcaaatccaacacagtataggaataaattgaaagtagaggtcattaaaaggctgaaactgttatctataatcttaaatttcaaattttgatgtataacaaaattttctctatttattaacctcataagtaaatattgcttttgtggatttataaaagtatatatgtactaataaatagtaccttatctgtcttaaaatagagattattcacagagtatcatttttaaaatgtagctttggcaaaaatgttggaaaaccaaaggtgaagaaaaagaatatagactatatatttcagacccttaggtttaatcacatgttcagcaccttttagactttaggcacattacctatttctcctcatggaaataatggaagagacaattgccttgcagtgttctaacgtggactcaaagggataatgatattctctaataaggaactcagcatcttcatctactgtagggaccaaccccacaaggtcggtgggtctctccctgtgtgcggcgacgagagagtgtagaaataaagacacaagacaaggagataaaagaaaagacagctgggccccagggaccactaccaccaatgcgcggagaccagtagtggccccgaatgtctggctgtgctgttatttattggatacaaagcaaaaggggcagggtaaagagtgtgagtcatctccaatgataggtaaggtcacgtgggtcacgtgtccactggacagggggcccttccctgcctggcagccaaggcagagagggagaggagacagagagaaagacagcttatgccattatttctgcatatcagagacttttagtactttcactaattgactactgctatctagaaggcagagccaggtatacaggatggaacatgaaggcggactaggagcttgaccactgaagcacagcatcacagggagatggttaggcctccggataactgcgggcaagcctgactagtgtcaggccctccacaagaggtggaggagcagtcttctctaaactgccccggggaaagggagcctccctttcccggtctgctaagtagtgggtgttgttccttgacacatttcgctaccgctagaccacggtccgcctggcaatgggtgtcttcccagacgctggcatcactactagaccaaggagtcctctggtggccctgtccaggcataacagaaggctcgcactcttgtcttctggtcacttctcactgtgtcccctcagctcctatctctgtatggcctggtttttcctaggtcatgattatagagtgaggattattataatattggaataaagaataattgctacaaactaatgattattgatattcatatataatcatatctaagatctatatctggtataactattcttgttttatattttattattctggaacagctcgtgtccttggtctcttgcctcggcgcctgggtggcttgccacccacagtctaccatgttttatcctagtgctgaaggggtctgagaggtcaactcattccttttagggatgagagaaattaaacatattggtgcacaagaaagatgcttgaggctgggtgccactgtagaagttttctagggaaagcataagtattaataaacaaataataaaagaaacaaggatcaaaacctcacttttatgtaatattaaaaattgcttaatcagtaaagttatatgtaatgcgatatatacatatatattttaagtcaagatataaacatataggaatcaccccctagagtttagcttttcctgttgctgtaaaaaatcagcctctcatacatttaaaaagttgtatgtggcacagcattatttacataatgttttattatcaaatacattgcttgtgacaaacacagatacatgtgtatagtagtatatatttatatcccaagtatttgtgaagggataagtgctcctttctcattaaacagaaagcctcctggtaatataatgctacacatttttgtgaacattcactacctaaataatgtctctcacctggcctactcaaaatgccatatgtttgatcattcaaaaatttattgctatttcagaaaatgttaaatggaattgcgtagtgaaagtaataaaaatgaaccatgagaatttatatacatacttttccacgtctctcatttcaccatgtttatgtagtttagcaatatttttctctcctttgtaaaactaattccaggaaatttgcaaagaagtcacatcctaagtcctaagaaaatgcagaagctgaagtttgagccagatgggcactttccagtagaaagcttatcagtatcagatcattaaaatgagcaaagtttcccaacattatgttctccacaatcggaaccacaatagaaatcccaaaatgggacgaaaatatgactccattcaaaatgcaaaaagtatcagaccccccccccccattttttcataacctaacaagataactctaaaacccttggttcatatttgattcatcagtttcttctagaaaaatctacagttcatcattttttatttaataggaaatttgcagttaattccctctgatagaagcagtatagtgtaagggagagaacatttatttagaagttagaagcccaagttttgaattttctctccactagttactagcaaaatgatcctgacaaaatttccaaatatttctgagcctcagattttttttgtatttaaaatgataaaaatctgtagggacttctactaccagacaagatgttgtaacaaagaccaaccagatttattcctaacctaaaacgattgaaagaaacaaaaatgtatgtacatatatgaaacaagggctttcagacatgtaatatttggcaataaaaaactgtaatacctgagagagagaaagtaaacaaggtgagccctatgactgctccagaatatagcctggagaaagtttctaggtttcaactcagggatgaagggacttttggctaattcccagagttgaagagccagtgggtagtccaggaaggccaaggcagcttgagtttgcagggcagggtacaggagagttatgagccacacacagagaactggagatctgcagagtcccctccagtcttcagctggctaagagtgaatacatgaaagcctgaggccagaaaaaaatctatcttaagcattagaaggaaaatcccaggagctcacacaggcctggaaataatttgtgttcgcaccaacaagaatgggaaaaccttacaattcaaaaagacagcaggttggcaaactactgcccatgggccagcttggcctcttttcatatatggagctttattggaacacaacctcgcttatttatttacatattctctaaggctgttttcaaactacaacagcaaggttgagcatttgcagcagagatatatggcctgcaaagtctaaaagatttacttttttttttttaaagacggggtcctatgatgttgcccagtctggtctggaactcctgggtgcaagcaatcttcctgcctcagcctcctgagaagctaggaagacagacacgtgacaccatgcctgagggtagcctaaaatatttactatcttgctctttacataaaaataaaattgctgagttagagtgctcagaagaatatcgcctccatagtgaagcaacattaactcacacctctggatcttgtcctacactaaagtcttttgaaccaccgtgttggctcatgtattcacctatttaattctcaccccaactcaatgagattgttactcttgcccctgttttatagttgagaaaactgagagacaaagcattaacaggcccactgtcacctagctgattaaatgtggagttgaaattcaaatccagagtctaaatccagagactaaaatctgtaagtttatgttattctgactcttattctaataattgtatttggctttatattgatacatggcatctgttaggagaaatgattcatttgctatgaatattgaaatagtcccattaatgacacttagtgatagttgactcaaagctaagacatggaatcctgttattgacattagttttcaattagttgcctctggaagaaaacactaaaagagaatctccctagtattatcttccaggtttctgataggtcttatgtgcaagaggcattctcattacatctgttttcctcctgggagctagaactccaaccttacactgcagtgtaaattcctattcaaggaattagggctgaatttagttgtcaccacaactcaaaatgagattgttattcttgcttctgttttatagttgagaaaactgagagacaaagacagccagcacctccagagcacttttttgtcttttatttaaggcctggtctgcttaaaaataattattaaaaactgaaataggaaaagaagaaagtggactgggccaggcatggtggctcacacctgtaatccgagtactttgggaggttgaggagagaggatctcttggccaggagtttaagactagcctggacaacatagcaagatttgatttctacagaacattttaaaaataggcagatatggtaggacaacagtagtcccagctactcaggaggctgaggtgggaggatccctgagcccaggttgcagcaagaggatggctgagcccaggttgcagtcaactatagtcctgcccctgtactctaacctggatgagtgaatgagaccttgtctctaaaaaacaaacaaacagacaaaaaataatttaaaaagaagaagaaagcaggccaacttgttttatctctaaagcataaggcagatccaaactaagatgttcttccgaagaacaagcccattctaccacatctggacacagagctgtaagaggagaggataaaatacaagagagaaaaggtgaccaggtggtccttctgaattattttacaatcccattatttcattacctgttgagtgaccctattgtatatgcaaatccattttgttcttaagtagaatttgggcctcactgattctggagaaaggaactggagaaactgaaggatgtcagactatgtggctctttggatgcacaagtctatgactaatacctggaatgaggtatgctatgctccaggaatcatgcttcctttttcaatcaccgcagcacatgagttgggtttccttcctcccattttaaagttttaagagatttaattacatgtgtatattaataaatacacatgttcttacagttctgtaaaagtcagaattgcatttcattaaaatgtaattttaatgtaatgtaaattaggaactgtacagtaaaaaaaactgttatgctttatctggaaatttaactatttttctctttgattttgtcttcttatcccctaggctagaagcaattttatttatctgccagcaagtatggaaaataacatattaataataatggggacaccttgaaaactttaactaaaaacaaccaaaaatatattaatttagggataatagtcatagttgtgcagttttataaccataaacctgttctgatttgtataatgtccattctgattggttggtgatcatgtcatatcagttattaaatatttagactatcctaatgatgactcataaattatgataactaaaatgcatttcaattgcatgatttatgatagattaatataaattaaagttattgacttctacaaaatataatttattcaggaaacgaagtcttgttcctttctgatatcaggcttgaaagattgtatacttaatctaatgataacatcattgcacaaattatgaatcctcccttttgtaattgtcttcacaactttaagcacaatgttttaaggttccccaatacccacaaatcttttctctgagtctagactgaattttcagaaacatcgagaaattattcatgtctccatcagaaaaggacatttgaatcaggaacaaacgagggtctaaacagtaaaattgttgttcatctgtgatttgtaatatgaaattgagtaggacacttaacctctcttgacctcaactttatcatgaataaaatacaggttttgattaggtgacgttatcaattaggttcacagcctaagttttaaacaattgcattttttcctatgtttagaataattagaacatgatatcctgagtcaaacataatattctaaaataaaatttaaatgctcctctatgctattttaaacttgaaaataaaacatcaaaatgtaagtaaaacattccacttttcctcgatccaaaacagaaataaaatttgatataaaaatattatttaaaaattgagccccaaacataaatggcagctgtattgctcagcaagactaaattgttattctcgcatacctcacaacacggtctctgtagcaacaggaattttgaacaaaaaaaatgcataaattccaacattttaataaattaaattaatgactggatcaaagtcttcttacaggactatataagaacctgactcattctgattaaatcagagccgaaaaataactttacaaattgcagcattatgcaggtgcagtcaaaggagtgtcattggttaattccttaatttggggtagtatttttaaaataggtatatttataatttttgtttagcgctctgatacagttacataaaagtataattgtaataatataattggaacgctataggtatagacaatcaaaaggtgcttggaaatattttcctacttaaatacctccttggaaattgtttacaaagcaactatataacgatgcacacagttatataaaaacaattttaatctagcacatgcccaaataatgatgaattctaaattagtgtaatcatatttagtgaagatatatgtatataaacaatgtgctaatgccaaattatttttcaacacatttaagaaattcaaaagatttgtatctatgtggcaagtatgagaaattagttgcgtaactatacacatcttagtatcatctaggcaagaaactactccagtgcatataattagctatgctggtatgtttgcagatataataaaaattacatgtataggctggcataggtcattttgaaacatgaaaagatgacattcttcatacatactttaatcaatagaaataaatttatacaaagaaagaagagataattagaccttttacttttttcctaaggagcagttattacatttaagaggaatgtgttatttagatctaatagcatatactagtcattagattgaaaatcaagagttaaaatttgcagtgcacacatactgcatgacccaaagtcaagtagctcaagaatttgtcatctttttaatagactgtgtatacaaaattgaatagataatcatctttagtctgccaagctgatactttttaataggataatcctttaagggaagctgtagttcaacagatgtgcaaatcaacccagaacaaatagcacactactcttggagatagagcctgcacagttggcacttgtgataacttgtagttatatttatctaaaattgaatttcaaactatattcaaatatgatttactcaaatctgattgaactcagaagtatattttctcacttgttctataagagaagtgtaaataaaaattgtttaaagtcatcttcatgtaacatctcctaccatgcactctatcaccaatagaaaaaataattgaaaggaataaatagcatattgttattatgaaaatcaatactctgtaaatattttgaaataatgataagcatctttgaataatagacatacatttcagaccatgtcttctatccaaaaatgttatcattccctctcttatatatctgttggtctaacagtgagaattatgttaattcggttgacaaatatttaatgtaagcctactatatgccaggcactgttctaaattctaggattcagtgttaaagagatagaaaatactctatttacaaagcaaattgaaacaatagacatgaatttgcaggtaatgactaggagtattgcaaacaaactgttccacatgttatatgctacatgtgtcatctgagtgctgtttgtaaagaatagcatgtatttgaaggtggagaaaaaagatgggcattcctataatattagctatataaccacctaattctcttctaatggactcaattaaattaatggactcagtaattagtgtaagttttgattattactgcttttttgttttatcctttatgcctttcataatatttgatttttttcttgtatttatactactttaggtaccatttttccttatccaaatttggttgtaacagtggatccttctgctacttgtgcttattttccttctacttcttttgctgttcttactcccccttagctcctttctctgtaatcatttttatcatccttttttttctttttcatcaggtacaaataactgaattaatcatacttctcagtatgtgataaacttattaatctccttttatgtgccgttcctactttcattctttcccattctccatggaagtttttaaatgtctttaatatgttctcttagatctgcagatatccttgaagaacgtatatatagagaaaattattctgtgtatgtacgtatgtaagtttctaaaaactatgttttgctatgcattccattcaatttcttgctttttcattttacagcatgttcttacattttacccacattaatatatgcctatcaatttaatcaattctgtctacttgatagtatttcatattattcatcttactattttatttatccattgctgtaatgatggatgcataattttcctataagccccttgctacctaaaggcattctgcactaaacatttttctcaaacagaagtttactgatttcatctagaatgtcttttattaaattgaaatatttagattatattgagtcaattgttcagctcccacttataagtgagaacatgaagtgtttggttttctgttcctgcattagtttgctgaagataatggcttccagctccatccatgtttctgcaaataacatgatcttgttcctttctatggctgcatagtattccatggtggagatgtacaacattttctttatccagtctattattgatgggcaattagattgatttcatgtttttgctattgtgaatagtgctgcaatgcatatatgtatatatgtatctttgtaatagaatgatttatattcctttggatatatacccagtaatgggattgctgaatcaaatggtatttcaggttctggatctctgagaaacttccacatcatcttccacaatggttgaacttatttacattcccaccaacagtgtaaaagcattcttatttctacacaacctcaccagcatctgttgtttcttgacattttaataattgccattctaactggcatgagatggtatgtcattgtggttttgatttgcctttctctaatgatcagtgatgttgagctttttctcacatgtttgttggtggcatgactgtcttttttgggaagtgtctgttggacagtgagagcacatggacacagggaggggaataacacacactggggcctgtagaggggtggggttgatgggtagagagagcattaggaaaaatagctaacccacgctgggcttaatacctaggtgatgggttgataggtacagcaaaccaccatggcacacttttacctgtgtaacaaacctgcacattatgcacatgtactccagaacttaaaataaaaataactttaaaaataaatttaaaaaatttttaaaaaattaaagagtcaaaactattttgtttgtctttgtatttttttggaggagggattgctgaagaatatcaaccctgctgttaggtcacaaaaatattcttctcttctagcatctttctcttttagctttacgttggtagcttttacattttaggtctttaatccgaggtgcaagggagtgttatcagtccatttttcctgcaacaacaaagaaacccaggatcttcctgacttatagaagcatttgtttctcgttcccttatcagaaagcttcaggacagttcaaggctgacttgctttcctgggctcagcctaatgccatgtgtctgatttcagatcccaggaccttttggtgggacatgtcctcatagaatgagcaggtcaaatgaaaaaccaaacttgtgcaatcacatttaaatcttttttgagatgtcacaaattttaagtctgtttaacattccattgaccataagaaggtcatagcaagttataaaccaagtacaaaaccactgagatggggacatatatcctattactacagatatcaaagacaagtttcatggtaataggtggagatttttaaccctattacagggaagaagtaagtactgggaacaataatgactatagagggagattcaactttatttctctttctaataagtcagttttcttaacaccaccaactctactattgaaacttgtctcgttgatttgtgatgccacttttattagagatcaacttcaaaccaatagacacatcattttctgaattttcctttctaatatgctggtaacattgcctgtttctgatctagcacaatactgtttttgttgccgtgatgttctagtattgtctgcttaatatctaaatgaagccacactctttgtacttctttttaaaaagtatccattgagttttctatttcttgagacttttggagttatcccttttaaaatttcaaactgtatttcaatctgttagagaacatgatctgcattaagttcatcttctatgcaaatatagacaatttgttcactgccccttgtttaggcaaaaaatgcatttctgtgcagcaattggttgattcaaaaaatttatagaactttcaatttagcttattaactagttattcaaataatttatacaatttattttttgactgcttgagatctcagtttctgacatgcatatattaaaatccttaaccacaaatggtaactaatttatccatataaatctgtcagttttcactgtatgtattttgaggctatgtttccagatacatatatatgaataatcattatacattcttgatcttttttccctttgtcaaatataacatctctttcatgtgattttgccttaagttctattttatctcacattaaagttggcaaacctttttatgtcatattttccaagtaatcttttccatacctttactttccatacctttttatggcaatttgtttttatttatttttgtttttctccccaatctgatatttatatttttgagatggttaatttactcataatagttgcattgtttcctacatcagtatgcttgcttagaaaaatttttgtattggtcagtattctccagataaacagaaccaatatgtgtgtgtatatataagaatgtatgtgtatgtatatatgtgtgtgtgtgtgtgtgtctgtgtatatgtgtgtgtgtatatatatatacacacacatatatacatatatatatacacacatatatacatatatatatagagagagagagagaaagagagagagaggaaaagatttattttaaggaattagcttatgtgattgcgggggctggcaattgtgaattcacaggttaggcaaacagtctagaggctcagaaaaacttgatattgcagctcgagtccacaggtagtatagaagcagaattccttctttcttgagggccttagtctttctttattaacgctttcaactgattggatgaaatcattggattggatgaggcccactcacattatggagggtaatctgctttacccaaagtctgtgagttcaagtactaatcacgtctttaaaaaaaatacctgtacagcattatctacactagtgtttgaccaaataccgggtaccatatgtacaatggcctatccaaattgacatataaaattaaccctcacaatgctacattgtgattgtcttgaccttgtctttcccttgatgatcttatttctttcaggaaatatttactatgccctattctagacagtaaaaatagagcaatgaaaaaatatatctgctctcatagaacttacattctacttgagaaagaaggttcagtgaatgggaggtggatgataaatagctaccgaaattaatgccaacatatttgccaagtggtgataagtcttatgaaaaattaagacaagttaagagaacaaagagtgatgaagtggaatattactttagaaaggatgttctgagattacttctctatgaagtgatacacatgagcagacacctggatgaattgagggaatcagtcaaatggttatcagcaggaagagcattccagaaaaaaaacagcagtgcaaaagatttaaatctaaattatgctttttgtgagtgagattggataaggaaaactatgagagatggatcaaagtgttagccaagggcagattatggatggtcttgactgtggcaccaacgctggtctttattctaaaaagaagaaataattataagttagctcaattttttaaatgcatgtacatttgatggggtataggtaaattaaaatcttgccaagagaccaacacatgcaacttaaaagagagctaatatatttgatctcaaataaaagaacaaccaatgaatttgtctgctattaattatggatgatcaatccacagcaaatcattcctatttatgtctaaagacatggtgggacttaaatcagagacttaacagtataaaatggtgtagaaatttaaatgctccggacactgctaagagacagcaattaataatatcatgtaatgaaaaattttgtaaactactcttatattcttgtataagggctattagatgttctgctgaggaggagatagttcatgagtttgctactttctagttccacatcaatggataatttctccctctttactgtatggaaatttataatatgtagacattttgatgttgataacatttagaagtgtttaatttttagtattatcagcctgacagacataagttttattaaattagtttgagaatctctttgaagatatttgcatctgcataagtttgcatgaaaaaaaagtttgcattttagggggaaaactattatatcagtgagaattttggagtattttgcttattctttctggaactttgaagtaatgtgaaatagtgtttagaaacctcatctcaacgtagggggcttcttagtaataatacactgtatctgcatacccgtttataggttttaatccaattcattccaccaacatatcttctaatgcttagtcctgttgtcttctcatgatcaaaaatgaccccttttaaaaatgctttgcatcaccatcctttttttttttttttttttttttttttttttttttttgccaaaattgacatccagtttgttttaagacagtttcattaggtcatatgtctagatttgttacctccattcttcctctgcctgggcctaaactattctataatttttctctgtccccactgccccccacccccttgaaatcatagtcaacaattaaactttgctacttataagaaagacttgacctggctttgggacagccaactgagcataaagtggtgaatatgctgttgagagtagtgcttataaccccatcatatgtcagtcaaccagattagcatactgctccactattttcattaatgaaggcagaatttgtgttaagaaagccatatttgctacaattcaaagtcaattagctttctcgtgaaaaaatgagtttctcatttaggtgcttaatgttaaaataaagagggcattgttcatattaattataaaataattcaaaaagacatctctagacaccaatcaggaaaagataatcactgaagattatctgaaaataaattaaatgtctaagcataagtcttgttcaaatataatatctcaaatccatgcaatggaataccatgtgactattaaaatgtcataaatgtgcatataatgaaatataaagatagattttcatagtacatagtgaaaacaaaggcagtggaaaaatgggatataggatgtaacttcacaataatcatctagatagagaggtatatagacaggatgctgtgctgctcattctccattggccccattcctccactcatccattctatgttcttctctgccttcctctattccctgggaggctgacttgcctattgacttgtgtttggaattgacgaatgggaggcacttacaggagagtgaagggcaggaagagagggagattggagcatctactccctccacgcccccgggctcgggtgcacttgcacagtggctgcattactctccagctacagctcccatcaggccgacttactcctgagactggttctcagccaggctcctgttaggccattttctctcctcaagcctagtgtcagtaacaactcttcactgcttctaatttacatatgtatttccttaatttattcctctatctttaccccttggtaaatatttagtcccttcattaataagtctctttaaaacttccctctgagagtgggctctttgtttcctggcggggccctgaccgacacagttgctcataaaaggcctggcatgctaaccactacaatgtgcgtaggcattctctgagaagtgttttgccttttgttctaaattttctaaagtgaatatataacgagttttcaatattaagaaaatcaagtaaaaatgtttctgtacatgaaagagaaaaaatgaaaataaataatgctagtatgaaaccaagaagagctggtatctttttaacttgttttaattggccatattggtcttaaggacctcccacatctaacactaagtcttacccatctcctcccaaatgagttagaaagagaggaggagaagggcagatgaagaagactcagctgaagccaagtgaaagttagcatttatacctaatggaagttaataaagcttaactccttggacttcacatatgtctggaaggaagagattttccactctactgtcagggttaaaacacttacatagcataattctaactccggctctgtccctccttcctctctccctctatgaaagtggtatctatcttggtaactggtgtcattgaatagcctctacttgtgccgctctccttggaaaaacttgtcatctagtcacacaggttcttccatctattactgccagcagacagcaccagcagtggaggcctgagttaccacaatgctgccaataattaggtgggcatggttcattcactgtggggagtgttaggatgcccatgagccaacaaatttgtgttatgtgttcagcttggccttatcacattttagctgcattctgttctccctataaatcctgtgccttttcctgggggtggttccaaactggagaaggaaaggaaaggatactttactgatgttctcaaaacacagtaacatttagatcccttctatatgcccacaggaggcaatatttttttaaatgtgtatttttgttattctaaatgtcttataattactgcagtcatttttgaaaagaatatgaaacacatgtaaaagaaaaatcatgaaatcataaaagagttaattgtatactttttatgaaactataaaatcactatataatatatatttgataatataatgttttcagtctaattatatactttttttttttcattttagttatgtacagggacagtagaacagttaggaaccaaggtctccagagtgacactgactggttttgaatctagattctaccacttattcattctctaaccttgggcaaattccttaatttttcttttctttttctttttttctgttttcttttcttttttctttttctcttttttttttttttgagatagagtcttgctctgtcacccaggctaaagtgcagtggtgccatctgagctcactgcaactccgtctcccgaggtcaaaggattctcccacctcagccttctgaatagctgggattacaggcatgcaccaccacacccagctaatttttgtattttttttgtagagatggaaattcaccatattggccaggctgatctcaaactcctgacctcaagtgatctgcctgcctcagcctcccaaagtactggaattacaggtgtgagccactgcgcctagacagttccttaatttttctatgcttaagttttcgcctctgtaaaatgagaataacaaaatagtgcatgttgttttttgtgagccttaatgaaatattcatataaacatggtgaataaggcataagtctctgcccttattgtttacacagagaagcagaaaattaactacctctttctttctgtctctgtctcacacatgacacgcacgcacacacatgcacacacacacacattcataaatggtataagcaaaataaagccatgttaagtatacacagtgaaagagtggatagtcatattttagataagatgtgcaggaaaggcctctgagaaaaagcaactttcctaactgaggaagcaagtcatgcacaggtcttggcaagaacatttcaggctgaaagttccaggaggcagaccattagttaaaaaaatgttgcagaggtccacgtgattagagtggaatgaataaggaaattaagataacgctgaatcgattacctgagagcaaaggggaacaaaccccccgggtaggttccagactcagtatctgagaacttccaaaggatgtggtactattttacttaatggtgggaaactgtgacaaggtagcctgagcaagtgttgttacttcaaatgcagctatctcaccagcaggattttgtgtatggaatactacaattaaacattgaattaaatattttatgttgtttccaaaactaagtcattatgattgtgtatgatatatcccaatgttttctattaatggtttccagaaacaccatctttcttttgtaggttagaacattatcatatgaaataagatgccaagaaaagaacttgttatatcacgtaactcataatttgataatccttgagtattcataattaaattgaaaaagtcattatttcttggactataatagtatctgagatgtaaattaatgtatttatttgttactaaccaatataatttaattttataccactttaactccccattttgtgttaaaaaagaacacaatcataatttgactcctttattcaaaggaagtaaattgaaattcaaagtgttgcgcttaaaagtgagttggttagtgtttaactttcttttgagcacttctgtccccaaagccggtcagtactttgcattttggtcatttttcttttgctgagataatgagggtggggactctttacaactgcaggcaattgctttgagctccgagcactttgaagagattagccccattgatattctctccaatatttttggagagaaatgctgccttcccttgagtgtaagacgaacggctgttgaatagaaacttcttttgtctagcagagagtatggtaatacatattctcttcttagagacatatatacaacattagaaagttatctaagatgattgggagcctcactacactgacttgttaattttgtttaaactttcagttaaatgtggtctcatttacctggaaagtatccttaaagcgtttgagcctggattgtattgctattaagccagtgaacttggtgatgaacaagttaattatcctggggataaaaagggaaaacggcataatttctgccagcaatacagtgaaaaatatatgagtgaactatttggaggcctgcccactcagtaggacttagctggccagtaacctgatctctctggtttgagttcatcaaagacatttctttgatctaaaaatgttacagaatgctaaaattcagatgaagccatataaataatataaattttataccacttgactccacatgcattatgtttttgtttcagagaggttcagttagcaaaaatatcaattcaaatgacttttctgtcattaaaaaaatgccttttgtgggagagggatacacatacacttaggtgtgtatacatatacacacacacttaggtgtgtatacgtatacacacacacttaggtgtgtatacatatacacacacacttaggtgtgcgtacatatacatacacatataagatataaattaaaataaaattaattaaatatatatttaatttcattgctgcaattctacctagtgtctcacataaatacaagatcatcatctactgattagcttgctcctgcagacaatcggatagatactaaaacctcctgaaggtcatcataacctcattttctgaaagcatcccttgaagttcaatagcttagaaagtttctgttgcatttgtgtcccttgctgggttgtatatacataaaaagggatattactttcattcagagaagataataaaaccttgtgatttaggaaacagggttatcatcaaataagccttttatttatgctattcagactgcctatcttcaggatatcgcaagtactgatcaatttcaggtcaattggatgtgtgaaatagaagtgttgtggtataagctcatgattatgtcctgtagcttgaaacagtgaatttgattacatgacatgttgctgtaccctctttggtcttattgtctgcacacttcaaataatctacctgtgccaactctaacagcccatttcattctctaggaaataaccttgatataactctaaccatttcttcatggtgttagaaattataaactcataccaccttcatccttagaactttttaactctagtcccaatatcattatccaggattctgggcaggctgccatatagcactgtgatggataaatacaaatgggtgtgggatttgctgaagggtgtctaggctcagaaaattgccattgtgcctttacatccaagagcgcctcacaagattacaatattttgtgactccttaaccttggaaactagagtccatgagacttttctaagatcataacaactttcaggaaaggagataattttctgtacctcagaaaattctgaggtacaggtctggccacttttacttcaggccaccaccttagttacactggaccttaattatcatggcaaaaatgtgaagcatcaatttttgactcctttacattgaaatagatagtttatgggtgcttagactgtcaaagctctcctttatcagtgttcttttctctaatttacaaaatatattttgttgttttgttgcactttgctgagttatttatattccccttgtacagatgctagcatatcaataaatagtttatatattttataacatcacagaaaacatttattgagggcctttgactctagtcattatcattacttttcacaaacttgcaagatgatttctaagaaattctcattaaactcttttaaagtttaaattcgaacatattttctcagcaacttttctttgcttttaaagaactttggctccttgcactaacagaataccatcaaatcagttctactcctatgtagtaagacaaattttatctttttccatagaattgaataatttcatgatactagtttaagaataaggcttgaagatgctgatttgcaactgatactggtgcatcaagtatcataaaattccttaagaacaataaataagtaaacatatattttaagtgaaaagttattaatgtttttttctttttaaaatacattttattgtgtatatttgagatttacaacatgatgtatggggtacatatagataaatggttactatagtgaagcagatcaacatattcatcactttacgtaattacttttctgagacaagatcagctaaaatctacttatttaacaaaaatatctaacatagaattgcatctcatgttacacattagatctctgatttatcctgcatactttgttttttttttaaattttattattattatacttaaagttttaggttacatgtgcacaatgtgcaggttagttacatatgtatacatgtgccatgctggtgtgctgcacccattaactcgtcatttagcattaggtatatctcctaatgctatccctccccacttcccctaccccacaacagtccccagagtgtgatgttccccttcctgtgtccatgtgttctcattgttcaattcccacctatgagtgagaacatgcggtgtttggttttttgtccttgtgatagtttactgagaatgatgatttccaatttcatccatgtccctacaaaggacatgaactcatcacgttttatggctgcactgcatagtattccatggtgtatatgtgccacattttcttaatacagtctatcattgacggacatttgggttggttccaagtctttgctgttgtgaatagtgccgcaataaacatacgtgtgcatgtgtccttatagcagcatgatttatagtcctttgggtatatacccagtagtgggatggctgggtcaaatggtatttctagttctagatccctgaggaatcgccacactgacttccacaagggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatggtgaacattttttcatgtgttttttggctgcataaatgtcttcttttgagaagtgtctgttcatgtcccttgcccactgttggatggggttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaatgagatcccatttgtcaattttggcttttgttgccgttgcttttggtgttttagacatgaagtccttgcccatgcctatgtcctgaatggtaatgcgtaggttttcttctagggtttttatggttttaggtctaacatttaagtctttaatccatcttgaattaatttttgtataaggtgtgaggaagggatccagtttcagctttctacatatggctagccagttttcccagcaccatttattaaatagggaatcctttccccgttgcttgtttttgtcaggtttgtcaaagatcagataattgtagatatgcggcgttatttctgagggctctgttctgttccattgatctatatctctgttttggtaccagtaccatgctgttttggttactgtagccttgtagtatagtatgaagtcaggaagaagttgaatctctgaatagaccaataacaggctctgaaattgtggcaataatcaatagcttaccaaccaaaaagagtccaggaccagatggattcacagacgaattctaccagagctacaaggaggaactggtaccattccttctgaaactattccaatcaatagaaaaagagggaatcctccctaactcattttatgaggccagcatcatcctgataccaaagccaggcagagacacaaccaaaaaagagaattttagaccaatatccttgatgaacattgatgcaaaaatctgcagtaaaatactggcaagccgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaatccttcatgctaaaaactctcaataaatacggtattgatgggacgtatctcaaaataataagagctatctatctatgacaaacccacagccaatatcatactgaatgggcaaaaactggaagcattccctttgaaaactggcacaagacagggatgccctctctcactactcctattcaacatagtgttggaagttctggccagggcaattagacaggagaaggaaataaagggtattcaattaggaaaagaggaagtcaaattgtccctgtttgcagatgacatgattgtatatctagaaaaccccattgtctcagcccaaaatctccttaagctgataagcaacttcaacaaagtctcaggatacaaaatcaatgtacaaaaatcacaagcattcttatacaccagtaacagacaaacagaaagccaaatcatgagtgaactcccattcacaattgcttcaaagagaataaaatacctaggaatccaacttacaagggacgtgaagagaagttattaatgttgaaacagttcagttaatgttgcctgcaggtattagtttaatgttaagtgctgaaagaaattaatgcaaaaattaatggcttaacatcatcaatatttacttctcactcacatcaatccaatgtgagaaggattctgtgccatacatacagtatttcagtagcccaggatggcaaaggctgttccattttcagtatttagcttcaaaggtcactctgggcataaacatctagccagtggacaggaaaagatagggaaagctttcttcatcacttttgcacgaatctaaaataaatattttccactactagggccagaggccctcaataaataaccacttcattcagttagcaagtactagttccataccctgcctagataaaaaggagactgagaactgtattccttggcatagtagccattttcgagccacaactctaccctgcagaagccagtctgaatcttcagtggagagtcaacctgtgtctacctgaacctgtaaattgttactttatcagctataattcttgggttgcagtcaacagaaattgattctgctatctctcctaagaaagaaatagattagaaggatatgatgcagtttgcagaattcgaaagaaggttaaattgaggaaccaggaataaagaaatatatatatatataaagaaatgtgtgtatatatatatataaagaaatgtatatatatatataaagaaatgtatatatataaagaaatgtgtatatatataaagaaatatatatataaagaaatatatatataaagaaatatatatatatgaatcagagaaattctgtgaataaaaggaattggattgatgaatgtggtcttctgagtactgtcaacatgagtacgtctcatctcaagatgagatggctctagccactttctgtccaggtgttattccattcaagatttgaattaaagaaaagaacatctgattagcagagcacttcctcttggctagtggagatcggggtatcttgattgacagtcctctaagattttacccaatgagacatgggaagacacctcaaagccaaaacaaaaaagagcaatgtcaaaagaaggggtgatagaggttaggttgatcaaacaatatatatgcttttaaaaaatcagttatttcagactacttttagtttaatacattaaaaagcaagaaaacagttcctggtcagaacagcaaggagaaaaaactgataaatcattataatcagtataaaattcttcttcctttttgttgtaatttgatggccttgaataaaattttgaatccttcagtagttaagtttctttatgtataaaggtgcagatgagagtactttgtcatatgaggcagtggtgtttggttgtggggaatgggagggaaacagcaatgagaattaatgtgttagccattttatatgttgtgatttacttggaatatcccataataaaaacatttttactgcttataaataaaattatactttgccaaggagctattataatatactaatttgtattccactgataaattcatcttttaatgtatggataccttcagattaaatacaggtttattaaaggcttttgttgatgacaatgtcctcaaatatagcatttaccaccatttcctgacaaataactatgtggtgaaatggatccaaatgaacaatatctaagtagataaatgttaagatactgtaaaggaaagaaacttctttttttaaaaaaaaaacaatattattgctagctagaggtgctatagatagtcatccataaaaataaatgccaggtttgaaaactacaggatatacctgtagaatatcataaaacttacaatgaaaaaaaatcctccaaacagatcttaatatgcccctcttatctgttcactctatcctgtagctgtagttttccaagtaggctactaagcggtctttcaaagatttattttaacaaatggctgctctgtctatgcacaaagaaaatgaaataaccctataattttgtgaatttttaaaggtaagctaacaaaaagattcctttcctgttcctttgattccaaagaatgtatagttgtatattattttcccttgggagctcggtaagacaatcttcccctgagtctttattcaagtatttcatataacaatagaagtacagtgatggtcaatttcttttaaaattttccatgtatgcttactctagagcaaattccactagtgcccttaagagtctctagtggaatttattgaatgtgtgtgtgtgtgtgttttatatatgtatctaaaaatagttctttggcaaaaaaatatgtgctatcaattttttaaaattacactggcttttctagactttattaacgtatctccggagccagaattttatgctaagctttttttaaaaaaatttctatttgtggtatatctatattcagttataattggggaaaaaccctcacttctggagtgctgatgaatatagaattatttaagaattaagattatttcaagaattatgtttggaataaatctcttaaacacaattctcagtatgtgagcttatgatatttatatgaaaactaaaaccatttttcttgccaatggatatgaaattattgtcctattagacacctagaccctatttcctgcagaaaggagcatcattcataccattgcctaagctcaaagtccctgaattttccttaacttctttttcttaacatatggaccattaccaaatgtatctattttgcttgcagaataggttcaaaatctaaccctttagatgaattgtctttaaaaagattgacttaatggtgacagttccattttttaaaattcttaatgggacctatggttctaccagcaattctctagtattccaggaattctcaggattttacatctttgctgtgactttcctgcttctgcctggcaaaccctgattcattctttaatattctattcaaatagtactttttctaatatcactccctcactttttctcccaactctattttttaggcgaaataaattcttttgtcatctttgtaagaattatgacagaaggtaggttttttgtgaaacaaaaatgcttcttatggaagttatatttgctttccgttgtacattgatgtgttacagaatggcttagtacttagcactgtagtttgctgagtatttatagtacctctgctagtatcaaattaacctaacaaacaatgaagttttataataattaataaaaaccataagtttgttcctataagtaaatattttatatgtcttaattatggagaaaagttcaaggtaaattttaagttaaaaaagcagaatatatatatacatatatatatatatacatatatatatatatatatggccagaattgttatatctaacttcacaaagtgtatgtatatatatatatatatatatatatatatatatatatatattcatactttatttgtacatataaactcaagtagatatatttgtgtttatatatattttcaaatacatttacacagaagaaactgagaggaaatataggtacttacttttattaacccaaattagcttatttttaaaatgtcattaaatctaaatatacctaactagggtattttgagaataaaacgttcttatttgactgaattatctttcttcagacaggagatatcagagttttgcaaacactgtgctatatttttataataaaccaatctaggaaattggaatgtaggagtttaatggttgctatattatgtagtttgtgaaataatgaaagtgagggtaatcaatgtgaaaaactgcatatataaaattagaaacagatgctaataaacaggtggttgaacaaaaaatactatggtactggttcagcacgcttgtgctgaggaaacatctggatgtgggtgttttactccaaagctagaacttgctaacaagaaataaaaacaagaaatttcttgagtgaatagagtgaatcaaaaagtgattttcaagatgatctttaagtctatattgcttttgaatgtctatagagtaatgaggctgattcacatgcaggaaaatatgtcgataacaaatatcataaatagagcacacgtgcacatacaactaagtttgttttgtagcacacccagtgttttgaaaaatattaaagtaatatttctaatttctattacccagtattcgaagctgaatttccttacaaaaacattttgatgatttttatcagaaagaaacatattttgaaaatgtatccttctgaaaatcttcctagaagtgtttattatatatagtatgcatgcaaataatatatagtttattatatatagcgtgtaaataaaagcccagttgttaccgtcatttagtagaaagcttatacaattttcttttgacgtatgaacatttcttttgcaaactaagatgacccactctacaatctacaatcactataaaactacaatacctgagtaatgaaaatattgccaaactctaatcacttctctacttttagaaatatttagtaacacaaaatttaagtgtataaaaccaaaacaaaatcatctagcctgtaggaatttgttgcaatagtatttgtttttcaccatttgccaaattagaaaagctggacctgtgatctaaaagatccaattctctggtcaatttttttatagcctgcattgtttccattgagttttatgctatcagttggtataattttttttttctgtttggccataatattgtaagcatacgaaatgggcaatatgtcaggaataattaggcactgtggtgctgaaaccccagcgtatatactgcttcttttatagaagaaaccagttacctgtagtcttgtcagtttaacttagcaaagaccatctgtttgcagccacctcttttctcagaggagcattccctcttccacaaagaattgctccatgacgtcaaaaacacttttctctacaaaatggtctctcctgtcttcatttctttctgttttctaaactgggttgctttttagagaatcagcaaatgtggcactagataacttaagaggtgaaataaaatgaatccgatagacagtgctctcaatagaatagatatgaatgtgcttagataaatgtatggctacaggaggctttcttgtggacaataactatccaaaaatatttacatgtatttgggagtctaggtttatttgcaacagtaagccaactggtatttgtcaattacatttaaatttaaatttaatttcaaatcatactgaacattatgagtggaaaataaatggttttatgtgcttagaatttaacagtttatatgtaatattatgttttggaaaaacatgtaaatggtgttagaatagttcagctattactaagccattctgggttagcagttattcaggaaaagactgtcaattttatataaaacctcttagataaatagtatgggtatatgcgaaattacacagataaataatattctgcatctttcatccctccttcccatttcatgacaaactactgttttactaaatatgacaatgtatattttaaaaccaccagaaattataatacctatatttcctgcaactggggagtaattcagagggaaactgggaacttacccagtggtgtatgcttgagtttatatgttttatacatatgttgagggaagaatgcggcaagcctgacatttctgcatatttcatggtatttagggaatttgtccagagcagagtggaaattttttgttctagccctctttgttcatatgttgccacagtgatctatgagttaacaattaatggctgtgatatttcagtgcaaaaggacagttgatcatcaaaataactcagatatatagtcctgttataatcattagaatagtatttagtatccaagtatttccaaaataaattcaataagctataaatagataataatttccatcttatttaattaccaacaaactttttctttgtagtcagtattcatccttcctttaaatgacaagttagtgccataaaaacaaggtagcattcaggaaagcaatatgcactgcactgatacagaataatcaccaaagtaagaaaaaggatgtatacttggagttaagacacctagacacatatttttataattaagtgcaaattgtaaattatttctttgcagtatgggctctgatagtggttccaggattagatttttcttatacctaaagaatattttcggaataattaacaactcatattgaatctgaaagttctcacattgggctagatgcaacgtgacctttaatctttacctagtttaaactcatgccaaaccaacctgggatcattttgggccttgagtggattttattacaaacttctgttgtctctcagttaaagttgcccccgattggtttagttttcagttttattaaagatagttattatgtaccatccaaaagtaaacaagacttctgggtaattttacttagcatagtttgttttccaaataaatttagaaataattttataaaaatgacataaatattgcttgaaaggcattaaattagcaatagtcagaacatagcttaacagagaacatctgagaagaaagagaagcaataaatgtgagtagatgtaacaaaggaatatctaacatgagaaatgtgatttttatattttcaatttgtgtccctctctgcctagtactaacagacagaaataagaactgaacatgatgtaatgaacagagaaaagggaagtcatacttcttggctaaaggaatggtacaaaatagaggcctctaacttgacatgacagaaagtatgatgggattttcaaggcatcccaaggcatcccaggggagctttagacgtagcttcctatcttataagcagtcctttttctcactgcctgcctctgctggccaccaattctatatatgaacaccatgaagaaacataatgagggcacatgtaaaatctgctccactcacagatattctctatccagggtgcaagctttgctagaggccgtctctctctaaatcctttttcttcttttcttcctccactcttactgcattctttacacatctaagtttaaattccataaagcaaagagtcttgcaattctctgccattgtcacttccataagatgtaaaattgtatattttagcccagcaagtacccagtagtcaagtagatgtgtttaatttttacattaaagtgtaaacaataggaaaaagacgatttgacctagtcaaagttgtggttgaaaggctctctatctaccatgcctcttgcatcacagtgacttaaagtgcttttctagatggcctctaggcatcacaactgcatgctgttaaattcagccaccaccagcacacacatactcttcatacacgtacaaactcattgagaacagaaaatgcaacagtgatttaaagccctatgttatctaaaaagcttcatggtctttaatcttttaaatgttttctacttgatcatggaataaaatgaactgacagtttatctctttcttctctctaccttttgctggagatttaaatatatatacatatatatattgtacatgtatatatataacaaaagaagggaaagtaataaaatcaaagatcctagaaatattccataccagataacaagctctgttgttatcagtttgtttattttattattcttataagtttgagactctgggtaatcagttttcttgattttaaaactaaatataccaatgcctccagtagtacactggatattcttaaataccgtctatgccttttcaaagtatatagtctaaaattgatgtgaataatgaacagatggactaatatgtgcgttacacaactaagattaaaaagtaacagccagtctcacaattgtttcttctgtccaatataaatgctacaagattatagacatgtaccttaggtaaatgtattttataatagggatgaaaaggactgcaaatctttaagtcaaagttagttgctttttgtttctttgtttacctttaatcctttcatggctgttacctgatgagtaagccaggaagctagagatatacaagatatataaatattaatgttataaattgggataaagaccaaaataattgctccagtagattctgtggtttttatacttgctctgtattttagcaattgtaagaaacgatctccttacaaggtgccagaatcatgtcactttattgtacataaatatcagatcacattgctcagattttttccaaacttcagaaaaattttgaaaaaaataatatgacatacactttaaattttattttattactgtggccatcaattatgtgcttcttatatcccaattataaggaactctagaagaggtcatagcgatgaagtgcctggcatatagtaaatacacaaatacttgttagaggaatcaatgactctaaccattggttattttcctaatacagtaaattagtgataatctccagtttcattattcttcctcttttaaaaatattcctttgtatacctaaatgtaccatccctatttgaattactgcccgcttccctcactttgaaaatccatacatctactacatatttttctatttgtggttatctgaactcagacttaacctgaagcagatccatttctgtccccatatcatgcctaaatttacttcttgagattactatgccctattatagacagactttcactcagggacaaagaggagaattactggtgaagagaagctttaaaaataggggctatttttcttagataacaaggattctggagacaagagctactattattggtgtgaaggctcaatgacatcagggtgtacacctctgcaagtctctcggcccttttactctcagctaaaatgtggctactatggctctcagcttgttcaagtcaggaaaaggagtgaagtggctcatttttcttcaataaagaaagcagaagctcttccagaaaaaccataacacacttttgtttatacctaattggcttgaactttgttacatggcaaaccatgatgaaagggaagcagggacaagggtgctggagataggtcagccctatcactcctgtctcattttagctcagcttagaaacctgtcctggctgataatattttcgtcatctgtgtagtccaaacttgcagtgagagcctgcttgtcttttcctcaaatgtgcttttatgaagaccaatgaaaggcttcaccgaagcctccgtgtatagattaccccatctgagattataaagaagcaatcacaagtggttgaggcaaatttaagctccatacaggataagtacatatcttaaaacatttgggggttttgacataaatcttgactcattatctcaataccatttaggtccatgctattctaactgtggtctttactatacatgtatttatagtacacattctaaatgtttattttcaatttatatacttatcatggaccattaacaaagagttggcaaaccagagccagtttgccaaccatatatcatatgaaataaatatgcttatagtctgatatttttgttcttcactgacatgtggtaaacatctctctgcatttcttgtttcttttgtttgtcattttgatgataaaatgcataattcttggtataccatttaaataaaattttattataattattggatattaaaactcaccaaggattatttttgtcatataaatgtaaagttagttgaaagcttttcaagctttattagtaatactaacagccactcatcccaactatagtgtctctataattgccaatttttactagtttacttttaatgtaattgggttagctaggctcactcataaaatattaatgtttacactgatttgttttgctttaaatgacagcaaaaaaaagacatttcttttgtcaccccacaacattctcagggagaactgtggtacgttatgaggctaactattgcttgaatattacctgtgcattacttaagggggaatctgcaaacagtttcagggccaaaaacaaaaggtcataatttgataaaaatcttattgcctgatagctcgcagacatctgtcagcagttttggtttcttttaaagggcagcacatggctgactgatctcatagtaggatttataagtataattattgccatataattcaacaaatcacttttatcactgaaaacttaaagctttccaatttttgctttttagccatttaaattttagggaaatagtcttctgtccaataaattttaatttcaaaataaagtcttcactaaaatttaagtagtttaatgacaaaatagaaatgaaaattttgtctttaaaaattttttttttgcttttgcatttagaatattctatggatataaaaatatagcagctgggccttttaggattacattgattattaatctcaataatcagttgtccttattaacattcataattaacatgcatagcttattgacaaaggtaatttgcttgcatgaaaaaaataggcttatttgcagaggctgaaaaatgctttgaaaagtgctcgttctagaggctcactgctttctaagcacactccactgtaatctaacatagacaattcaagaaaataacctttctgagcttgggtctacctatctcataaggttattatatgcataaaatgagacattttatgtaaatcagtgaacacaattcctaccacataatatgcacctgataatttatggttattgtacagaagcttatttcttagttactgggtagaagcagtttgtgtttggaaatgagaatactaatttggaccaaaataagaaacagaataaaataaattcgcataaatagatatacctgtcttaaatgtccctgaaagaattcctatgtgataaaaaaaaaagtctacagaatgatgatgagataaactgcacatcaagaaaactagagaaattacaaagaggtatttttttaaacattaaacagttacataaatgtattttttaaatttcgaagaatggacaactgtacataaactggagtgatgtgagaaggtgtcacagagcaagcaaaacttgcaggccagacagagacagaattattggagacctgtccaagtgtgcctgcgtagtctgtgacaaaggggcaaaggctaaatggaacagatgtatggtcatgtggagaccagagagcagagggacctgaccactatatccaaagcagccccacaatacacacccaacaagatatgcccttttagcctttcatcctgtttgtttcctttatatcatgtttcacaatccatactcatcttgtttttctattcctttaactgttagcaacctatctcccccactataatgtaagttctgttagggcagagtccttgtttgtcttctacagcactctgttcataaatacccagcactgtaccaggcataaaataatgttcaaaaaataaaagttgaattgataacaaagaatatgagctgaaaattaaatgattctttcaacaagcattactggataaactggggaattatattgtcaagtattaaaagaattccctgacaccttcaccctaccacattgtcttccaccacagaactgtgttgaataagctccccactgccacaggaggagtctcatagctcacagtgaagctggagtataaagcataagattgtcacctctgaagttaaaatgcatggtccaggtatatgaaggaaagatttatgagaatctaattactctgagtttttccttcttctaagcaaataaagactccatgggcaggggcaggagagaggggaagatgaaagtcattggggcttgagaagaatgaggagtgaagatgatgaaattatttagtaaaatgtaggaaaaattgtacgtccagagaattagaagagttacagatgaatctgtagaatctggatgaataaccatggctgagaaccatacagcttccccctccttccactgaaataacatgacataagtgttctggagcatacatgtcactccaaagagaaggaatagatggaggtaatgaatactaacctgactaagtacactacaaattgtcaaaattcctctcctatgggataaaaaagagctcaatacagaaacatgcaatatgcaagtagttgtttttttgtttttttgttttttttttgaaatggagtctcactctgtcacccaggctggagtgcaatggcacgatctcagctcactgcaacctctgccccctgtgttcaagcaattgtcctgcctcagcctcccaagtagctgggactacaggcctgtgccaccatgcgaggctaatttctgtattttgttttagtagagacagggttttgccattttggccaggctggtcttgaaatccttaccttaggtgatccacccaccttggcctcccaaagtgctgggattacaggcatgagccactgcacctggctgcaagtagtttcaacaggagggataaatagaagctttcaaagtttacacttgaggaaccactatggtaggacactatatgggcgtactctcatttgcaaaaatagttatacgttaagtgtaagtacatacaccaatatatatccccacacacacacacacacaaagttccggtatattcctgttttaatccatagtaatctcttgtttcaaatacttctcaattattctttcacttttgtctaggtgcttcataggtgagaggtactatgctatgtgttacctagcaatattttatatgggcaagttgatgtaaatcaattcaaaaagggaaagtaaaatcttggcaaacaaatgttttccttagctatgattattaaatctaagtactcattcatctacccattaattcattcaaaaagaattgtcccttttatcagaaagcaagagtttttctacattttattagcaattaaactaacatcttactggcccatatgaacaatatcatctcccctagcttgaacggaagctgagaaacaggctttttcatccactgtagcagaagacagcaaggaagaaaaagtctgggaattagtcatgtaaacaataatgtctgccataacaaacctcaggttaagacaaatccgcctaaccaaatcttggctatctaagctgtccagtttttcaggttactcttataactccatatcgcttaacctttttttttttctggtcggaggaaaggatgaaatgaggaagaaaaaaaaatgtaaacaaaatgaaataggctccaaactttcggacaaagtagtactttgagctattctctctagccatacctcttctcctttaatatcaaaatgcactactatttaagcgatttttgtattggatggaccttgagaacatatgactttaaatgctgacggtttattgcagcagttccatccagaaccataagaagcccaagttatgagaaactgggatagataggtcagagtgtctgcccctcctctgcccatatcatccctttctttgcatatccacttctccctggatacccacatctcatgtagctcaatctctcacttgaccatgtgagattcatttgccaaggctagaatgaaagtctacaaaggaaattcaaaaggcattgccaataaaggactagttaggccattaagtatatttgaaagtgtaatgaggatctaaagggaaattttgtcttattgcatacagtctctcaaagatgttgtatatacattccacacatttataaagcaagtaccatttgccaagcactgtattacaaagtatgtgtcacctgcacttaatctttgtttatgcacaatcatagtgcagtgtctgaaaattacatttagatctgattcttcaaaccataaattaaaataattgaaattccatagtttagaataaaagggacttattaaactaaatatctggatctatttctctgtatttcaaaaccaaacattctttggtacctaatccacatagagtatttcttcatatccataaaaatgcaaactctttgcaaatgcaattgctcagtcttcagaggtgagatatctttacttctaagtctcttcctatccttatatttacctgctgtggttctgaatactaattttaggaattcttttgatattacactgaactgctatttttcaaatttgaaaatctctgttactgcaattacttccacacttcttaagcaacacatctattttttaactcatcctttactcatagcagtcatcaactaatttgatgataatcacttactgattcaagtgtggggtcctgcatccctttctgtgcttcatttatagcaaggtgtgtcagtctgggtgtgatttaggaggaaacaggtaacattttatacatagcaacatctcttgtccaggaaagacctcaactctttacaaaggaatcgtggtctttttaccttttagttgggtgaatgttcactttcagaactaacaaatccatttgtataagtatgttgtattgcatagatttgtgcagtacttctcaaaatgattgtgagactcctgtaagcttttggcgaatgacagactcacaacatctgatgttaaattaacatcataaagcagaatttgcatctggccaccaggcctttagtcatcaaactagcaaatggaactaatgtggaataataatgagagagctggcttttgagaacagaagactaaaggggaattttaggaaacatgcagttcacattaaaaaaaaaatcaccaaagctattaaacactgaatgcatcttatttttcatgtcagctaggtttatcattgtctctgccaggacattcatgatttttctgctgcaagtaatgttgagaagtttttgataaccattttaaatgccagtcaggtaaacagtcttcttttctctggacaaagctctatgtacctgtgcattttgcatattttaaaataagggcttgaattgggagaatttttcaagactacagtgaaatgtgatcctaggagactatcaccaaagcagcaaatgctaaacatgatttttttttgtattgaatgcataaacacctttttttttgcatttttctccatgatattttgatagaactattgaaaatactctagggaagagaaaagtttttaagaggtgcttttaaaaaatcaacttaattatatagttaagtcctttatttgtaaattaatttatgtaattcaagtagatatatgtgcttctttaccaaaaactgagctcctatagattatattttgcatcatcaaaattatcaacaatcccctttaacaactagtaaatgccacctgaaattttccgaaattgggatcatacagttggaaaaaaattgaatgaataaaaattttaattgactgaaccagtctccagaatgaacatcctactctgaaattatcttccagtttcctgttttgcactatcaaactctgtcttatctctttcctttttctctttttaccttgatgcatgcatatagacatatgtagccacacacctgtcactctctacacagtcatactacaatgttactagaatatgctccacgtctttcgtctgtgtctgcctcaatactggtaatctctcccctcctcctggcattactcttggagtgaaaggtagttgactaagattaaaagggaatatgagtgggacctttacaagcttcctctcctccctacttgccagattgtgttgtttgctttggaatttatataggagaaataatttgaaaatttttgagcagtgcacttcaattttcttcttcatatatgcccccaaattttgaaaacgaatatataccctcatataaaattgatagctcaaattatttttataaatttaaatggctacaaagactattatatacccttgtatacaattgatagctcaaattatttttacaaatttaaatgactacaaaggctattatctccagcctgttgtatatgatatatcatcacagatcaaatctttatgtctgcctcaaattcatatgttgatgtcctacccccaaatgtgatggttttcagatgtgcggccttaggtttagatgccattatgagagtgggggccccatgatggcatcaatgtccttataagaagagaaagagcctggagctccctcttcaccttgagaggacacagaaagaaggtggccttctgcaaaccaggaaggcgccctcaccagatctcatgatagcaccctgttcttggacttccagcctccagaactgtgagaaataaactgttgttgtttatcagctaattggcgtatggtactttgttacagcagcctgagctaagatagaaaagtgctgtaaatacatatttgtcaaaagcttgtagcgacaggtttagattattcaatttatagtaaatggtaaaaagccagtcctcattatcaaaccagtctgccaaatcaggcttactatgggtcagaaaagcctacctcaattatccattcttcttctgaattctagatagaatcacagaatgacagaattgtagaagaggagaatgatcaatcaatagatggacagataggacagagaccacctagcagaagcaggggtccttcactgagatatttttgatttagtgagaaaaaaggcacagccactttcaataatgcttatcagaactctctttggttcccttgctagactcttccagtgggagctatgcattttcaaattgccccttcgttggtataccaactaatgttataccttgagcagtaatttgctcctctttagtaaggtaggaaaagtgtgatgatgaaaacagaagttagaaaggaaaaaccagggccgggcatggtggctcactcctgtaatcccagcactttgggagaccaaggtgggcagattacttgaggtcaggagttccagaccagcttgaccaatgtagggaaagcccatctccactaaaaatacaaaaaattagccaggtgtggtagtgcatgcccctaatcacagctaggtgggaggctgagagaggagaattgattgaacttgggaggcgaaggttgcagtgatccaagatcatgccattgcactctagcctgggcaacagagtgagactctgtctcaaaaaaaaaaaaagaaaaaaaaaaaaaaaggaaaaaccaggatgctgtgaaccaatcataaaaaagagttcacatagaatttgaggttctagaaaacgatttccgtatagttatgtgtccatgtacttataagaatttatttgtgatcccaagggaacacgtacaatttgaagatccttgcttaaaatggttttaatatgcaaattcctgagcttcatttccattagtttcttattcaagcagtctgaatgaatcattggacattactttgggaaaaaaaaaacaggactaggacaaaagaatggattagtaaggaagtaaataaatattgctctaagagaagctaaagagtttaccacaaaggttgaaaactctgtgaagacatgcaagtttatgattcctttctaggtagaagtttatgacaatttgaacaaaaattagagggcttcaagaaacgaagcattctacctttccagtgatggtgttcatattagtgacaagttcagaatatattaaggaaggcacgcaaatgattgatatagaacagtgtagtcattttctccttcactgctcatctttccttaatgtttcttttttcctgatgccttaagaaaatagtgcctgtgtgaaataattaatgaataatgttaaatttgttaccgagtaactttacaatcctggtgaaactctttattttctatttcttagaaaaaaatggagatttgtttcttctatgaaagattggttctgctgtctcaggagcaaaattgaggagaaaataatattttgttcacagagtttatttagctgtgtttagctatgcttttgtaatgtattctttcaaaagctgttttcttttctctttgtcatatactatagtttgttctgtttattgcacttagtagtattgtatattcctttattttttttgtacttttccaaagagacagttctaatattttatggcatttgggatggttttgtttttcttaagtgtctttcatacactgtatcttctggttaacagagacccatgggtaagcaaaatactctgtttacaaaattgtgcccatatatgattattactctcttgctgtaatgcattgtaaaaaataagtaatgagactgcaataagcttctgtcttacatcaagttcccctagaacagcttgagattttgcaatggggatttgtatgcaagagagagcttttaagagaaacccaaatggaatgagagaagcagatcagggaagggacagaagccaagtgacgatgaagttttagctcaagtctgttgtcagcctggtcctacaaggacctctgctacatgatcagtactatagagttgtcccatctagaggcaaagcgaccaagctttgtatccccatatcagtcggctactggctgttaaggccactggtatagagggtgaggcataatttctcagacatttccaagcaaaatggattttatcaaaaggtaattttaaaaaatacatctatgagcaattagcagccaacacttccagtagctggtggatgggtgctgtcctgaccagagaaagggaactgggaggagctctggtcgcctctactagaactgctgcaccaagatactcatccaattaaaattttaagagcttttgctaaaattcattaacatctaattcaaagagatcttttatgtgtgtgtgtgtgtgtgtgtgtgtgtgtatgagagagagagagagagagagagagagagagagagaagggggtagagctcaaagctatgtctgccaagattttaggcagaatggttcagttaaataaaaggtcctggcagtaataaatctgtgtgatttatttgctgtgtaaccttgagtagttacttaacttttctgaatccagttcatcatctctgcaacgtctgtcatgggtagctacctgaggattattgtgaaaaaaatgtgtgtcaagttgctgacaaaagggagatactcactaaatgatggttcctattttatattcagtacaggttattgtcctccatttcatgacctcagacacttgctttgaaaacaaaacaaagaataaaaccaagtgagaaaatgtggctatattggtgcaaatgttctctctactgcaaaaacaaaacaaaacattcaacactaagtatcatctctgtgtaaaaaagtagatcatttagtttaatttctttaatgataaaattctcagacactaccaacgttaaagcaatgcaccattcagatgcacctttgcaccagaaaaaattggttggcattctttagagatgtttaaagagaattactctttatataatactcaactattatagtcagaaaatgctaaacatgacttggacaagcaagacattatttaagactgtaactgactcattctaaagcaatgcattatatgaccagtaggctcaaatagttggcgagttgtcatggggcttttgctttttctagcaatacatgaaatggcaatacatgaaaattcacttcagtcttgattaaagacaaaatatgccctggatctccaaaatctactataggcaaacctgtctacctagatcataatagtcatgaagtatatgcactaatacacatatgtgtactcatagactgtatcctcttcctcatacttgctcagaaacactatacttttactttacaaactattctagtttgtatgtttggtatctgaaattacaggaaaactggaagcaggaaaatgagatagaagaatggtacacacagtaaaacttcacattgtcaaattgacatctaacagcccagagcaataattcttcaaatttgtgtctgttttactagcataagacatatttgtgcacattattgcattagatctttataacacaatagaggtttgctagtcaaataaatattctcattttacatgtgaagaatgactcaggatgtttctgacactttcaaagtcacaacattaataaaatggcaaaaagggatgtcagatgcatatagtagatcacaaaatttgcatccttatcatattgttagattttaagaaaggaggatttttcctgataactcagaaagccctgtttctgaaaccatttggtaaagggaaaaattctgcacatttactactacgactggaatatgtaaccatatcttttagttaatacacatttattacacagcatccatatgtggtagccattgtgttaaactctggggatttggggatgaataagtaaaacatagcgtggccctcataaaacttatagtgtaatgcaataggcagataacagtagatacaaaaataattataatacattttgaattacatgaatgaaagaaaataaccagcagaagctacagggatggcctcttgagaaagtgctatttaatatgaaacctaaaataaaaggaatagtctgccaggaaaacaaataacacttccaggcacaaggaatgatgtgtataaaagccctaagggtggaaaattctttgcaagttctaggaagagttaaaaatgtaggaaaaggcagagtgaccaggggaagatactgagttcaaacacacacagatagatgagagatgatagatagatagatagatagatagatagatatttgagagatatatagacttgacatatttcaagcacagaatgttattattcaattcacattttacaaagattactctaacaactctaggaaaagaattacagggggttagcattagatatgaggagaccactgatggggctgtaatagaagtgcaagattgaactagaaacagtggtggaggtggagataagtgatatattagaacaaactttgcgcataaaactgaaagggcatggtgatggattagagatgggagtgcagaggtgagtaaggcaagtgacttgacccccttggctttctggcttgatccagtgactaaatagtgtctgaggtcattactgagatgaagaagactgggcaaaagtagaaaacagaatcaggagggaaatcagcagttcatgttgacacttggcaagtctgagattcctatgagaatcagatgaaattcaagtaaaaaaaactagctatggaagtctagattctgacggggaatttcaagctggagttatgaatttgaagtcaccaacattatgattttatttaaagtcaaataaacaactgctatcttccaggatcacagagagagtgatattagtaaaaatgcccaggactgagccagaggaacaccagtacctagtggtctttctactatatcacagtacttccttagaaaaatgttcaaaataagtgtaaaaagttaccagaaccagaatcgcccatatttaataataatgaaaatttcaggcccttaaagaaatattttcactatgttttcttaatcccgtgttgaatgtcataaccatcagtattgtatgcctcgggaaggtggagatataggacagaaggaagaaaccatgccagagagacagaaatcaacatgccatttcaatctttcccctttgttctttgaacttctctaccgttttctccctgtggagccttggcatcttaagatcttgattatcagaacttaagcatgaaagaatttcttgtcttgatgccttatctcttctgcatccagaggaacttcatgatgtttagataccacttaacaaatacgaaaacagaaaaactaccctaagatagtagacacagaggccatccgtattgactgtttaatagttcagggattgcacaataaaggcaactatcattgctaaattcagaatggaagaatggtaaatatcacttagtcccagaatattctcctaattccaactgaaatatacactacaaaccaagaaaaatgcagaaggtgctcagaaactgcaaagaaaataattggaaaagaaagagtgaaacacaaagagtgaaaccagtctatatgcctgttacattatttgtggttgaattttaaaacatgcatcatatacaaactaggaaaatttcttaatttaattggatttaacatttaagtatcaaaagcagaatactaatttagctgagctaagaataatgtagggaaaacctgaaggatagtataatgcactgaatcatatagcacaatataatccatcaaaaccacagagcctacaattttctcgctttatattcggttgaaaaatgacttcagagtatgtgcttataagaataactgatgagaaatctaagtggagggaagaccacttgatgccagcttcttatgataatgtataaatctaacagccataattaataatagttaaaggcttaaatggccctgggatattcagttaacagaagacaggtacacctgccaatatgaagctttgaaacttgcttagagaaagttagggcaattaacctgactatattccactcagttttgagtaaaaatgaatgttatgaaaataatgtaggtcagatattgacttgcaatattatttagagttctgatacaatatatcttaaacactgttcagtcattttgaaatctgtgaataaatctcaacatgtaatttatacagacaaaataaataagaaaaatgcttactgagtttatattcccattttggcgttaatatcatttttaaaggctgttagctttatttggaagtcagagaatttctgaattaataaagttcacattaaaataaaacatcattgttttggacatagtctacaatatgaatggactatgtataatggactatgtataatggactatgaatggaccatacatactgtatggactacagtatgaatggactataaataaatctccatagtgaaaattctcaaatctcctacacatttactgaaaaattaaaatatcattgtcattgcaaataaaatattattggcattattaataaaactgttttgggtactctatacaacttcttttagaggtattttctcagatttttgtttcatcagagttctacttctgttatttacattttggtacttttcattgtaatgtatgtgatagctatgtgtggtaacatcagtttacattataatcacctgtgttttttatatgtgtttttccactgaattaacctattaataaagtgaatattaaacacccagatttctaaaatatatatatattatgaaataaatattatcatatcgattctcactctttttatcagtaaaaggtaatatttaggcccaatttgctattgactttttacctggccattgggtgaaaatggcccaaggtttttgtaatcaatgactccacaaataaatcgtgtataatcttatagataacttgttttcactttatttcaaacatggtagcagaattgacctcttttattgtgtaatttttatttttatttcaatagtttttggggtatagctggtatttggttacatggataagttcttcctagtgatgatttctgagattttggtgcaccgtcacctgagcagtgtaccctggaccctatatgtagtcttttatccctcacctctctcctacccttcccccacccactgagtcctcaaagtacattatatcattcttaggcctttgcatactcatagtttagctttcacttacaagtgagattatacaaaatttggtttttccattcctgagttagttacttcacttagaataatggcctccagctccatccaagtttctgcaaaaagatattatttcattctttttttggttgagtagtattcttggtgtaaatataccacatttgttcattaatttgttggttggtagacacttaggttggttccatatctgaaattgtgaactgtgctgctataaacatgtgtgtccacgtatctttttcatataatgacttcttttcctttgggtagataccgagtagtgcaattgctggatcgaatggtagttatacttttagttctttaaggaggctctatactgttttccataatggttaactagtttacattcccaccagcaacactgctggtggcagtgttccatttttaccatattcatgccaacatctattttttttattcttaattatggccattcttgcaggagtaatgtggtgccttattatggttttaatttgcatttccctgataattagggatattgagcattttttcatatgtttgttggccatttgtatatcttcttttgagaactctctattcatgtctttgtccactttttgatgggattacttgtttttgtcttgctgatttgttgagttccttgtagattctggatagtggccctttgtcagatgtgtagtttgtgaatattttcttccactctctcagctgcctgtttattctgatgattgtttcttttgctgtgcggaggctttttcatttaattaggttccatttatttatttttgtttttgttgcatttgcttttgtggtctgaagtcatgaattatttgcctaagccaatgtctagaagagtttttccgatgttaacttctagaagttttatggtttcaggttttagatttaagtctttgatccttcttgagttgatttttgtataaggtgagagatgaggatccagtttcattcttccacatgtgtttgtcagttttcccagcaccatttattgaacagggtgtcctttccccaatttgtgtttttgtttgctttgtcgaagatcagttggctataagtatttggcttatttctgggttctctattctgttccctgggtctacatgcctatttttataccagtatcatgctatttgataattattgccttgtagtataatttgaagtcgggtaatgtgatgcctctagatttgttctttttgcttagtattgttttggctatgtgggctacttttggctccatatgaattttaggattgtttattctagttctgtgaagaatgatgatggtgttttaatgagaattacattgaatctgtagattgctttaggcagtatggtcattttcacaatattgtatcttcccatccatgaacatggaatgtgtttctatttgtttgtatcatctatgatttctttgagtagcgttttgtaattttccttgtacagatctttcacctccttggttaagtatattccaaagtatttgaattgttttgcagctgttgtaaaagggattaagttcttgatttgggtcgcagcttggtcatttttggtgtacagcagtgctactgatttgtgtacactgattttgtatcctgagactttacagaattcgctgatcagatctaggaactttttggatgagtttttagggtttgctaggtaaacgatcatatcattagcaaacagcaacagtttgtcttcctctcttccaatttggatgccctttatttctctcttctcttgtctgattgcctagccaggacctccagtactatgttaaatagaagtggtgtcttgttccagttcttgggggaaatgtttttaacttttccccattcagtgtgatgttggctatgggtttgtcatagatggcttttattactcgaaggtaagtctgttctatgccaatgtcgttgagggttttgatcataaagggatgctagattcaatcaactacttttttacatctattgaaatgatcatatgatttttgtttttaattctgttcatgtgatgtatcacatttattgatttgcatatgttaaaccacccctgcatccctgatatgagacccacttgatcataatggattatctttttgatatgctgttggatttggttagctagtattttgttgaggacttttgcatctatgttcatcagggatattggtctgtagtttccttttttcataacgttacaaagagggggaggtgagaggattgcttgagcccaggaggcagaggttgcagtgtgctgagattgcaccacttcactcctgcctgggagatagagcaagatccccatctcaaacaaacaaacaagatctcataaaatataagtttataaaaattgtaatctgataaaaattcaaagtttataaattcgaggtttttgagaaaacaattaattttaatgtttgtgaaacaaatatagaacatggatacacagacaatattacttaacaccaaaggcctgtctcctttttccccagcccattagcttttgattcaagaaaataaatcaagtttaacatatttgataaataataattaccacacatgggaagacattgtctgagacacagagtaattgtaaagagagttgcttcttccggccaattaacaggtgatccactggatcagctcagcttttgtgtttgcccagatactaggaaaaacttctggaaaagtggtgtcaatatcaaagggacacagactggtattgttttgtggatcaattagcaaaaataactgtaaatgtctctttttctaaagacggagccaaatttgtctacagggccacaattaagtagcataaattcttacttcagagttggtgcttcaccatcaaggtatcaataaaatccaaaatagagattcctgactaaacactttcgattagtttcttaaaatctagctgctaagtgaaaatatttaaataataaacattttaatttacttgtaataggggaaattaagatatatcccatttcagctagctagttttcctgcccttgaatacatgagagatacctgcaaactctaagctttcatatgaatgaattcaggcctcattaatgcacagtacatgacaagatagacctacatgtggtttgcatttgtatttatgaagatagccattggaaagaataagtagccatataaggaggatgttaaaagttcctacaaagaacaaacatttcatatatttaaatgcatcaattttcatacatttaactggtgtgctactgaggtcatatgctagttaggtcacttcagcatgtcctctacaatgcctgatatgggatagactacattttattggcataacaccaaccaaaattctggaatagattatatgatattctctggaaataatcttttggatcaaattaattaatgagtatgctattgcctgagctgcaatgtcaaaaatcacatttctttcttttcttttcttttcttttcctttccttttatttatttatttttattttttagacagggtcttgctctgttgctcaggccaaagtgcagtggcacaatcacaactcactgcagcctcaacttcccaggctcaagtgatcctcccacctcagcctccagagtagctgggactacaggcatacaccaccatgcctggctaatatttgtaattttgtgtagaaatggggttttgccacattgcccaggctggtcacaaacttctgggcttgagtaatctccctgctgggcctgccaaagtgctgggattacaggtttaagctaccatgctcagccaaaaatcacatttcttataacacgtttatttactttggatgtgggagacgttacaccaacaaagtcagtcatttagaaagaaagagtttaacttgaaaatttttttacaacctaaatacattaaattgatggctgccttatgatatgtctgtatttaaattgatgacaaaagtatttacagaaagaaaagagggataaggaaagatatttgagcaacatgggagggttgctgatggactttgaaggacataaatgactaatatttaatctcagtctgtctgtgttcctagaatatgaaaaccttcagtaaggtaaggtatattaatactaggaaaggccttggatgagtatttaatgaaaattatagagaagggataaattctgactatggtcaccatcggggcagaggtaaattatcctcaagaaagaaagattgaagccccaaaatccatagaggtagggagtaggagtcagaagtgatcacgaagccacatgcactggcaggagtttgaagcagttttaagaaggaagttgcacttcccataaaatatgaaagttgggtttgagctaatctgatctacatctttaagggccaagagacagagaattgaatctaagatacacaaataaatggccaaagcatcagtctccaaacaaacgtattcaaatagaaaaacaaaggaaataaatactctattttgaattttctattagtgccaccagagaaagcatcacagatgttttccggctatctcctaagctgttaaagaatatgattctgtgaaacagacctgagagaattgccttctcttttggtacaaaaaaaatctaaagtttcattttctgaaatctctcacgaggtgaagtcagtgtagaataccaaaacaggttttaaattctggaaacctaaattattctcttttatgttgtcagcaaaggtgctttattcacactaaatgaaaaatacagtcttcatttttctatatctgtgagagatttataattgaaaataaagataattatatcatgataaatataattggatgatgtccaatttaaacataaacttccatattactttcaataatgtgttttattttattttctggttctggtatatttctaagttctttaaagcatttaagttgaaggggggaaatggcagataggaggcaggactaactttcagctcccactccagtggatagagcagcatgtggagactcaaatcgtgaattttggctccaagaactaccacaggaacataccagaaagccgagagaatccacagaccctttgaaggaagcagagctgctgcaggccctgggagacagccaaaaaactgtgactgtccaaagtatgaaagggggatcatcggcctgaacacacatcctcacatcctcactggggaacctcaagttccagatcaggggataaggatttgaccttacctggagctgagacaaatttagagagctgagtaaaatatgggaatagaagaagcagtgggaagagccctgtggacactcgcggtccccagggaagccatttctgactttgtctcccaggggtccttggggagggctaccagaggaactggaaaaagaccacaggaagaaggaaatttccagctgaacttcgtaacaatttcaaccaaagtttcctggacggaacctggagaagggggcgaatcaggggtgcagacaagcacagaagctgtggcaggtggggaagctcaaaacctgaaagccctgcttactttcacagccgggaggctggttgttggagcaagttctcagctctgcctacccactgcctggaaacaaactcagtaccgttgtgggggcacagtgggagtgagaccagccttttgggctgcataggagctgatgaggcctgtaactgccagctttcccccacttccctggtgacttgcatgatgcatcagaggcagccataatccctctgggaacatgactgctttggcctgaaaaccacacccccacccccacagcagctgcagaaagccctgcccaaggagagcctgagctcagacatgcctaaccctgccctcacctgatggtctttctgtacctgccctggtagccaaagtcaaaggacataatcttttgggagctctatggccctgcccaccacctgatcctccctatactactgcagctgatgctgtcttgaaagcaccaccttctggctgaaagccaaccaacacaaaactagcacaataaacacaactacaaccaaggaccctcagagtccacttcattcccctgccacctctactagagcaggtgctggtatccatggctgggagacctgaagacagttcacatcacaggactctgtgcagacactaccctgtatgagcccagagactggtagttccactggatggctagatccagaagataaataacaatcactgcagtttggctctcagaaagccccatccctaggaaagggagaaagcaccacatcaagggagcaccctcttggacaaaagaatctgaacagtagccttcagatccagatcttccctctgacataatctacccaaatgagaatgaaccagaaaaacaattctggtaatatgacaaaacaaggttctttaatgcccccctccccaaaagatcacaccagctcaccagtaatggatcgaaaccaagaagaaatctctgaattaccagaaaaagatttcagaaaatcgattattaagctaatccaaaaggcactagaggaaggtgaagtccaaattaatgaaatcaaaaaataaaaaataaatcagctgggcacagtggctcatgcctgcaatcccagcactttgggaggctgaggcaggtggatcacttgagaccaggagtttgagaccagcatggccaacatggtgaaaccccgtctctactaaaaatacaaaaattagctgagcatgttggcaggcatctataatcccagctactcaagaggctgggagaattgcttgaacctgggaggtggaggttgcagtgagccaagatcacgccactgcactccagcctgggcaacagagcgagactctgccaaaaaaaaagaaagaagaagaagctatatcaaaaaaatgatacaacatatgaagggaaaaatcttcagtgaaatagcataaataaaaaacaatcacaactcctggaaatgagggacacacttagagaaatgcaaaacatttaagttgataatgtattttacttttgatgccttgttgtttttattactgtaggagttaaaaatcataagatcctgaaaaacataataatttcatatgttcaattttatatttgtgacttcatatattgaataatttttactcaaagaaatataactttaaactacacagtcagtattatacaaaagcattggtcacacatcagcttgagtatataaaaaattttgaagcacatctcacctaaagatatttatgctttagttgaggatataaaacccataaataaaaataaacaaaaataatacatcaaaatatgctaaattaggctatatatgtcatcaatttgagggtatattgaaagatttcttattgatccataatatacctatttatggaatacatgtgatattttgatacatgcatataatgtgtagtaatcaaatcagagtaattgcagtatccattacctcaaatgcttatttttgtgtgtgttgggaacattctacatctcctcttttagctattttgaaatgtacaacaaattattgataactggccgggcgcagtggctgacacctgtagtcccacactttgagaggccgaggtgggcagattacgaggtcaggagatccagaacaccctgaccaacatggtgaaaccccgtctctactaaaaatacaaaaaaaaatagctaggtgtggtggcatacgcctgtagtcccacataatcaggaggctgaggcaggagaatcgcttgaacccaggaggcggagtttgcagtgagccgagattgcaccactacagagtgacactctgtctcaaaaaatatatatatattgatatctattgaacttacaactaatttctcccctctagctgtatttttgtacccattaaccaacttctccttatctctttctcccactctttctcccagctttctggtaaccatcattctcccctctaccttcatgagattaacgtttttagctgccacatatgagtgagaacatgtaatatttgtctttctgtgtgtagtttatttcacttaagataatgtcctccaggctcatccatgttgctgcaaatgacaggatgtccttcttttttatgggtgaataatattccattgtgtatacatgccacattatctgttcatctgttgatggacacttaagctgattccatatcttagctatagtgaataatgctgcagtaaacatgggagtacagtcgtctcttcaatatacatatttcccttattttggacatatacccagcagtgagattgcaggatcacatggtagttctatttttagttttttgtggaacctccatactgtcttccataatggctgtactaagttacattcctaccaaaggtgtatgagagttcctatttctctgcattctcatcagcatttgttattttttgcttttttataatatccatcctattataatatcacccaactgggatgagataatatctcattgtagttttgatttgcattttttgatggttagtgatgttgaacattttttcatatacaatattgagagattgatgtaaaaaattaatcttagaaaatgtataaagatctaagtcagaaaaaccattgccagaggtttgatctcaacctcattaaagttgatcctaatataatagaaaatcagactattaaagaggtagtttctttagaattgccagaacatttaatccttcactgagagcattctgcttcttggacctattgtgtagtgtgatgcacctccaggctaaaatattaccttcaaatcagaattttataaggggtaccattcttctattcctgcttgccctgggtgccagaatgctgattctcaacatcaggtagggtccacccagttcaggtgctttttcttcaacaattcttaaccagattagtttatgtggaacttaccaaagcagcaaaagattcatgactgtttatccccttcctttcctgttcctctcctcatcatattacatcttccaccaataaaattgataatttacttgattatgtgctcagtaaagatataccacaatttctaattccaaagtttcagtttttgctcattaagcagtggatcctgtttctatgctagcagtgctgatctatcttctcaaatatcaggccccaaaaggtggccttattttcattgatttctcatgcttatttcttattattatttctcatgcttagcttttctttattttgatggttaatattacgtgtcagcttgattgcatggaaggatgcctagatagctggtaaagtattgtttctgggtgtgtctgtgagggtgtttccaaaggagattaacatttgagtcaggggattgggagaagaagatccaccctcaagtgtgtgggtaccatccaatcagttgccagcgagactagaacaaagcagagaagaaggtatgacaagctggcttgccaagtcttctggcttccatctttctcctgtcctggatgcttcctgcccttggacatcagactctaggttcttcaacctttagactcttggacttacactagtggtttgccagaggctctcaggccttcggccacacacggaagtctgcactgtcagcttccctacttttgaggtttttggactcagactgagccactactggcttcctacctcctcagtttgcagactgcttattgtgggactttgccttctgatcatgtgcaccaattctccttaataactctctttcatatatacatatactctattcattctgtccttctggagaaccctgaaaaatacagatttcggtaccaaaatctgtattatgttgtcttttatgataacataaaagagaataatttaggtttccagaattaaaaacctgtgttgctattctacactgacttcacctctagagaaatctcaaatttctctagagagaaatggaattttaaggatggatttctttagttggttttggagtttctggagttctctgtttaaactgattagacgccaaaatggtaaggactctacttctagtagtatggagaatactgatagtccttggcatgaactgtgtagacatgctcaaagtaaaggctttgagtgctgaatctttttcaaactatttcagttgaagactttattttgtgtaatgagcccagaaaacatatcagtcatagtataatagtataatagttaaaagcattggctctagagctagaatgaattaatccaaatttcaactctcccactgtgtaactggattaacccatttatgcctgaggttgcaattttttttttagtttttgcaatcagaccttggtgatgacattgagcagtaggatataaataactcccacatgcttagggttccaataatggaacactagggataaatgggctaatagctatataacatagacagggcacttaatcttcctgtgcctcagttacttcttctataaaatggggattataatagtacctacctcataggtttgtggtggggaagaaataaataattacatcattgcatggcacatagtaaactttcagtagttaatgcaactgtttttgtttttatggttacgggatgaagttttctatttcttgaacccaattgctctgttttttgttattattattagtcttttatcattattttttctggctgctgcaatacctacctgggtctttatttctcccaatgctatcataaatgttttagatcccattagctaaaaggatcctttcctacctagagtccagactcaaaacagaccacttcatgcctctccatgcctaaataagggtcccttcacccactatggtagtgtagttattatatctcttcatgcctgatgtcctgggaatataactaaaactctagataggaagaaggatcagaaactccccagcctaattgtagagaaacccattgcagcctatctgagaaatgggaattttgcttgtgtctcacacccctagcatcactgtctcctgagccataaaataacagtaaacaaagttctcatttatgtgaaactttaacagcatgcatcaatcgagagatgttcaaataccctgggaaaactattcaaacaaaagcatatccactcacacaaaaagccacaaagaaatatcctctgctcttctttcttgctcttgctcttgctcttcaacatcttgaaagagttttatggaccatgggaagtaatacgtctttgcagctgacctagttgtcttaccacaatagtagaggtttctagcctttggttccaggtattgttaccaatttgactagtgctcccaattcatcagttactggtactgaggctcatagcaatgatgtcttggctttgcccagaaacatgaacacttccaccttatcttgagccaaattaagcctatttaacctgcaaccttccatagtcaataaggttacataattgattaatttgtcaccaaggccccatactcaagtatatttatttatttttggaaatggagataacctcagggaagttcctaaggccatctacagtgtttgtcatatgaccttttaccagccctactcttatacacatttttctcaccaagaaaaatggagaatttaaggtttataacaactcccagatattgaaccaaattaccattgaaatcaatatgccctcctacatttttcttaatctgcttgatcaacttgagtcagctgtgatttgtatcagctgaaactccaggacaggattagagggtaaggaagaagttggggggaagggtcttatctccctatcaatatcagaaatattttttaagtattcatgaaagactgtgttttcagatccttatgataattttgagtacaattgaccctcgaacatgtttgaactatgaggtccacttatacatggattttttcaataagtttactgaaaattttcttggagatttgtgacaatctgaaaaaaacttgcagatgaaccatgtagcctagaaataagaaaaaataaaaggtatgtcatgagtaaattcagtataaaatgtatttagatattagtctctttatgtgttaattgactatgatattgataacagtaagatattagtagtcaagtttctgtggagtcaaaatttatgtgtggattttctatttcctgggggttttgtgctcttaccccatgcatatttccaaagatcaattgtgtttggtaataggtttgaataaatgttaacatatttatgtaactctgaaaaatacacttttaagcattacaaatgattggaaaaaagaagaattatttaataaataatctttctttggtagatgggaaccagtaaatatcaaaggccttagaaacatgtataactcaacacaggaattctattcctagaaatctttttaatgaggtaaccaaaagctccacaatttggaattaagcaaaaaaatacacacacacatgcgcgcgcgcacacacacacacacacatatttgtgtgtgtacttatatatggatcttatgatagttatataacaaaaataatatgtaactgtttaaaatcatatttatctagaatatctgacaacaaaagaaagatgccataatatatttaagtgataaaccaaagcaatgaacgttatgcaccatgtcatatgagtcttaaagatgataatgactgcatggatgataatattgctactcacttgttttattttttactcttgagcacgtaacattttccccacagttacaatgcaataaatttaattcagaaataattatttttagtaaagaggcaaaaaaaaattccctacatttgaatgtattagtctagttcatgttggctgcatattagaatcaccaggggagcatgaaaaacaaaatatctgagacctactctaacttgctgaatcaaaatgtgtttcatttttagtgtttgttgttgttcatatttttaacatggttctcaaatgattttgaagtggtcaggcccacaaaagtccacactgtcatatgggtacaactggccttgaggataatattgctaactcctcaggatcttttcagaatgaagtgaaataatgtgagtgagtgatcctacagtcatgggggaataatccatctatgggcctatttcccaggacactgatatctgagaggtcttacatcttttggaaaagacctcttgtaagtagtttggtagaagtgctatgtctcttcagcacttcttcactgccttcttgtggtagcaaatcccagctccctgactagagaggggacctgcaaccaagactgagaaagccacaggctcctatctccctagtggtccaaggagtggtccaggcttggatcaattgatcattactaagaatttttcttatcatggccagcaaattgtcaagtaagcttgctccatcccagttttccctgaccagaaaatggcactattattcccccaatatgatcagagtaaaatcatctttccttataccctacattccacccatcagcaagtcctgctggttttcctttgccacaacccccaaaacttcccacttctcctggcctccaatttaccactctagtttcgggctactgtgacacttggtgcctatttggtcttccacttcattcttatcttgctaaagccgttgtccagagagcaaaatatacttgtaaaatataaaccaaattatgtatgtaatttcttagcttaaaattctccagtgaattcacattacatttattatagaacaatatttactctctgtggcctgacaagacatacttggtttacccctctctaaattcctccatttctccctcactctcttgtttctgactgtcttgctgttcctcagacatggcaagctttccctgattttgtcttttatctaccagaactgctcatcacccagacctacaagtgatcccttcacttatttctttcaagttttactcaagtatcaccgcctcagaggtaacttccttgacctccctatgatattaattcctccttctcacctccccgaccacccactccctgcatccatcaatctctttgctttcttcctttttggttcacagaacttggcactacctgatacacgggttacatgtccattgtttgactcttgtgaagtgaaggcttcacaagggcttccaccgtgattgtgccctgtatctgtacctagttgaggaccactatttatatgctaagttagacccccattgattggataaagtcaggctccagaagggcagactaaagccaccaagcaaggaacaagaactggaagagcttttgtttccagaatcaccccagctagctctactctttctatttttcatcccttcgatagatgaaccaaaaaagtctttcttttctcttcagttagtttgaatacaatttctgtcacttgagattgaaagatccctaactaatagccagttgaagattcagtttcaggacctgaggaattttagagggagaactgtgaaatgccacatctctgtgcacagcacactagaacatgtaagtccacacagcacagactcctcacctgcccgttaacctctgaaggcacggtgggccaccattattgtcaatataatcaaagaactttttcctcccctattgagtactttgttctttgtgtgttgtgtattcccgtcatctgctgcctgaacaactcagactcagctgcttcttatccttcttgtcctttcccttacccttccagatttgcaaatcattccagagttgtgaagggaattctaatcttttaaaattgattttcccagtttctcacacacacaggggaagcaaataatgcatgcaccatattatgtattaatacctttattcctaatccaatcttaaagcagactgattatccacttatccccacccctgaatttttttattcaaatgttcatacaaagctgtcacttattcctgaatgcctgaattttaagcaaagctgatgacttcacagaactccatacacattgagcacactgaaaccacctgtgcaacaacgcaaggcagtgtgaacaggcagggagctgtgtcaaggccagggtcagagaccagctgctagaattcttccctgaacccaagggagcaagcataggttttgtggcaatcttctcaactatagcattattgttgacattttgagtttaatataatgtacaggagctgttctgtgcattgtgtgatgtttagcagcattcctggcctctaccagctacccagtgtggcaaccaaatattcctccagattttggaaactgtcccctggaatgtatgtgctcagagaaggattgagcccaattaagaatcacatgtattcaaaaaaagaacttgtgtgataactcaaaaaatcaattctatctactgggtatactactatctcctcaaaatagtcagtaagaggtcctgggtaggtgaaggtgctacctctgctttacagttggaccataaaggtcatggcctttatgaaccaataagtatccattagaagtaaaattgtagatgagtgtgatctgtttataaatttgaaattttaagggatcttattttcttcatggccccttcatttaaggtgaaactctatttatagtgccttttgtgatagaactcgggctctcttctcaaacctacattcccactattccatcgcatgtgtcctatacccagccatatcaatatttttttattctatggaaacaatttgctttcttatatctccatgtcattcatacatactgttccctctgcctaaaatatccttcccaaccttcctttttactttttttttttttgagacagagtcacccacgctggaatgcagtggcacaatctggctcactgcaacctccacctcccaggttcaagtgatccttttgcctcagcctcccaagtagctgggattacaggcatgtaccaccatgcccggctaatttttgtatttttaacagagacaggatttcaccatgttggccaggctggtctcaaactcctgacttcaggtgatctgcctcccttggcctcccaatatgcccagtcttccatattttctttgatatgttacttcttatgatactgaaaacttcccttaattcctgttccttcctggcattctctattccaggcctgtaggtttgtctcctctctgattcacctattccaatgcctattcttataaatatcagttgagtttcttacccatctccaaatgatgtacttgagagccacatcattttatttaggcagatctaaattttgtgggtacagaagtttatgcaatctgggatgccctctttataaaaaaagaatataatattattaatataaaattaggtatatttatttagaactgggaaagaaatcacaacaaatgcctggaaatttaaagactcaaactcccttgtcaatttaccagaaatgcttacatagaaatatttcctaataggaacctggctttttctaccatctagaatgctctgcagctgtcagtatctcacagcaacctgtgcagttgagggtcaccagagcctaaggttcattacatttatggcaaatctgcctttaaaaaacgtatctctgcatctccaaggcccagtacaatggttatatggtagaaggtacttcataaatgttagtgatgacaatattaaattttatttaaaggttaagaaattccatcactcttttgttccagaaaaagacattgccagaaaccacctttctcaatatgacttagacaagactcatagatgacccccttgttcacataaggcaaggccagacacagaccctccaaattcccattctttgcctcagaaatgactaatggaactgcttgtcccaactgatcagctggaacaaaatgactgttaaccaaccttcctcaagatccctgacctctggctcacctccaggtgagccagcattcagctcctcccaagaatagaatagactggcctcacggaagatattctccaacctaccagcctatcaggccacctttgattccatttccccacactgcttctttcttgctttgtttactcctcccttcagaagcttgtagaccttatggtcacctccttctccccagtgcaacattatctttccccagccttctaggaagtctcttgccacagactttcaaataaagtctctccttactaagtctgaacttgctttttatgtgacagtgaaattactgaagaaaataagtgatgaatgactgagtgtgaactcttgtcaagcaacaagtgttctttgtaactctttcccgtactgttgcaatgataatgctattgctttcctactgagcctatgtggtctctcttttgacctctgttccttctgccagttgcaatacactcctctgtcaaccattactataagcttaatctgtcaatattgtcaaacagttctgacctctaccttgattttggcttaaatcccacctttgttataattcagtctagatcctaatccattcagactttttcctgccttagttccaagaaaacatgactctgtttctaaatcaaaatagagtatgtgagttagctttgaaaaggcctgatagatacccattgcaaaaagttagtgaaaggccattctggttgcaaacaattgcatgtaaagtcttggaggcaggaatttgaaattcatgcctcaggacaataaaattagccaagttttattttaaattggtagaataatgacagaaggttggagaaagcattttatgaatggatattgattgggattgaaaattatgagcattggttttttatgtgtgaaatttcagatattggcaaaatacataaatagtatcttataatgaatgaaaaagtactgaaactagaatttgggagacatttggattattcaaaatctttgaaaaatgctgtgatgatgatgatgatgatgatgatgacgatgatgagatggagtcttgctctgtcgccaggctggaatgcagtggcacgatctcagctcactgcaacctccgcctgccaggatccagcgattcccctgcctcagcctaccaagtagctgggattacaggcacatgccaccacgcccagctaattttttgtattttagtagagatggggttccaccgtgttggccaaaatagtctccatctcctgacctcttgatctgcccgcctcggcctcccaaagtgctgggattacaggcgtgagccactgcgcccggccagtgctgtgattcttaaaatgaaatcttggagcacagtacatttttgcagtacaaatatattttccaaattttgggtaaagactaatattttctcacctttataaaatacattaattgaattctctgttgatttcacaacttcatgttaattatagaatgcagattggcatatttaaaattttcaatgttctgaacatctaactacataaaggacagttttaaacttattctttcattggaggcaggtattatgttgaaggaaactgggcagataatgaaaattctgtattggcaccctgcataggcacaagatattaatatataaaactatgattaagataacattaaattataaagtaatttttacaatctttttttatagattaacaaatacaaacttcatcagacattaaaatccattatttcagataaggaacaatgatttataagagccaagtggtggatttaacacaaactcacattttaataaaagtgttacaaaattttagttattaaaaattcaaaaaggttaacattttagatataaaaagagcaaggcacaaatcgatttaatgggagataaagggtaaagcatgcaatgcttagactttaaaaatccaattattccaattgctctgcatacattaggcagtcatattttagtgctatcccatgccttacttgtcttgctgccttttgtcaaagctcctgtttgcattttaattgacttggggaaaagcaagggagaaaagaaagggaagttgtaaaattaaagaaagggctgtgcatgtttgaaagcacctatgtgaccccctctgactatgttatgccgatgctttaaatatcattctgctccaaaagtaagatccctatcagtctggctagttttaaattgtcacttccaaatttaaatacattattttatgaaagtttatcccaccactcttaagagtacttaataaacacaaaaatcatagtagagatacttggaaacagccactaggctatacacactttccacatgctaaaagaataggccacaattttgtttatgttatgtttcacaactatttaatatctgcaaactttcatgttctcatctgaaaatgaggatggtgagagcagctttataagaaggctagtagaatgaaggaaacggtaatgcctgggcatgcctgatgaagtgcaatgtagcttccctgggagtggctcatggtgttttgttagacattctgaagtgcttttgtagctgcttctggggcagtgggtctcaaacttctgtctccaaccctttttatactcttaaaaatgttactgaggactccaaagacctttgcttatttggattatatcttttgacactgactatattttaggttaatgcatattttttttcaatatgtataataaactcactacatcccagcataaacaaatgttttatggaaatctacattttccaaaacaacaaataaagagagaatgatagcattgttttacatttttcaaaatgctttaatgtgtcgcatgaaagacttcgattcttacatcagcttctgttgtcagtcttttatgatgtgttgttttggttgaagcataggaaaaaaatctggtttcacatagatctggggttggaaaagggacggcctcgaggtccccttaaacagtctgggggacccctagaagtcctgaagccacccttgagaattgctgttctggaaaatagaagcaatggggagaagagtagagggtgtgtttcccagcactggtttgtgccaaatctgggaaaacttgacggaaaaatactagagaccctgagacttatgttttgcctccacgctgcctttaatctgattgcctgtccattgccctgccgtaacccattcccactttgctcctgccaggaagatcagaattctggtctgtactcatttggcagaagaacctgggaagagaggataagagatacttgtacaataacgccttcatattgtgcaggttttactatactacatgaggagagtggggaatgtgatttgatttattattgaatattatagatccttgaaatatacagatatgacatttacagtttcacaagtgacattgaagatgcatggcaggtagtcatgtcactttgttgaggcatgagtttggaacaggtggcaaagctagtgggtaaatgtggcaagtcactgacaagtgggcttagctgactctcagcacctccatcccagtgtaatttaccagtggccactcttgttgggtgaacttctcctaaaataattaaaattattgttgaaaggcttgggttttgaaggggttttgttgttttgtgaaaaatggccttgggaaattaaaaatccaactactattcttggaaatggaaacagaaggtgaagctatagggcttatttaaaaaataactctacatttgttttggtttactatttatgaaataattaaggacccaaatatttaaatttaaactttattgccttttatgaaggtaattaaatgtaattgtggtatccacaaatttgggcatttggaaatatcaggaatctcctgttaaatctgaatttacatttaatattagatgaatcagtgttgttattaattctcagttttgtatggtttagaaatcttttgttaaatctatttttaggagaaactgaaaagtattgattattgattataatgagtagtatttatagaaactttgtaaagtaaaagagaaacaacttatcaaatagaattatttgataacttatcaaatagaatagaaacaacttatcaaatagaattatttacttatgtaaaattttatgtactatcatctatgaaggactgaatttaaaaggcttgaaatatttgcctcacatatataaagtgctaagtgtttgctatttttatactttcttacaaataccaattttttaaaaaaatccaagaagaagaaacaaaacaagataatttattgagtacctgctctgtgccagttacttttttaggcatttggaatagactgcccagaacagaactagatattgtatgtcatacatcacaatattttattccataaaagtctccaaattcttagaaaatgtcccttctagtttctctgtgtctgtgtgtgtctttactgtaacttattcaaatttgctctcactgaaatatattattgcatgtggcaattcccagctgtttatttccatctgaaataccaaaccaaatatttcttaattactgttaactgatgatggaagtatagacagtataaaccttattaataaacttactacacatgaaaaaagataatttagcaaaacctgttggcaggttcatcctctagagatacattacattttgattatttttttattgatactccttcatatctaatagtttataaggacattttacacatatagttgaaaacatatcaacatattaactttaatagaatacaagatatagaatatgatgtttaaaaatagaagactgtaaataggatttttatacctaagttagcttaaatatgtaagtaactatttaaatatcttataagaatgttaacacatttttagaaagtcttgaatccttggtccagatcttcttatatctaatctgcttataacttttacctagaaaatcagccttagatgattttaaatgacttagcttacctacagccatctaaaaacttgttttggacttctgattctggatagatatagtttcagataattgaagattaccaaggtactgtctgcttacgacacggaaaagcttaatgtttggctaattttagttgcatttgagtttgttaatttttaatcagtaagatttgttaggtaaccttaaagttaagtcactgctactccccaacccaaagccttctcagactccccattcacacctctcacgtccaatcataattaaacactctgtgttctcataacactttgtacatatcactaatatggaatttgttatagctgaatatgctaaaactggatggcaaaattcagggaatcgaaggcttctgttaggtttctccctctaatgcttcaggtagtgccaggaaataataaacccccaacaagtatttatagggatcaatggattaatcttgaaggggcttttttacttaaaacgtaataaaattaacatggttaaaataaaagctgtcatatgacatgtgctgaaggtattttatattctatcctttatctactttatcttttggggagcatactcactacattctttttccatatggttaaaagagagtgattcaaactctctgccttaggggtgagcatgtgattcaggacttttgtagtttctttttcacccaattccccagttatgagggccaatgtattcctttattttgcttttgataattctaacggagtgtcacacacattcaatagcttcctggctaaaataacatctgcattttagaatttccccataagaaatatttatcaggttcaggttctttagaagtttaactacagtttgatatgcatatgaaattctattttattgcctctcctactacaaaagtttttcactctcacagtagttttatttttcttttcacagtatttcaagtattttgatcagagccaattacttttaaatgtagttttttttgaatgatgttttctttgtaacttatcttatttctttcttgactgtctaatatccgaggctttgttgtgctccattcttttctcatgcttgccatttgtctcgattttcttcaatgattttttcagcctatttttcttactcaagataaagaaagacatagacacatccattttatatttcagcaatatttatcttaaataaacctacaaagcggttaaagtaagatgtcccactgaatgtcatagatattaggaatggcttatctttctcttttaactctctttattaaaagagagaaactgctaaagagtaaatatttgtttttttgaatgcatctctttagcttttgacccccacctgatctctcaaaaaagaaaaaaagtgacatttttactttccagagcctacacacagacaaaaatggctttaaaactctatgcatcagaggaatgctaaagaaagaaaaatatttcatgttatttttcgtgttttcactttagcatttcaattacatgcttgttagtgtacattcttcttatgtttggggttggttttgatgagtgtagtagcatgatattttttagaatgttttattacaaaatcagccaatactgtttaaggattacattaaaattggtaaactgccaattgaaaaaaaacattaaaaatagataatatctgaataattattttaaataaaaatatgtgtttttgcctagtgacatccattctcacagaaaagtggtattgaatgtttcatggtacatctatctcacagctaagacattaaaatgtgttgagaaattagtttccttgctattctttttttttttttttttttttttgaaacagagtttcgctcgtctcactcaggctggagtgcagtggcacaatctcggctcactgcaacccccgcctcctgggttcaagcgagtctcctgactcagcctcctgagtagctggaattacaggcacccaccactatgcctggctaatttgtgtatttttagtagagatggggtttcaccatgttggccagcctggtcttgaactcctgacctcaggtgatccacccgccttggcctcccaaagtgctgagattacaggcgtgagccaccactccctccttgctattcttgagcacattgtagtaaaatgacctatttggagccagaaatgaaccagccacctacacaaactcttgttaatcttttcagccaaattatagccttaaattttaatctcagaagaaaatttttgtcactcaatctgtgaaatacaggatcaaataaatggcttttgctttaattttttttacacttcatgacatagttgcttaccatgtagaatacttattgctagcaatgtaattatcatgaacagtgtctgaaacatccatttttagtcaagttctgtgactaatcaagctaaaacatacattttcaagagatccacctgaggactgtctatccatggattttctatcccactgcactttaaaattgactgggagcttctataaaatgctctctggatgtgcctcataccaaataaatagtaatctttgaaggtgtggccttgggttatattttttaaaactctacagataattttaaggtgaaccaaggttaaataccatttatttgaaccaaatgaatattcagaaacatgttattcaatttttagtcacttgttgagaactaatttcttgacaaaaaagacattcactttgtggttaatgtcaaaaattttacctttcatttcttaatatgaaatatattgcagaaatccctgataatcacaaacacctgcattttaaaagatttccattattatgaactattttttattattatttggatcttcctggggagactttatctcactgggaggtaatctatgttaagtcttaattcaaaaaatgaaagttcttgagaaagggttgaagcatataggtcattagcaaaaagctgatgttgaaatattcactgaagtatccattataataatgaatactaaattactataagatttattttcctagaatagtaattttcccatgtgagcactctgcaatattttacagtagtaggttcacttcgagagttgtttctgaatacgtatagcatatgaactaaatcaaattggtaaaaataaacatagaagtgagggagtaaccaaaaaaaaaataaagttatatccaaccttttgtttcagaacaataaaatgcaatctactgaaataaaatatttgattaatttaagaggttggtatttagtagcaaaatttaaagcaataaaatagttttggtaatggtatttaaaagtaacctaaatttaagtatttcttctcatcaaaagatacttctattataataaaatatcaattttaaattataattcttaaaatatttattaagtgcaaagtttaatgatatactgtaccagagatataaatataagtaagagatgattcctgcctttaataaataggtattcaagtgtggatgacacagacatatgcagaaaactcgcaatgtagtgactgctatactaataaagtgtggtgatcagaagagggcatgtttcagttatgaggcattgaccaaggctgaccaaaggaagagatgttgaaatgggttttaaagaatcaggagaagttctccatagggagcagaatgggtaaagtgaatcaataaacttagagcattctgcagaaaggtaagctgttcaatagggacagaaatgagaatgtaagtgcaaagaccagctgttagtggggctgtagtctccttggccccagatcataaagggccttgaaagttaagccaaggtttctgctcttcttcccaggggcaatggaaaaccattcaaacaatgtaattttgagtttcttaagactcctgtttccttggccactttccttagcctgacaccagcttgccttcctacagccatacatgaattttctttcatattgatgattttgctaactaattaaaatgtttcacaaacaatgacttgatttcttaaaaatcagaacaaaaacagtgaatgtcccataaatatatgtacacataatttatattatttctcttaaagatgagccattatgattgaggtttataatttcttcagtatgtgcaaatactataattttgatgtataagtacaatcacagatgaaatacaaatttagtttataataagtttgaaaaagctttgcaaccaataaataatgcctacttcatctgaaaaacttgagaattaaatcagaggaaggagttgcagactaagggatttctggggaaaggctgtacaaataattaccctaagaacacagctgtgtttgctttgttgttggataaaaaatggtattaaccttaaggtttcttttataatcctgggaaattttaagttttcaaaatgttttacttgttgaaagtaagcaaattaatactacaaacaaacattcattcattcaacaaatatttatgaaacaccaatataagtgaggcaactttctagaaacagagtatgcagccaagaaacagagtagaactgtccctgacctcatagggcttatcttctagtgagggttgtcaatatgtgggcaggggtagagtcaaataatagggaaattaactggtgcacaatattaacagataatggttgctgttgaaacaagaagagattggattgctaacagagggaggaatttgttcatttttattgaatagttggagaagggttcacgaataaggtaacatttaagccatgcatatagaagagagcagcaagaacaaacctcaagtttaaaaagtgctccccgctgttcaaggggaagcaagaagtccaatgtagctgcaagacaataagtcaatgataggatgaccaacaggagatgtggacaaaatgtagagatgcgtggagcaagggagatggagccaaatattgtagggccttgctggccatttggggaccttttttttcttttactgagtgaggtaggaattcattggacagtcttacattttagaagaattaatctggcttttcctaaatctagattgtggagaatgagggtataaggagtctattgtgataacccaggggaaagctgatggatgcttggatcagagtgaaagcagggaaggcagggacacatggttctattctaagtgtatttgttttgaagacataagaaacatgaatatcaatatgtaaaatattaagttactatctacttaatatgaaaattatctccatatatgtgacaggcttttattattaccaaaaacacaataatcacaaaggcttcttcaactctaaaacagttaagaaaatatttcatatatttttcattgacatcaaacatcaaaaaggagagaggaaaaactatctttgtgattgttgtgtgtccaatctatgtgttggcacataaatacatttactttacttataatatagtatctgatctgaaaaataaactgttggaatatatgtggatgtttgtttccttctaatcatttaaactgactgtgttattgaaatcaaatttataaactgcctgcctatgtagacacccagaagcaattacaaatgcattgaaaacatcattacttacattctggccctatacagtctagaagtggtatcttttcttcctggctaggtagttattctgaatcaaggagtctgactacttccggtagaaagccaacagtgggacttcaaccattacttaaatgtaggctggagacagaatctgaaaaggttttcatttgcaaattactgcataacatactacttcaaatttattagcttaaaacatgaagcacttatgatttctcataagtctcaatggatctcagctctgcttcttcccttgtctgaagtttgctggcaggttggtaggggctagcccgtctaggatagtcttagctggtatgactcagctctgccccttggattcttctcatagtgaaggtgaaagtacatgggacaaagtgaaaaatgcacatactttttcaaacctctgcttgtgttaagtctgataatgtcctattggccaaatcaagtcacctggccaagcgcacattcatggtgtgggggtaaaaggtctctgattatttaataaaaagaacttcaaaatcacaagaactttaaagagcaaacaaaacaaacagcctcaaccacaaacacaaaaatcattacaaccatcatatctgtgacaagtgtcaagtttggaagacaagcaagtttggttaaggccttattccaaattctgaccttttgttgttcaccaaaatgtggttgcagtgcctagaacagaaaagtgattcaaaggctgtttaaaacacttccaaatactccccccaaagcttaccctggtaagcacactaataggatcacacaagatcacattttggacacttaagtgaaaaataagagatacaagacatgaaattcaagaactattcagttcagtctttggaaaaagacaaggcaatttctggttggagctgatcccctggctcttaaattgtacttgatttcttcaagtttcaataatcagatctttgaaaatttcaccccatgcactctgatatcttatactttttctcttttattgacatcagacaacagctaaattggattgccaagtatgaatcaaaataattcaaagatgattaaaatattaaggatgtctcaaaggcatgacaatgtaccagtctagcacactagtccagaaaatgtaaccaagtctagtgtagtgttttccagaaggtcttttaatataagcaattaatttttaaaatgttacaataaaattaatataaacttcatgcctagaatctgttaaactcattcttcctcctgataattattccaattaatttgtggtcaaataatagtgattatggaaattttagagattccacatcttcttattctgactataaaccacagtctgggtaatttgctgcatcaataatgtcaaaattaataagctaaagtcaaaacagtattagaaacagttttaatatttactacaaatatacctaaaatctgctttagacaagagagaattaagtaaataaaagccaacaacattaagaatttattttgttattaccaaaaactacatataacatttcctattatccttgattcaacgcttttgccagttaggactccaatatgtacttacccatatcccaaagacccgtattctgtatcctgatgcctctttctcttccttccttgattaatcattgctgtaactgctgtagctgttctatagcagttctctcttttctgccatagatggaagccattttgaaaattctaacttccagttgagtagccaggaatttttgctattaataaatttctttcttgtggaaggtgtatgtgtgtgtgtgtgtgtgtgtgtgtgtgtgtgtgtgtaaatgtgtatatctaaaactttaattttcctatcttattattttcttccccttagacaaatctcagtttgttattattgtacctagagtaggagctaagaataatggctagtttagagatggaagtctgaaaaattcctgaatctaagcagttaaccttctttctatgttccttttgatgagattctgtactgtgactatttgtaaatataaaagcagctccctgagacagatggttatttacagtgttttctctattatgcaggataaattattaacaagaaaataattgaatattgaatatgccctggcaaagaaataatctttcaccaagtctgtcacacagtatgctgcaagcatgcattccaattagtagagtgggccaagtagattaatgtatcaaattgtttaaattcatgattcaatcctactttccttaagaacttagtacaattgcaaatcaattattattcaagtttgttaactttctgcaaatttcaactatattttatgactcatggatttaaatcataattcaatatgcatataattgaaaaagttttctcaaaagcttgttttcatttattttcattttgatagcattatatcacagctgatcaagtaatttatcatgttaacatattaaaatgcattcataggaaatattttacctcatttttataagtaattttttaagctaccaaggattggaatagaaaagaacatagttaggagagggaatagccaaattattttcatatctttggatcatactatcaataggagaaaaagcaaaactgtttaaccattataaaataacagtagactatatcaatggttctcaaagtgtgcagtacctggaaatttgtgagaattgcaaactctatcaccccagaacttctgaatcagaaagtctgcaattagggcccagccatcagtattttgacctcaaactgattctgatgaaaaggtaaagttgcacaactactctcctattgagcttttatctcttcaagcactgttgcagtcatattatcatttaatctacatttaaaagacaaagtattatcacaatatttaacaaatgagaaaaatgaaattcaggaagattatgattagcttcttcaaagctcctcagctacattgatggcagaaccaatatctgatttgactttcactaacatttgtctccattaacaaactcataattttcagcctaaatggatagaaacattaaaggaaaaggaaagtctaagtcagctgcaaagaattatgttacatagtttctgctatggagccaactttcattctttcaacaagtattataccagggactatggtaggtacaggagatacaaccagaagcaaaacagagttctttctcttatggatcttgccatctaccacgagaagcaggaaaaaaaaaaaggataatttcactatagaagaaagtatataaaggatgtaaaggtcactacgatgggcacataggaaaaacgcttcttctggctctaagattaaaggaagaggaggcaggtggttcctggaacatgaggtgtaactaatctttcagtagagtaggggagaaaatatcttaatccataaaaatagctaaagatgtgagagagaagaatgggcatgcatctttattatcctgccatttgttatctaaagaacagtgcaaacatttttaattttcattattatgaagggctattgtctgtatattatatttatatgtatgtgtatatatatttatatgtgtatgtgtgtatatatatgtgtgtgtgtatatatgtatttgaaatccaaaatgttttcaattgagttttcttattagaatgcaataatttaaatattttagagcataaaaattaagctaatattcattcagtttattaaaaaactataatttggaagattaaaaacaaaaacaatagttcacagcttattttatatttgtgggaatcagatacaaaaaaaaggtgacttgatgcccctagaaaatatttacagtcaatacaaacatgggagacagctttgaatatggtgtagaatacatgttaataaaaatgtataatatacacaaacttctggtctgctgcagtttgtatagcattatgaaattaatgaaaatatattattttcataacaagtgtcagcaaaatgcagcacagtaatgttaaactattctatttttgcagattcaacctcatattcagttttctcttacactccagcattacatatgatgaatgtgaaaaaataaacaggcaaacacctaatatattatagcagatggagaaaaaatagctaaatcggaatgatttccctaaattttcagtatgtgaagcaatgaaaataaaaatttaatattcagcctcctcattttaattatttcacaacagtgaacccatagtgatcagggtattttgtgtattaaattatattgtttggcattattgttacgtgattctagataatatttctatcagctaactaatttctacattaaccaaaatgtatagctaataggccaataaacatgacgagggaaaagaggactttctaaccctttgtgagtccacaaaaatgctcatttctagaaaaaccaaagaatacattgacctcactatcaatcaggtaatgtcaatgttagctgcagctctggctgtgcacaaattctttttgcaacaaggtgagacataaataaatatcccgtcagtgatattaaatatttattacattaaacttttaagtattgaaaacaacttttaatctcaggaagaaatattatgatagtttaaaattagttcataaataattggatatttatagatacagtaggttgctttcagagtttgctctcagcagggaattaaaatgcacctctatgcacatgctggtgcagaagagatgaaatgcaaaaccaagatctctccagaggacaccaacattcttggacaatttccaaaaggaggcacaaagtacaggctagttctaatttggtgtctgatagccaagagagaaggccattgttgtggaggtgatgaatggggaggcaatgaggaggggtcattacagaaatagcaagcagttgtggcagttttttgagttaaattttacaaagaatattttgaaaacaagatgggccaaacagaaccaaaccatctgtctatcttgggtctcaaagctgttggggaagagacagttattgagaaaccatatccatcccaaagatcttaaattggaagcatagtcaaggggttataatgccttctttggttgacaagttctaacccgcttcagtctattacaatctcagatgttgtctgtaataatgcttggtgtcctatgtcgttggatccagacatcgttggaataaccaaccatgtcccagaacagtgcttaatggaaacaactaagtgagtctaggattaggtcagggtttgatattatctatgctatttattgactaaaatatttcaaatgcaatctagcctggaatagaaaggtagacaagtcaatctagaatagaggtaaaaattattcaaattaattttgcaagtggatgttttaaatgcatgtctattatgacatgttttctagactctttaaagaactatgtcagatatgaagtagtatttattcgacttcagagtgaactgagacaacccatgatttagaaatgaggcaaaaattgtctcagaatagactacagttaaataaataatacttataagtttataagtattgtataacgatactcatgcatataagaaatcatggtatttctccatttacaattttgaaatttctattttcctattaaaataaagaaaaatacatcatctatgctagagggcttcatgtagccaagtggcattactccagcattgagcccccaaaagaagaaaagaggtgataggataaggaaagagcacaaagaaacttgcagtaaactgcacatacttttgtccttcaagaggcattatattttccttaaattcattgccagttttccttggggaccattgtctgttttctttaagagaatgtgaggatatatttatgtattttaactgctaaattaatagttaaaaattcaatgtgacttttatttctttcaaagaatgagattaaaattttaaatggtttcttttattaaaaagagactatatgcagttttatccaaatactttttctatgtgtttaattattgtataaccactaaacatattatataatttgtttttatgcaatagtagtggatatgtttttaaaagtttaactaatatatttttaagatgaatagaacaaacatttaatatcacttaaaagtgatattagaatgtactaccctgcactaacagctatttttgttacataaatctttaaatacactttcttattcttgcagtcatagttaaggaagaagttgtagaaaaaaagtaaacatatggtagatgctatttattcttttttctggtaatatgaaaagtcaaatttagaatttcaagctagaaatatctcagagagtatagtatcttttaccttaaatatattctaaattggtatgaaatatttcagtatctcatccaaacttgtcataaagttcactttattattttcattttcttatttaatattctcttctgataactgcaacattcgtggtgaatgtgattcagagttttcagtggctgtgaaaagtccagttagtcatagaattggtagctatggaagaactttggagaatatttcagattcttatagtgtgttgagaaatataaatcattgcattcaaatattaactaaattactgctcacctctgactgtgaaggagtcggggggggctcagattgtattggatttactcaatttattctaaaagtgccaaatgcatgtttggacagtagttcattttaaatttctttaaatatctctagtgtcatatataataacaaatgaattataatgtatattcaatgactatatttagtgtcatcctgcttttccttctttagaattttattagaccaccttacataaaaacagcatcatcaaattctgatgtggtatgattttctctgttgaataaatatttcaaaaaagccaggggcattagttaagaggagcattaaaaaaacaacccaaatgtcaatccaagttagtatggataaataaaatgtagcatatctatgcaatgcaatgcatccaatgatggaaatgaatgagcacagagcaaaataaaatgtgcagtgaaagaagtaaaaccaaagaatacatatcctatgattcttttttataaagagttcaaaatcaggcaaaactgttttatatcatttagaagtacatactataaagagcttcacagcaagtcaaaaaaagggggggccataagtgttagcatagaggtttgcctccaggagggagaacagcccctggaaatagaaagtggcacaagagggttatcttctggggtgttggcaatagtctctttcttgacctgagggcagttacataggtgtttgctttacaataacacattaatctctgtagccttctgtatatgtgccctaattctcagtaaaaatagataataatgatgatgatgatgatgatgatgatgatgatgatgatggtagaatagatggatggatggatacatagatgtaaaaggaaagggaataattaaaatcaataaaactaggatatttgatctattgctgtctatttcaaccaagaggtacagttggactgccatagaaggtacatcataaagggtcatggtacatactttggaaagaagtctaagacaggaactaaaaagttgggtctagaatccagatctatactttgacacattctgtgtatatcatggaaatgatcacttcaattctttgtgcatcagggttcttatctgcccactgaggtaataaccatttatagaaaagtctgtgataatttcaatgagattatacaaattatttggataataatttttcatctgcatctttctcccaaatcctccaatcctgtacatgaggatgtaaaaaaaattatgaggtataattaccagtaagcaccatctacttttacatatttcatgtatgcagttttttgttcgacaaacttttgtggtttttttaattattttgagttcaggggtacatgcgcagcatgtacaggtttgttacataggtaaacatgtggcttgctacacagatcatcccatcacctagatattaagcccagcatccattaactattcttcctgatgctctccctcctcccacctgccacctttcaataggccccagtatgtgttgtttccccccccatgtgtccatgtgttctcattattgagctcccacttataagtgagaagatgtggtatttggttttctgcttctgcattaccttactgaggataattgctttcagcaacatccatgtccctgcaaaggacatgatctcattcctttttatggctgcatagtattccatggtgtatatgtaccacattttctttatcaaatctatcattgatgggcatttaggttgattccatgtctttgctattgtgaatagtgctgcaatgaacataggagtgcatgtatctttatgatagaattatttatattcatttgggtgtatacccagtaatgggattgctgggtcaaatgctatttctggttctaggtctttgaggaattaccacaatgtcttccacaattgttgaactaattgacacttccactaacagcataaaagaatccctttttctccacaacctcactggcatctgttgtttatttgactttttaataatagccattctgactgctgtgagatcatatatcattgtagttttcatttgcatttctctaatcatcagtgatgttgagctttttttcatatgtttgttggatgcatgtatgccttctgagaagtgcctgtttatgtcctttgcccacttttgaatggggttgtttttttcttgtaaattttcaacaaacttttgttgagcaaaacactgtggtcatgaataaggaaaagggttttattatttttatgttgcatacacacatagtcacacatgttcacatgcacacatgtacatgtaccacacacacacacagaggcaattttttatttcttaattcccttttatgaattggtgtctctaaacatgataagggaagaaaagtatcaactaatgattatgcaccacttttcagaaatattgaggtcatagtctggaatattatgaaagattctttcaaattatgaccctcttgaaaataatttggaaataaactgattttgcatttaagtgacactgatggattaataagttaatgtatacctagattttgtgatattcataaaaagattgtaactgaatatttgtgtagtattgatttgattttagatacctttaattaatagcaacctaagtccaacagcacattttgcaaaagcaaatttatacacctgaaataaaatgtaagttgattttattaaatgaaagtccaaacttacttaatatgagtccattgagtccaaactcaatgatttaaacatattttctccaataaataatgccccatagctttcttaaattaatatttactcctgaaataaatattataccatatttattggtatgatatttaatagaaggtaaagaatttaatgtgcattttcttcctcaaataaataaatattgaacttaacttgtccttcgagcattgagatgtcttccactaaacacctacagctttaaacacacctcctggaaccctgcatagaatgatttaatagttacatattgagaagaattttaaaaagtgtctctgacaccctctttattccattgaagaacttaccactggtgggacagaagaattgtctgtggtcgccaaggtttttttttaacaattactaaaaatttactttttacatcttcatgcccattggcaaagtaataccaaattgcaaggtttaaactatgtaggttttatttttttatacaaacaacatttatttccaataatgcaattaaattatttgttgtctttatgtattatagctatgacaacagtacaatatatacccaactctatcatttcattctacaaccagtagtacaattagaatttgtgtctatctcttagcttattttgaactaattttcaggacacagcagtacaatgtgtagagtacagtgtggtgggcatcaatggttattctgaggaagaaaatgggcattaaattcttacctcctatgaaagaaacatagtaggggtgtaaatatatttatttcattcataactttgataactagggcctacccatctgccagactatattattgtgtaaatagctcccatctgagctaggtgtcttgctaactcagatcaattagtacttgtaattgaagctcaataataattactgctacatctagtgagcatttaattcctgtgtgccaggcatagctatagatacagtttaagctgctcaagtttaacacagtaaaaatgataagagcataggtgcttataaagaattactattacaaggaaactgggtatgaatacagtttttaagggtataattttgggccaggcttggtggctcacgccacactcccaacactttgagaggcctagtcgggtggatcttctgaggtcaggagttcgagaccaacctggccaacatagcgaaacctcatctctactaaaaatacaaaaattagccgggcatgggggcgggcacctgtaatcccagctactcgggaggctgagacgtgagaatagcttgaacccaggaggcagaggttatagtgagccaagatcgcaccattgcactccatcctgggtgacagagcgagactccgtttcaaaaaaaaaaaaagatacaattttgaattcactgcctatatctaatttcccagcatttattacgattcaccaaataaggtagcaatcatatatagggatttttagatcatgaggtttttaggtgtcttctggattcagatgagttccttgaaatcatcttgcaaactgaaagtgactgtgatataagaaataaccataaggctatggcaaagctgagagtgacagagtttatgcaattttccttaggaaaactgcatgatatctattttgaatcctccacctggcattactcattttatttatggaacgcattctccccagagtgacatcttctttccgtatccataatgtataattgtgatccttagaccttatcatgaaaggacaggtggaatattattttaagcaccaggatatttcttagtaaatatcatatgtagagtattgaccctttcagggacagcaatcacatagcaaaaggaaagcacaattttatctcttgttcaatcacattgttattctctttattctctggatttagggtctgttcctataataggtaacacttctaaagataaagaaagcacttaagagaattttgggatgtgttccacaagagacctggaccacattttcagttaatagtgtttgataaattgaccatgaaacattaaaaaaaaaacacagatcttaattcattaattgctgttagcattttattcgtaagataattaccatacatgtaatcattaatgatctacgctcatggagaatgtctttacaggatgatatttctgagatgttttaagactcctacattactgaatttgtaaagggaactgtgatttttgtttcaaaaatttaataagttaaatgattaatacatatagtcctcccagaaaaaaggaaaaggcaaatcatagtcatctctttcattactgtaaaatgtggtaataatttagagaccaatattttgttgattcaatttttgtcatttactaaattaaacaataatatgtataacataattccagttatgagtttactcttgggagtaactatatctttacttcatctcatttcctctctaaaaagtcatctggatgtgaaagtatacacacaaggtaaaatatatagtatattatagtgtaaaagtatgatttttaaagaacttggaaaaagaaagaagtttaatgggacttatattgggttctatagatgcagattaaaactaatagttacagtagttttaattcctatgtttcatgtatagaaaccatgctatcattcttctaaatctgtaagctttttgctgtagatttaggatttagagcattatatctaattctaaaacaaacatttgaattatgaagaagttcttatgctgcagaaatttatttaaatttagactgtcattagcatcaagaatattttttattccattaacaacttttaattaatcatacaatttgcttttatttcagaaaataccacgtatctttatagactaggagctcagatatattatttccagctttcttgatgttacctcatattgaagttgccaatggtaggactgcacaatctgaatacatatgatgagatattttatgcctcgttttccatctgcttgagttagcaccctttcaccattggccatttcatactacccaatttccatgtaatttgtctctctaatcttgtcagccccttgaaatgaaggtgcactttattcagggattattttcatgctcaagatcattttgtgaattattttatatcattataaataatcctactgttaccttttcaatacaagaatttgatttcccagcattaatgggttcattcaatagtagtgccaagttcatacagcaacactgtaattgcattttaatcagaaactagtaatatatgctgaagatactttgttaaattaacattattgctgtgattaacaaagcacactgttaagtgaatattgcatgaattaaattacatactagatcacttacatagtttaggatttcatgtgctatctagctacctcttcccacaaaatctacatccttatctgttttactcataaaaatgtaattcttgaagctcataagcatagctacttaaatgattcctttgcttaatagaaacatctttgttcactacaacaagcttatctgcactacattttttaggaataaaggatatgtgatatgtattatttgaaaactggcattcaattgccacacttggctgttcaccataaaactcctatttgaaatctaactttgaggacttctttgaggatactagagttatagttctgaaatagttacttgcagaaatgctatctattaatttaaattttggtttaaaaaactcataatatttttttttgagacaaggattcactctgttgcccaggctggagtgcaatagcacagtcagagcatattgcagccccaaacttgtggcctcaagtaattctcctcctttagcctccagaatagctaagactacaggcaagcaccaccatgcctggctaaatttttttttgaatgttgtagaaatggagtgccactatgttgcccaggctggtcacaaattcctgtcctcaagcaatcctcccaaagtgctaggattactggcatgagccactgcacccagccttaatcatttttagtgcacagtttagtggtattaattatagtcatgttgttgtaccacagatctctagaactttttcattttgcaaaactgacactctgtacccattaaacaataaatcctcattttcaaaatgagatagcttctctagatttagtaaagctctcttctttttcattattttgcttttctgtgaaaggggacttcaaatttattttgaggaaacaaatgtaaacactcatcttaaagtatgtatattaagactattttaataatcagagcaaactttcatttatttagctattttcagtttgcagcctaccatgccaaacattactttattgctgttccctgcagtccttttgacaaggatggagcactgtcagagctgcactggagctggagacagggatagaggacactcaggatgacagcccccacccagaatcctggagaggaaagttgctattgttgaaaacataatggatctggttgttattaaagtacctgaagtcagctgcataaattgggaagcatatgcacgcttctgctttactgtggcaatttaaaacaatataaatttcataaaattctcattgaaaaaaaatgaccaagaaaagccctaaaaatagtaggaaatgttacccatcattacatcctccaccatcaaggccaagtagtcaatacccacgccagataagcactgtgtgcctatgtgaggtggtcattaaagaatgatgaggaaaggaccacagaaatcaactggtgtcttcccaaagtcctggggacgctgaggaacacacatgggtctcataatgtccatgtccttcccttatacctcaatgctctttccaccttgccctggtggaaagtcttgtccatatcacctctaatccagcattctcaaagcagcacaaaactgtcttcagaagactgaatgtttctacattccttcatattaattccaggaaaagaattcccaagtcaaataattcaaatgctaagtgtattttttaaaattgtttttaggcactttctcttaggaatgtaaactctttgagggcagggtctatgtcctttcatcattgtgttcatcaggctttatcattgtctagcatatggtggatggataaacaaccatctccgtaaagatatctgatttctattccaactacacaagctccttttctagtatacacagccaccaaaataatgcttaaaacatatgtctcagaatgacaatcaagatagaagtcttaaagcaagaaagatgttttccttgtttgttcttctataaattctctaaagattcataaaatttagctatacaatctacttcagataatggcttctagatgctatgtagaaattggcccattatgcaagataaaaatcatctaagattataatgcaaatcagtcatcataaaaaatataaagatctagaatttatagaaattctactgagcatttattttatgtgaaagaaaaatacatccacagtacatacataattaaatgtaaatgtatgctgaaaaagttcataatcatgaaaaatacatatcttgatggactacttttatttggcaacctttaccttccaatatctgtcataatattagagtagattagaaattatatctacagtctcaactcattttatgaaatatgagtaacggtaggtatagataatttattttccctcagctgtacataaagatggataattacatctttctaaaaaaatgaagctgaccaggcgcggtggctcacgcctgtaatcctagcactttgggaggccgaggtgggtggattgcttgagctcaggagttcaaaaccagcatgggcaacacagtgaaactctgtctctactaaaaatacaaaaaaaaattagccgggtgtggcgatgtgcgactgtagttcccagttattcgaaaagctgaggcaggagaattgcttgaacctgagaggcggagcttgcagtgagcggagatcacgccactgcactccagcctgggcgacagagcaagactccgttgccaaaaaaaaaaaaaaaaaagaggaagaagccattaggtctcttctaacctttacctttgcagactttaatgttgtcagctagtccaacatcattatgcactattatttgaaggtgctcatccattttcccagcatcttttgtgttgtcataacccttacatgcagtatcagtaaatatggctttattgtttgacaacataaattccttagtgacgttttcaaaagaataagagtttttaaccatttagttaaatagaaataaattgatgatgggaaatgtctgcattctatgtttaatttttctatcaatctaaaactgctctaagaaatagaattcattaactaaagtaatgatgtaggaaaagtttaaactaatttactgtttacttaaactgcaatagcaaaggcaggagaataacttaacaaccttacagttaattattttacaggatatgttacctgcctttcatcttccctgagtataagacaaggaagcagacttaaactctcatgagagaaatgtaagttgtataaaaaaaaaaaaattctgatggtcagagtctgctaatagtattgaaacttctggatttcatatcctggatgcaggtgattaaattgtctggtatagcttaacattctcttgcctagaaagaagaagataaattagtcagcacttggaaaactgatccaacttcttgttactataattctatatttctcagactggtttgctaagcccattagaacaggggcttcatgaaattaaggtcacaggtctaattcttatttcaacctattagcttccctttcttctgagggactttacttcaaacatcagccaatcatcttgtaactttcacccagtcacgaaactcacaagacaacatacatggagtggtcaggcacctactcattcccataattctctggaacatacttcagtgtgggctggactatcggtgtcacaagaagatacatgacaccgcagagatggcccagtacagtttttccttgtcaaaatcataaaaagactatggtaatcctacaaattctgattcacccgtgtcaaagaaaggaaggaagcttcagaaggttgttttcttttctccttcagagacttacaccaaattattttgaatttgcatttttttccagtctttaattcttgaccagtaagaagtctctcaactctagtcattgaatctaccaaaatattttgtttcaaaaaataagaaaaaaatattgcatttttctacatttttgagtagaagaatctccctaatcattggttataaaaaatgaaaatataacactgaacaagttaatattacaaataacaaaataaatgcccactgtgtaaaaataatgcaaaattcatatttcaaagttaccataatttgaatacataggtctcttagagtcaaaaacctcataaaatgtgtgatgacatttttcaggacatatgtagcatcttctaatcagatgctaaatgtgatctattaactatcacttgggttgctgcagccctacatcgattgttttatcctgttgataaaataaaaatttacctcaggaatgactcactggttagtaaaactgaattctcttaagcttaggacttgggaaaatcaataattggaaagataaatgttttgagtcataatgaaaagcatgtataataaaatcctgtataagagcctgaggcatcatccaaatttatagaagtggtaactaagtgttcaaagacaggatagaggaaagagcctagaaacctggttcaatgtctggaaatatttgtctctttagagtgataaatgagttttaatcaaattgactgtagaaatagaaccaaaaggaacattattctaagtggtatcggtaatcaaggaagaaaagcctggtattaagaacttaccatcttttcagtggtcccttaagatgaaccaacgatttgaagaaaacaaacttgattataatatacaagcttgcctatatttatttataaaatattctcaaagtgtagtttaattttaataaacctctctctctgagtcagggctcataaaatttaactatagtacctggcctaatttttttgagtcatatgttaatgtaaatcattaattaatctcatatattgatgagtatagtatgaattatctttttataatatctttgatatataaatattcacataaaaggttataatgtgttctaaagaattaatttctgactatacattatatactactagtgtctagtttaagactatatatcacttcttgtttgggaatttatgtttatatttaaatgtcaataattatcttcactagctcaccaattacatgcaattagtgattacaggcaaataatttcctaaaaatttgaatgaaatgatcttttaaattgtgttatgaaatatcaaacaatatagagtttggattggcaacagtaaatagaacagagcatctccttctacccatagcccttctctgacatcctacaaataggaatgaaggagttcctcaaatctgcacagtcaccttagggcctgggtcaggttttacccccaagacacatatacgacagaaagacaggaaagtgtaatgtgatcaccagtaatgtttctaaagttcaaatttaaaactttcacagccatttataaattcttatataagtaattttaatcgtaatgcattgcgaataacaaaaactcctactgtaatagctttcttgggaatccactcaatcagttacatatgtataggaaataaaggaatgccttcaaattataaaaaatactgaaaaatatttaaattggatatatttaaaataattacttttttatatagaatgccatagatcagaatccatatgaaaattgaaaacatgacctattatttatcagctcccaatgcaattataaatagatttaattggcactgggatttaaggcttacttactagtgtgtaactaattaatagaattttcagctcactcagcatgtgacttcttcaatgataagctgaagttccgaaaaaaaaaaaaaagacttaaaatgactatgcacatgatttttaaattactctccatgtttatggagtaattgagaaacaaactaagtttcatagtttctgaggccctgataggaagccaagtaaggatttaatatgataaaaaacaaacccacaaaaaatcatacattaaaatactagtaagataaataattgctgtaagtgagcttctatattattaaaactttttggaatgtaattaaaattaattttagagaatttttaaaaatagttatgtaagaatcaatttctattttgaaaagtgtattatgactactaatgctccattggtttaaataaataacactggaattctatattttatcataatcatctttgttactaatatagctgattattatactttcattaatgccctttattcaacgtatatttttattctttgtacactcaacaagactttgtttagaagtttctgtagtcttaacctgcctacctcttctgaaatgtctccttattctctttttatctctaagctttctattaaaaagtatgtctaactcaatgctttcttaactacatttccaaaccttttactatgccaggacattcttcagattcctagaaccattggttgctgttctcatgttccagtgtccttgaattactattgtctgaatctgcattctatctataaattatgcatgtcttcaaatagcacctataaacttctacttctgcatgctgttccataattgccaaattactgcacaagaatattattctgactatacagcagcattctgaaatcacggatttaggatttatatagatttatgtagatgcttttaatatccacgctattcccggcatatttttccaccctatatgctgcagttccctgattacctggcacttctccaccatctctttcccctagtccccaatgataatgcaattgtcttccattaaactgccttctgcaccaccttttgtagggcctaagtcctgtatcttaatggtacatttttataatttgaaaaattagatgtttaaaaaaggtattaaagaaaatataagtcattgagcatttttctctatacaatcaaaagaattaataatatattggctgaatgctttagagaaagacttggaaatagtctgaaacattttttctttaaagaaaactattttgtattttaaaagaacctatttttcacacataaaggggacagacttttgttttataaaatatactaaacatacattctagtgtgtacccaaggcagtgtctgaccatctgctggtaaaatttaagggcatttcaggtcaactcaagcaaataattttcagttcttcaaattaggtattcctgtcaatattgtattacatttgacatttgcactgttttattgggttagagccctaagcagaggaatttttttaaatttacctgatatgtgttcaaatattccctagtacacttcaaagggcctaaaacgtacgttttgaatgaataaataatcaaatgcataaatttgcactgtggaatttacatgcacagttaagccatcaaatgtaaagacagatttctagtatacgcccccattgtatgggtattgcagattttccatacctggtagtcatttggtatgcttggaaattcccaaggatacaacttatattaactgtttctaggtcctgaattttcttctagaaacctgttgacaaacaaaaaaaaaatgagagggaattaggagatatatgttgtctttctacctctgcctctaacagagggactttagacaaatccctggactccgtagtttacaaacgcacaaattatgaggacattgtttttctcttagtggctatggcagattcagattgtattttccaaagttggcagtagcaatatttctcatccaacattctcttccacaatgtcacgatgacattcctctcattgagaggtgaaatccatgatccctccctttgaaaccgggtgggcttggaactcccttgttactaatagaattgacagaattaacattgagtgacttctgaaggttgattaggaaaagccaagtaatcaaggctttgtatatggaagcacttatgctggaaccctgagcatactataagcccttgactatgcttagtccactgtgctgcaaagaagcccaagttatattccagagaacaaccaagcagagcagccaggcagtcctcagcttccccagccactcaccattgcagcttcagctaatctctaactgcagccacaggagagactttaagctaaaaccacccagccaagtcctttctgaactccagagctttggggaatgttaaatataatagaatactttttgctttcagctgctatattttggagatatttttaatgcagtatacagtatcattccttaggtaaagaaaaatgattccatgccacaaattgcttctttattctttgaaaaaaatataacctttctaattgactacataaatgtttttgtcagagatatgttagttaagtgccttgaattgtttcaggaaaacatgctataacaataattttgtttatcatatcatgaactcattaaaaataaaatgttttttagttttaattacaccaagacacaacactgcatcataggagtaaaccacttgtaaattgtaattgaaaatgtaatttttgagggctacaggctgggtgtgtatagtctactctttgtggctttaatcctagccttcttgaatcttcattagtgaaatctataaagaatgtaatcatgtatctcagaagaatcatttgttaagtgcgactgagatgatatattccatcatgaatataaccaaaagaatatcttttaggatattcttttatatcttttttccaaaaaaaaagaatcttgaatagattcatctgaagtctaataggttttgttttatattctgtttttacatactggattagtgtggatatctagaatgttaggagcctctcaagggacataactaatattcatcaatggatccttcacctttactaaatattgtccccatagtagatggtcagtaaatgtttgctgactgaataaaagcctacaagaaacagtgattaattagagtgtgactttaaaagctaatcatacaaagtatgtagttatatactttggttaagaagataaaagtttatagtttgagatgcttcttctactccaaggtcaacacactctctgcaaccatagctttatagcaaacattggactaggtatatgggaggacaggtacattttcatgaatccaaggtgaaataagaacagctgatgtgacaaaaaatcaacgagatccaggcatggtggctcatgcctgtaatcccagcacttcaggtggccaaggcaggaggattgcttgaggtcagaagtttgagaccagcttgggcaacagagtgagaccctgtctctacaaaaaataaattagcggggcacggtggtatgcacctataatccaagctactcaggatgctgaagcagcaggatggcttgagtctaggaggttgacgctgcagtgtgccatgatcacactattacactccagcagggacaacagcaagtccgtgtctcaaaagaaaaaaaaatcaacaagaaatcatagaagttaaatttatagtcattaaaattaaaaaacacaaaatagagcaatctctagttcagatataaaagtatattaaggaattcatccagaacacagaaaacaacataaagaaacataaaaatattgacactatgcatctaacaagagtgctggaactaagaggttagaggaaattttattcactccagaaatatttactgaatacctgctatgtgctgggtactattcttatattattattattattattattattattattattattattattattattgagacagagtcttgctgtgtcgccaggctggagtgcagtggcacaatctcagctcactgcaacttccactccccaggttcaggcaattcttctgcctcagcctcctgagtagctgggactgcaggcgtgtgacaccacacccagctaatttttgtattttttagtagagacgggatttcaccatgttgaccaggttggtcttgatcttgtgacctcatgatccacctgccttggcctcccaaagtgctgggattacaggtgtgagccaccatgcccggccgtgctaggcactattctaagcacttgattttgcaatgaaaaagccaacaaaaagtcctcctgagattttaattttataagatggtgggataagataataaacaaatgaacaaataagtatataaaggagagaagcaattgatactatacaaaaattaatgcataataagagaatagcaagtgacaaagaaagcgatatttgagacaagatggtctaggaaggactctcagatatagttaaatttatagaaaaactggaacgatctgatgatataagttttgcaaatatctgggagaagactgttctaaaaactggaaccacagcagataaaagttttaaggcaagaatagttttggcatacttgaaaaacaaaagactagtatggcagagaaagcatatttaaggaaatgataggtaagtattttcagaattgaagaaaaccatgagcccacagattgatagcaccctctgaaggcaaagaaatataaatttatacccaaacacactatgtgggactgaagaatgtgaaaaattaggaaagaaatcctcaaagctatcagagctatcagaaaaactaccagaaaattcagacagattgcccacaatcaagtaccagataaaggccagtaaacaaagtagagttattttgaaagtcatgatggacaaactaatccagatttttgtgaacataaaaatgcattttcaaattcaaaagtgaagccaaagtaaagacatttttcagcataaaagttgactgtttaccacccacagatgtacactagaagaaggagaaggaagaggagggaaaggagaaggaggaaagatagggatggggaggagaagaggaaggaagaggacatggggaggaagggaaatcagaaataacagtactcacagaaatgaataacatgtcaacaaattcatttaactagtaactgtaaaaaacaaattatttttatatgacaagtaaacacgattgacaataagatggaaagtaaaatcacactatgatttgcatcacatttagcaggaaaataaaaataatggaaaagcacgtaaacatttaaaactgtttagactgatacacatggtggatataacagtatttctagtagtagtaaaaagtttagttcaaagatttaaatttttaaaattataaatattgctgatttggagcctcctaaatacataacattttgagaaaaagtagattgaagtactatattagttagaagaagactagctatgttacagtaacaactaaaactctaatctcagtgctttagcctgatgaaagtttatttttcactcacgtactgtctgatgtgactagctagctcttcttggtagctttcttccaatgatgactcaacaattcagttccgctgatgttcactttgcaactcaaacattgtgaattttcttccagccatgaggttaggaaagcacagaaaacttactttatttcttaagtgcctcagaccagcaattacatatcagtttcactcacattctcattgacaagaattattcacatggccataacccaactgcaagaaagtctgtaaagagaggaacactcatagacatttgataagcattctctctgccacatttattgacagttatttatcatttcacatgaaaaagttacatatgtttctgaaaaataaatctcaaagaaagttaaaagtaactaaatctcttcaatgtgtaaatagaaatcattcagaggggaatattatggatttttggatataattttatgttaaatatattttaagtatttacaaacaatataagttagcaaaatgaatgaattcacaaattctctaataattattcagtttctcaaacctaatcatattgaataaattcaatattttagtatgtacagaaggaagaaaacaagttaaaagctttctaattgttaattcaataaccttttgtaaaataaaaaataccttttaaatttgcaatataaagtaaaattaaagctcctttagaaaaatatataaatatttatatatttctatttatatattatatatttatatattatatctatatataaagaaatatatataatttatatatatttctaaaggagctttgagatatatatatatatatatatatatagagagagagagagagagagagagagagagagtcaaacttttaagtttagaaaggcaaagcagagtttaaaccagaagcacttttgttattcgtttctctaaaatgaattgtctaattttctcagattttgattattttgatggtttgttccactttataatgtcagaaaaatatgctacatcatattaaaaaaatagaaatttagcttcaaactacctttgccattaaaaagtctttttttctatctaatatgcacataaagcactattgttttattacagctaatgaatacagttaaatggaaacatttaaagatttctttttcccttacctgggacatattttttaatgttctttcctatgataagttactatgtatattgtaacattgtgaataaatacaagttagggtttgggtgaatatattttcacacacacacctgcacacacacttaaaattttactcagactttgagacctgagtaaatctaaggctacagatttacttgttgcagaaagaaaaaaaaaaagtcactgcaaagctatggaagaagtatgaggtcaatttcaagaattaaaagtaataataataggcaaaagataaagactagaagaactgagggtttgcttttcctctcacatttatttctgtgacacaaaaatgaatatttcttaaaaatctttaataaccttaataactgagtactagtaataaaaattatcaataactgagtacagctgataaagattatgacaagtcttatgtggttatatttcatgtgctaatgctcaatatatgtaaaatttgattttaaaaatgatcagttagcaaattcatttcatgttttgtgagtaaggatgcacattactgaatttcatggttttctcatttacgtatttcaagaacaatgtcactgcatggggcttcctctgtgtccaagaaacgtactcctataaagtgcttgcttgctttgattcactgcctcagacatgttccactatatctgtttgcatctgttttttagttcaaggttaaattattcatacctgaaatacagcacaaattgctgaaaagtagggtctaagtagccaaggggatgtttatttctgtctgctgaaaatgttagacgtaaaacactgataaagtagtagaatgcctttagtttgtttccttttaaattctgaggaattgcatcagactaataatcttaaatgaattgatctgatgctttgaatattattattttgcttttatatggatgattttaaaagatgtccactctctaagtaaaattttattatgtctggtcataaaaatatgctcagaggaaagtatttcccattttataggccaagtctgtaaaaataaaaaatgaaattctttgaaatttttggaaccacgtttgtttcccaggggcagtatggaatgatggtataaagaacactggatttgcttgcaaaacctaatatgttgacattttgtgaaatagaaatattccttttttttaattttgtagctctaactttgttttttattttaattttttattattatactttaagttctggggtacatgtgcagaacgttcaggtttgttacataggtatacacgtgccatggtggtttgctgcacccatcaacccatcatctacattaggtatttcccctaatgctatccctcccctagccccccaccccacgacagaccacagtatgtgatgttcccctccctgtgtccatgtgttctcattgttcaactcccacttatatgtgagaatgtgtgttttttggttttctgttcttgtgttcgtttgctgagaatgatggtttccagcttcatccatgtccctgcaaagaacatgaactcatccatttttatagctgcatagtattccatggtgtatatgtgccacattttcttaacccagtctattattgatggacatttgggttggttccaagtctttgctattgtgaatagtgccgcaataaacataagtgtgcgtgtgtctttatagtagaatgatttataatcctttgggcatatacccagtaatgagattgctgggtcaaatggtatttctaagttctagaaccttgagaaatcgccacactgtcttccacaatggttgaacgagtttacagtcccaccaacagtgtaaaattgttcctatttctccacttcctctccagcatctgttgtttcctgactttttaatgattgccgttctaagtggcatgagatggtatctcattgtggtttggatttgcatttctctaatgaccagtgatgatgagctttttttcatatgtttgttggctgcataaatgtcttttttttttttgagaaggatctgttcatatccttcacccactttttgatggagttgtttattttttttcttgtaaatctgtttaagttctttgttgattctggatattagccctttgtccaatgggtagattgaaaaaatattctcccattctgtaggttgcctgttcactcctatgatagtttcttttgctgtgcagaagttctttagtttaattagatcccatttgtcaattttggcttttgttgccattgcttttggtgttttagtcatgaagtgtttgcccatgcctatgtcctgaatggtattccctaggttttcttccagggtttttatggttgtaggtcttacgtttaagtctttaatccatctttagttaatttttgtataaggtgtaagaaacgggtccagtttcatttttctgcatatggctagccagttttcccaacaccatttattaaatagggaatcctttccccattgcttgtttctgtcaggttcatcaaaggtcagattgttgtagatgtgtggtgttacttctgaggcctctgttctgttctattgatctatatatctgttttgataccagtaccgtgctgttttggttgctgtacactcatagtatagtttgaagtcaggtagagtgatgcctccagctttgttctttttgcttaggattgtcttggctatgcaagctctcttttgggtctgtatgaaatttaaagtcgttttttccagttctgtgaggaaagtcaatggagattgatggggatagcattgaatctataaattactttgggcaatatggccattttcatgatattgattcttcgtatccatgagcatggaatatttttccatttgtttgtatcctcttttatttctttgagcagtggtttgtagttctccttgaagagatccttcacatcccttgtaagacgtattcctaggtattttattctctttgtagcaattgtgaatcggagtcactgatgatttggctctctgtctgttattggtgtctggttttgcacattaattttgtatcatgaggctttgctgaagttgcttatcagcttaagtcgattttgggctgagatgatgtgattttctaaatatacaatcatgtcatctgcaaacagagacaatttgacttcctctcttcctgtttgaatgccctttatttctttctcttgcctgattgccctggccagaacttccaatactgtgttgaataggagtggtaagagggggcatccttgtcttgtgctggttttcaaagggaatgcttccagtttttgcccatttagtatgacattggctatgggtttgtcatacatagctcttactattttgagatacgttccgttaatacctagtttattgagagtttttaacatgaagggctgttgaatttaggcgggctgtatatcttaaaacaatcggtcagcttagtcagtcagtagtgtttgagagacctgaatagccaaattaggaaaaaggattgcaagttgatgtgagttctttgagaatgaagacagtttcccactgagtttcgttgattctttccttacttaatcttttgtttctatttgtttgagaaaacgatgtaaaacttaggtgttactattttaaacaaaaattaattacagtcatatttataactaggctaggagtaaaagatatatttagttgggggaaaactcatttttattttctaattttgagaggtatttttaaaactaagattggttttttttatgaattgtaaaaatcttttgatgttattcttttaactgaaggatgtaagaccaaaagtaaaataaaataaaataaagaacactggatttggaattgaaaaccaggatccagtgctggttttgacacttgatagcctgaggggataatggtgtaacttcctgcatctataaaatgtgaggaaaacgcattttaatatgcatagtaaactaacacagtcttccattaccaatgcttattatcattgttgctttaatatgaaagtattttcactatatcaaagttactagcataaaatcaatcatcagtgaatccattatcaatctaatcagtgtctatctggcatctttgtcttgctagtgtacccacttcctccttttggtggtataactgggtctttccttcagggaacacattctgtgatgtgggcagatttatttcttctgtagccaaaagcataagaattaattagaatgtctgtcactctggccctgggatttttctaacgtaaagaaatgttgaaaaatgttaatgctgagtagccatctcccaccaccttcaatccacaatcaacattttattatagctaatttatccatttatctatcttcctacccttacatcaatgcatcttatgttttgatgcatttaaaattgacttgcaggtatcaatacagttactctaaacacttccacacatattattgattagagtttaatatttccatgaggcagtgcaactcaaatctctaccagatatggaatgttattgtcccagaaaattgttctctcgtgccccttttcactcaatctccatctacctctctcagctgcaatcattaccagggtggttttcaaccatatattagtttttgactacagtaaagctgcaaataaatggaatcttttgtgtaagatttcttcatatgtgttaatgtgtatatcagtttatcccttatttctgagtagtattctattatatgaatatattggtttgtttacgaattacgctattaatgtgggcatgaggtgtttttggttttcagatattatcaataaagcttctgtgaacattcttctacatagtctctcatgaaagtgttttcatttctcgtgagtaaacactgagaaatgtaaagcctgtcatagggcaggtataggtttaaaatgatctcataacttttctcataataaggatataatgttatattcccactagtaatttgtagaagtttcagttccacatcctcaccatcatttggtgtgtcaacatttttaagtttagctattctggagtgtgaatattagtatctaatagtagttttattttgcctttccctgatgtctaatgatgttgagcaccttttcatgcacgtattggccattcatacaccttttttaatgatgaacctactcaatattttgcccatttttaattggcttgtttgtctttttattgctgagcagtagaacttagttatttattgtagacatcagtcctttgccagatatatgttttgcaaattgttttttctagtttgtggcttgctcatttatttcttttcttttacggttagtgcctcttaggacctgtcctagaaacctctgtctacttcttatttgaaaaggtattctcctttgctgttttctaaaagctttatagttttaatatattgatctatgatccatctgaaattaacttttctgtatgttataaatctgggcgagagtttttgttgttgctgattgttacctgatgatttcagcaccatgtgtttaaaacaaacaaacaaacaacaacaacaacaagaacaacaacaaacccttaactgtccacactgggttcctttggtgcctttattaaatgtgaaatggttgtatatatgagtctactttctattgcctcttcagtttgttacattgatctattgtcaatttttatgccagtaccacactttccttaatgtagcattataataagtcttaaagtcaaacggttagaagtcctccaaagctgtttttcttttcaagattcttttacctattcaaagtttttattttttgcatttccatataaattttaacatcttgtcaatttgtttaaaaaattatgggaactcttttggtgtggaatgtatagattaatttgggcataattatattttgtatcttgcaatccgtggaaatgatgaatctcatgacttatttagtgttctttaatttctctaagcaatttttgtagttttcagtgtaaagctccaatattgttttaaatgcattcttaagtaatagcatgtattttcatacttttatatatagaattctctaatttttgaactgctgctagtataaaaaaaatgtgatagatttttatatacttagctcataccctgtgactttggtcgtttcacttattaatcatagtagttgtgttgtcaagttcttaggatcttcttcataagcaatcatggtatctgcaagcagaattttctttctttccacttgttgtgactttatttatttcttatcctattgcgctcttaagacctccagtaaaatgttgaatagaaatgatgtgaataggtattcttgctttgttccccattataggttaaaacactcaatatatgaacatgaaatatgatggtaattgtagtttcttaatagcttctcaatttgctaagagtgttatgaatgagtgttgatcatcaaatgcttttcaacattcattgaaatgaccatgtaattgtttcttatttattctcttaatatggtgaatgataatgatttttgaatggtaagccaatcttgagcttttgtaaaacagcgaagataaacaacattatcatgatgcattgttctttttatatattactggattaatttaacaataatattttcaagggatataaaggacattaatatatggatttatatttgtaaatgttgtattaatggtattgttgccttcataaaaccaactgggaagtgttctcactctatttgatgcaagagtttgtttggattgatgctatttcttccttaaatgtttggtagccttcactactgaaaccatatgggcgtatagtttttctttatagaaatattttgataacaaatgaatatataatagatgtagagctactcagattttattattcatttcatgtttttataatatttatttttcaagaaatttgttcattgcacttatgttgtagaatttcctggcatgtggtagatattttatttttcatttcagtaggtttgggagaacaggtgatttttggttatgtagaagttctttagcagtgatttctgagattttgatgcacccatcactggagcaatgtacactgtacccaatgtgtagtcttttattcctcacccccctcccactcttcttcccgagtccccaaattccattatatcatgcctttgcatcctactagcttagctcccatttataggtgagaacaaatgatatttggttttccattcctgagttacttcacttagaatagtggtctccaactccatccaagttgctgcaaatgccattatttcgttcttttttatggctgagtagtatcccacagtgtgtgtatgtatgtgtgtgtgtatatatatatatatatatacacacacacatatatgtacatatatatcacattttccccattcatttgttggttgatgggcatttcaactagtttcatatttctgcaattgtgaagtgtgctgctgtaaacatgcgggggcaagtgtctttttcatataatgacttcttttgctttgggtagatacccagtagataccttaatattgtaccacaggctcctgagacactgtttattatgtttcaatcttttaagtttttattcttcagattggattatttatattagtatatcttcagccgccttcctttcttcagttttcttttccttcagttagttatcaccactctgctattaatcctatctagtgaatttttaatttcagatatggttctattatataatttcaatttggtattttatatagtttccatttccctactgagtatttttatttttattctttgagaacataatttcttttatgtctttaagcataattatcatagttatcttagacttctttgctattaatagttccaacaactgagtcatcttagtgttgtggagtattacctgttttttctcttaaatatgggtcacattttttttcttagtatatcatttttatttgtattttggattgttttaataaggttgtagatacttttaattttgttacttttttcctaaggagggttgattgaattcattttagtaggcatttgacttggatggactaaaactacaagtctgtctcttttcaggtggccagcaactcaaatatcagttcagttgttttaactgtggctgggttgtttggcatttaccttgtgcattcctgattcagtggtcagccagatatttgggcagaaaaaaaatacatatatataatatatatgtatataacatagtgtatatctacactatataattatatatgtatatatgtgtgtgtatatatacacatatagaaataaatgcgtacacacacacgtatagctttttttttttttttttttttactttctggctctctcctttcctggattgtcacctgcccccctcacccctcccccacacacgtttcggcagatataaccctgagccatttccttcttccaggcgttcactctccttcactctccacctgcctatttgatttttggttggtttggttggtgtttattttgttttgttttcgtctccggttcctttgtgtagctttgtttttgtactttgtttttgttttcgtctgtattcctaaatttggttgttttaataggagatgaataccataccaaaagcacaattcccacaatgtgtgtttgcatttgtcttctaagtgaactcctgaattatccagctgcgttatctacatagagagccagatcatctgtctcaggcagttctcctttgaccagatctttccattatgaaagctcagggacattaaagtggttctcaaatccctttgttaaagaactgcgccattttactaagattatgtaatttttaatcttttaatacaaaggaagaaaattttatttagcagaggattaaactattctgctatgattttgtagctaaattaaaagaattatacttaaagatttttgttctgattagtgggtagtgttatttttatattaaaaaaacagataaaatctcagtccataacttcagggacaaaggaaatataatttttaaaaattttctaagtgataaaagactatacattgggtacagtatacacaggagatgagtacaccaaaatttcggaaatcatcactaaataacttatccaggcaactaaataccacttgttcccccaaaaactattgaaatgataattttaaaaagagctcccagaaaaagaatatctaattttttttttttcttttcattgtaagcctctaccacctggtaggagaaggtaatagtaaatttggtatcttctccgttttcttcccagggagtatttccacatgctactgtgttatagatgccaaacattagagaaaataatttagtccttggttcatctgactacactggcatccattaaaagtctattatttctttggttatttgtcatctatgcatggctttcttttcatcttaaggactcctattaagtcttgttctctctctcagctaactcctgggattctctttacagcatgagttcttgttcctgtgtccagagatctgttatcatgtttctaatttcttgatgctacttaccctcaaacacatagtgcctgggtatctatctttgactattcaggcattagccctttctcttttgcctctctcctggcaccatagagtatggtaaaattctgagacttggccaggtgcagtggctcacaactgtaatcccagcactttgggaggctaaggcaggtggatcacctgaggtcaggagtttgagaccagcctggccaacatggcgaaaccctgtctctactaaaagtacaaaaattagccgggcgtggtggtgggcacctgtaatgcaagctactcaggaggctgaggcaggagaatcgcttgaacctgggaggcagaggttgcagtgagccgagatcgcgccactgcactccagcctgggctacaagagcaagactcagtctcaaaaaaaaaaaaaaaaaaaaaaaaaaaaaaaaaaaaaaaaaaaaaaggaaaaacctgagattttgctgctgcattcctgaaactccctcaggactgtaaatacctccctctccctctctttttctctctctttcctttctccaccagcccctcccacgataccatcacataccgttcactcacacagagagctaggcttcagaagccccctggaattcccaatactgatgcactccctgattctcttcctgtccctggagaaggacttcttttctagtctggcggctaagaaagctctgcctttataacaaaactgtttatactcttagtctctcaggatttagacttctgaaacccaaaagctttgctttctgaaagtgtggatgtgagaataaaaatctagcttgaaggaagtaaagttataagtttgataggaattgagggggaggaggtagtgaaaattagttaattttttggaacactatcttatcacacacatttgccctttatacatttattatttttgctattcaaataaaagtaacaatatgtattttaacagagtaattttttatttgtgcttattaagttaaatttttcttttttctatcatcttggatataataaacgaagtgtaaatatatgtatatacctgtataattacagtcaagagtttaaagtttgtattctaacttgtctcatttataatttttatgctaaagaatgtgtgatgagagacctctgtggaattttgatgcaaatgtcaaccaaaaattcttggtagcatagatcatctgtctaattcaagacctaatgctgaattattagacaaacatctctgtaaatacaagattggtttatttttatcatgaataaaggggaattctcatacagttttattttactgtcctttagaccttacagtttaatatctaaatattagacatttacattagatatataattagactatctatctgatattcattagatagcctaatggatttgtcattattgtccttctgtcactttccatgtttaaaattttcccttattattccagcatcttcagtgtattatataagaaaaacatttatcaaactgctcttagcatgagaaaacataatataccaaggaaacaggagggaatttcagaaattagaataaattaaaactttgagttaattttttgaacgagtttttatgtttaaaaatgtgccatatttgtagggtctcttgaattacctgtaatatactataattgatttcagcttgatatgtattttttaacgtaaaaaaagatttcatgtactttgaagagtctttgttatcattatcttaacaataatgtgatatttatgttttaattaccacaaaacagcaaccaccacagactaactaaaataaactttgtatagcttccatgctacacacaaactaatcattcaaagttttctcaggatgatgaaatttttaagatcatgttaaattaaccataattttaataataatttatgtcaaaacaatattttttctgtatccttcatctccgtatctataaaatgggggcagggttgactaagtgattccaagatcttatttggctctaaaagtatttgattctaataaacaatgaaataaccgcaaataccactaagtatagacaatgagtatcaaaggaataatgacgcattgctctactatataaataacctttttttactgtaatcattctttacctgctattgtgaatcagtagttttgatgttaaattgtggtgtttttaaacaaacagtatcattttattttattttattttcctcagttttatttaggtataattgacaaatgaaaattgtatacatttaaggtacacacgtgatattttgatatatgcatggattataaaatgtaacaagctaatgcctctatcacttcatagttaccttttattctatagtgagaacaattaagatctactctttaagcaacttttaagtatacaatgctttactattaactacagtcaccttaatgtacataagatctccaggactttttcatcttataacagaaagtttgttcttgattgaatggttcactgagggcacaggtgcaatgaccccacacatgcataaattttatatatgcattttagcttcttgactcagcataatctctcatctgtcctctccggtgaattcttaattactgattatttatgtctttacctgctttgtttgcaagttttgcaagaaattttgcatattattgtatgtgtgtgaatgtgtgtatagcaatgaaatcatttctgttataagcacttgatagaagcatatatctttatatcagtcttgcgatttcagagtacttttgcatatatgagcgatcctaccttattttattgcctcacattgcaaaataaccttggctgttatacttcaaggtctcaggtgttgagtcattagcagctatggaatagatcagaattatattacagctgcacaactacaaacaaaaggtaatccaagatctttcaggcttaacatcagcatatggacaactccttagcacttggctgaaagaaagttaattcgggaatttcaagctaaattccctcaggatgacttctctgaatgatttttaactcctgtaatacaaatagaaaggcatgtgaaaataaatagtatgcaattaaaacagagagcaataacacagatatttgtgtatacatcttccaaaattggtcattttataaagaatgtattttagcatatttagtttatacatgcatgcacttgggaattatttagttcactgacatcctgggtagaaactagtaatagaaacagatctatgacaatttattagaattattaagtctatacttttaaaattaagcacaaagtggcatctaccagaattataaacaagaaactgaatttcagaacatttaaatttcagaaatctgtgtggctgtctggactgttgaaaccacctcctgttcttcctgcttaaaccctctctctgcctatactcccacccatatgccctaaatccatactcctcctaataggcaaattgatcttggagaaatcagatcaaatctcctatataagaccaagaatatttttccagtgtaccttatataaattaaaaccatctctgtggactctaagtgctgtcacgactgcatctgcctcttggacttcatctttcactcctctctcctcagcattgcagccacactagcatggacatgccaagtgcatttctgctatgctcactaatccatttgcctagactgccctgcccctgcctgtggatcttctaattttttttatttaatagactttatttttagagtagttttaggtttacagaaaaattggacagaaggtataggaagttttcatataccccctctcctttctcacccccttacactatattttgtattattaacattttgcattcgtatggtacaattgttataactgatgaagtaatattgatatattgttattaaataaagtccattaaggtttactctttgtgctgttgaagtccatgcattttaacaaatgtataacatcatgcatccatcattatataacatacagaatagttttactgccctaaaattcccctgtgtgccacctatttatcccttcttcttccttcctcctaaactcttggcaatcacaaattctttttactgtctctatatttttgccttttccaggatgtcatatatttggaattatatagtttgtggcttttgcagactggcttctttcactaagcaatatggattcaaggttcccctatgtctcttcatggtttgatagatcatttctttttagcactgaataatatttcattttatggctttactacagtttgtttatcatttcacctattgaaggacatcttggctgctttcgtgtttttgcaattatgggaaagattgccataaacatcaagttttcaactcttttgagtaaacgcttagaacaatattgatgaatcatatggtaacagtatgttaagttttgttagaaattgccaaactgtttgccaaagtggatgtacaaatttgtattctcaccaacaataaatttgagttcctgttggctccacattctcaccaggatttgttatatccgcattatggattttggccattctaatcagtgtacagtagtatctcattgttgttttaatttgcaatttcctgatgacatatgatgttgagcatcttttcatatgcttatttgccatctgtgtatcttctttgatggtgtgtctgtgcagatcttttgcacactttttaattgagttatttattttcttatgattgagttttcaaagtttgttgtacattttggatataacccctttatctaatacatgttttgcaaacattttctcccagtctttagtttatctttttattctcttaacatgtcatttgcagagcaggagtttttaattttaatgaggtacagtgtataatttttttatggatcaaacttttggtactgtatctaaaaagtcgtcaccaaaccaatggtcatgtagattttcttttatttatgttctagaagttttatagttttgccttttacatttaggtatataattcattttgagttaaattattgtgagttctaataattttttattgctgtttctcatttgtattctgattttaatgttaagttctcaaaggggcctttcctaatcatcctagctaaagcagtccctcccaaccaatcactgtttgatccattattctaattttcccctagcattgccattatctaaaattatattgttctttatttattttcattcttactttttatttctctataagtcctacgtgagctgagactcagtttgttttgtttactgctctacccccagggtctaagacactacttgaaaattatttagtgaataaatgaatgaacaagaaatgcatttaacaaaactcacagacacataatgatatatgttcaagtccttatctatgagtgtctttgtaagtaacaaagacagacaactaataggaatgaaaactagggtagcgaagaggcagcaacattcaaacaaaagtattactattttgtttgttttgcctgtagcatgtattaagtccaactgaatctagaatacgttgccacaagaatgttagtaatgttagctagaatcttagtaatgttgaatgatttgcatggaagtttttcaagtcccttatctattgccaatagatagactttatttttggagcaaacctatttaaacattgtgaacagtcaacagagctcaacaaattagatatagaatgaatgttccacaacagagtaaaagccatatatgacaaccccacaactaacatcgtacctatggtgaaaagttgaaagctttttctctaagaccacttctgttcaacataatactgaaaatccaagacagggcatttaggctaaagaaagaaataaaaggtatccaaacagaaaagaataaagtgaaattgtctctgtgtactgacaacatgatgttatagaaaaaatattaaataatccaacaaaaaatgttagaactaataaacaaatttggtaaagtttcaggatacaaaatcaactacaaaaaatcggtaatgtttctatacactaacaacagactgcctgaaaaaaaaattaagaaaacagtcccaattacaaaagagttaaaaggaataaaatacttaggagtcaatttaaccaaggaagtgaaatatctgtatactgaaaaccataaaacattgatgaaaataaaaggtgtcacaaataaatggaaagataccccatgtttgtgaattgaaagaattaatattgttaaaatgtccatactacccaaagcattctatagattcaatgtaataactatcaaaattccaatgtcattcttcacagaaatagaaaaaaaaatcctaaaatttgtatggaactacaaaaaatcctgaataactaaagtaacttttaccaaaaagataaaaagctaaaaagatttttaaaaaaagattaaaaagattaaaaaatagataaaaagataaaagctggaggcactatactactggatttcaaaatatgttacaaacctataataatccaaacagtatgatactggcataaaaacagacatattgaccagtggaataggatagagagcccagaaataaacccatacatttatggtgaattgatttttgacaaaggtgcaaagatcatacaattgggaaaggacagtcccttcaaaaaatgatattaggaatactggatattcatatacagaagaataaaaataggctcttatttcaaaccttgtataagaatcaactcaaagcaggttaaagccttaaatgtaagacctgaaactataaaactattaaaagagaacataatgggaaaatatccataacattgactggtctgggcaatgatttattggatataacctcaaaagcacaagcaccaagagaaaataaagatatcacaaataaatggaaagatatcccacaaataaattcttttgtggattgaaagaattaatagttaaaatgtccatactaccgaaagcattctatagattcaatgcaatatctatcaaaattccaatgttattcttcacagaaatagaaaaaaaatcctagaatttgtatggaactacatgggcttatatcagattgaaagcttctgcacagtagggtaaacaacagagtgaagagaaaacccatagatcaggagaaaatgtttgcaactcatatatcaaacaagagggtaatagccaaaatatacaaggaaatcaaactacttaataagtagaaaaacaaataaccccattaaaaagtgagtaaaggactcaaatggacatttctcaaaagaagagatacaaattgccaacagatacatgagaaaatgctcaacatctctaattataagagaaatgtaaattaaaaccacaatgagagattgcctcacacctgttagggcaactattatcaaaagataacaagcgttggcaagcacgtggagaaaagggaaccctcatacactgtaggtggtattgcaaattaatacagccattttggaaaacagtatgaacgttcctttattgtgagatccaggaatctcagtactgtatatatatatccaaaggaactgaaatcagtatgttgaagagttgtctgcactcccatgttgattgtagtactcttcacaatagtcacgatatggaaacaatataagtgtccatcagtgcatgaatggatttttaaaatgtaatatatttacacaatagaatactattcagccttaaaaaagtaaatttgtcatttttgacaacatgaatgcaactaagaggacattgtcttaagtgaaatatctaatggcattttagtggaaaattatgtaggaccaaccatgtcatccaaaaactcaatattttatctttcggggctgaaagaagaaccaacatgactgaaaataaataaattaacagatggcatttgaatttatgataaaagtaaacaatagagaaattatggtatggcttaatgaatataacaagaggcagcaagcatctgaagggtgtgtgtgtgtgtgtgggtgtgtatgtatgtatttatttgtgtatttatgtgtcattagatataccattagcttctagatttctgcattaatacaggccatgcatggaagagctgtataaaacgcttttccctatgctattcggcagtaattttttgaaagtcagagatggctgcatgtaaatgttactaagttctaccaatctctaaaaatcacatttaataacaatttgccagactttcatttatagaaagaaacagaattatgttagaaacacaataatcagctatttgtcttttcaatatcttctgggaaaaatttgcagagttttaaaaatttaaattatcatggtggacatttatgtccttaaggtatccatgtaatatatagatagcaaaatatctttgtttcagtttaaacatgaaaatccaaaattagcatatcataatcaagggaattgcctaaggttgtctttctgaaaagaaatgacgtttaaaaatttttgttttaaaatcttatgataaaatcaatgggactttttcataacttagagaagaaaataaaacatctagcctaatgtgacctcccaaatatagaaattgaattccattttaaatgatttcttttgatctttggacatatgcctattctttgcacgattatggctggaattggtgagcatagaattgtgtgtgcacactaatgtgtgtatgtgtgcatgtgtgtgttttgcttaaatgacattattatttattttttgatcagtgaaatgtctatcttttctgaagcatgagttttttactaaatgcaataaatttagtgtacattcaatttttcaaaactatttcaatccactctatgccaaactacaaattgtaatgccataagaattatattgcatgtattttacaactccaatctacttattggaaggagggggtggtgaaacatatgtcatgtagctgttaaaggagatctttgccaggtacttctaaagaagattttaattcaggagaaaataattgcaaagcagagaaggtctgtgagaagaatctatcttgagcacttaagctgaaaccagaagtccaaacaatgacctctgaatcatgggggtcaccttgtatcctctatttatctttaaaattgaacttatcctgaaatgtttgcttaaaggcaaatgttatttcctgatcgagatcttataatgaattaatgccagagacagaacttggattaaaggaaagagaatgtcttttgacttttaggtccgttattatcaatatgtttagtttcatagcttgtctcctattggagtcttaattcctttaaaattggaatttcatcacactcatctttgtatcccttagaacaccaggtacaagatcatgcacttaaaaatgtattgacttgaataattttccagtgcagtctacttgtctacataaatattgttagcaaattagacatgaaatggtaacattattgaacattggctgcatcttaaccatcctgttaatttcatttgcatagtctttgttcaagtattttacagttcaagctttcttttggaccataatccaaacatatttaaaaagtaaaaatgaagtcctttgtgggtattttttactttcataggagaaggtgtaatttaaacctgttggttgataaaatacaaaaagtatcttgggatctaagtttttcttcgggataccaatttgagtggtctgtcactttctgcttacaacatactgtgcttatcaaactaaactccccaaaatggaactcacgagcctctatgatatggctcctgactacatgtccaactttaccttcagtcaacctatggcttctatattctcatgagtgaacgtattagctttctactcctagaatatctcaactttgccattttaggagttttcacttgctttcccatatgcctgaaatgcatatgcttgattagtcccgtggttgtctccatagcgccctacagttcttggatttaaatatcctagatatttaaatatcttgtaaaggggtgttttctgaccatcttatctataaagtagctccccatcagaggtacttgctgtcacagcacattttttatttctttcacaggatgtgtcacaataatgatcatattcagtagctgtcttctaaaacaaagtataagttccatgagtacagtaacctttttctacctttttcccgaatatacccactgcgcagaaaacagtgcccaatagaaagtaaaagtctaggaaatgatttctgaatgaaaaaacaaatatttactgaaaaactgtgacttttgagatcttaatttaagcagtaaattaatttgaagggtaaagtataattctgatacttttttgcatttttgtcttctctaaaaccaatgactagttagtatacatgttgtaagccagccaaactgcattattatttcaacaattaagactataggacataggaaattaggaagttttccaaagtagtaatggggataaaaaaagaattttttagctttgtttttattcaaacaagaaataactatattttaaaatttttccccatcaaaggtactgaatgtaaataagtcccttatgataccaagtattttttcatatctatatccattttaataattagtttatgcaaaagttcataaatttagaggtttgttggaaagttattatttctaatctcctaataagctgaaagaaaattatgacttcaaacaatatattgaaaccttattaagagaaactggccacgtgtggtggctcatgcctgtaactccagcactttgggaggccaaggcgggtggatcacctgaggtcaggagtttgagaccagcctggccaacatggaaaaccctgtctctactaaaaatacaaaagttagctgggcatggcggtgggtgcctgtaatcccagctactcggaaggctgaggcaggagaatcacttgaacctgggaggcggagattgcagtgagccgacattgtgccactgcactccagcctgaggggcaagagtgaaactatgtctcagaaaaacataaataaattaaaaaaagagaaactgtgggaaaccccccccccaaaaaaaaagaaagaaaaaaggaagaatagcaggagtctgtttttataggaatgtcatttgagcttaacagatctagaggttaagctttgaagagttttaactatatatgtgattctcataatatctatttcattcacaggaaaatcagaataattcttataaggaaatttgtgatcttaatatacagtactataatattgacaacatttcattaaaattataagtacttattggtttcctttcaaagtgtcatatctgtgccatttctatctgtatagcttttacaattataatttatatttaccaattttcctttttaacatgatataaggtatgaaagtgttttatcacttcctaattattttattatattttgctatcatctactttgctatcatctatgttctgaaatttatttatgtctcttatatctgtatggtggaaattttttttttattatactttaagttctagggtacatgtgcacaatgtgcaggtttgttacataggtatacatgtgccatgttggtttgctgcacctattaactcatcattcacattaggtatttgtcctaatgctatccctccccctgccccccaacccacaacaggccccagtgtgtgatgttcccctgtgtccaagtgttctcattgttcaattcccacctatgagtgagaacatgcggcgtttggttttctgtgcttgtgttagtttgctgagaatgatggtttccagcttcatccatgtccctgcaaaggacatgaactcatccttttttatggctgcatagtattccatggtgtatatgtgccacattttcttaatccagtgtatcactgatggatagttgggttggttccaagtctttgctatcgtgaatagtgctgcaataaacatacgtgtgcatgtgtctttacagtagcatgatttataatcctttgggtatatacccagtaatgggatggctgggtcaaatggtatttctagttctagatccctgaggaatcaccacactgtcttccacaatggttgaactagtttacagtcccaccaacagtgtaaaagtgttcctatttctccacatcctctccagcacctgctgtttcctgactttttaatgatcgccattctaactggtgtgagatggtatctcactgtggttttgatttgcatttctctgatggccagtgatgatgagcattttttcatgtgtcttttggctgcataaatgtcttcttttgagaagtgtttgttcatatcctttgcacactttttgatggggttgtatgtttttttcttgtaaatttgtttaagttctttgttgattctggatattagccctttgtccgatgggtagatcgcaaaaattttctcccattctgtaggttgcctgttcactctaatggtagtttcttttgctgtgcagaagatcttagtttaatcagatcccatttgtctattttggcttttgttgccattgcttttggtattttagacatgaagcccttgcccatgcctatgtcctgaatggtattgcctaggttttcttctagggtttttatggttttaggtctaacatttaagtctttaatccatcttgaattaatttttgtgtaaggtgtaaggaggggatctagtttcagctttatacatatgactagccagttttcccaacaccatttattaaatagtgaatcctttccccatttatttcttttttttgtcaggtttgtcaaagatcagattattgtagatgtgtggtgttattcctgaggcctctgttctgttccattggtctatgtatctgttttgataccagtaccatgctgttttggttactgtacccttgtaacatagtttgaagtcaggtagtgtgatacttccagctttgttctttttgcttaggattgccttggcaatgcagacacttttttgtttccatatgaaatttaaagcagttttttccaattctgtgaagaaagtcattggtagcttgatggggattgcactgaatctgtaagttaccctgtgcagtatggccattttcacgatattgattcttcctatccatgtgcatggaatgttcttccatttgtttgtgtccccctttatttcgttgagcagtagtttgcagttctccttgaagaggcccttcacatcccttgtaagttggattcctaggtattttattctctttgtagcaattgtgaatgggagttctctcatgatttggctctctgtttgtctgttattggtgtataggaatgcttgtgatctttacacattgattttgtatcctgagactttgctgaagttgcttctcagcttaaggagattttgcgctgagacagtgagctttctaatatacaatcatgtcatctgcaaacagggacaatttgacttcctcttttcctaattgaataccctttatttctttctcctgcctgattgccctggccagaacttccaacactgtgttgaataggagtggtgagagagggcatccctatcttgtgccagttttcagagggaatgattccagtttttgcccattcagcatgatattggctgtgagtttgtcataaatagctcttactattttgagatatgttccagcaatacctagtttattgagagtttttagcatgaagggctgttgaattttgtcaaaggccttttttctgcatctattgaggtaatcatatggtttttgtcattggttctgtttatgtgatggagtatgttcaatgatttgcatatgttgaaccagccttgcatcccagggatgaagctcacttgattgtcttggataagctttttgttgtgctgctggattaagattgccagtattttattgaggatttttgcatcgatgttcatcagggatattggtctaaaattctcttttttgttgtgtctctgccagtctttggtatcagaatgatgctggccttgtaaaatgagttagggaggattccctctttttctattgattggaatagtttcagaagcaatggtaccagctcctctttgtacctctagtagaattgagctgtgaatccatctggtcctaaactttttttggttggtaggctattaattattgcctcaatttcatggcctgtgattggtgtattcagagattcaacttcttcctggtttagtgttgggagggtgtatatgtccaggaatttatctatttcttctaggttttctagtttatttgtgtagaggtgtttatagtattctctgatggtagtttgtatttctgtgggatcagtggtgatatccgctttaccattttttattgtgtctatttgattcttctctcttttcttctttattagtcttgctagcagtctatcaattttgttgatcttttcaaaaaaccagctgctagattcattaattttttgaagggttttttgtgtctctatctccttcagatctgctctgatcttagttattttttgccttctgctagcttttgaatttgtttggccttgcttctctagttctcttaattgtgaagttagggtgccaattttagatctttcctgcttttgtgggcatttagtgctataaacttccctctacacactgctttaaatgtgtcccagagattctggtacattgtgtctttgttctcattggtttcaaagaacatctttatttctgccttcatttcattatttatccaggagtcattcaggaggaggttgttcagtttccatgtagttgtgccattttgagtgagtttcttaatcctgagttctaatttgattgcactgtggtctgagagacagtttgttgtgatttctgttcttttacatttggtgaggagtgctttacttccaactatgtggtcagttttggaataagtgggatgtggtgctaagaagaatgtatattctgttgatttggggtagagagttctgtagatgtctattaggtccacttggtgcaaagctgagttcaagtcctggatatctttgttaatcttctgtctcgttgatctgtctaatattgacagtggagtgttaaggtctcccattattattgtgtgggagtctaagtctctttgtgggtctctaaggacttgctttatgcatctgggtgctcctgtattgggtgcatatatatttaggatagttagctcttcttgttgaattgatccctttaccattatgtaatggccttctttgtctcatttgatctttgttggtttaaagtctgttttatcagagactagaattgcaacccctgcttttcttttgctttccatttgcttggtagatcttcctccatccatttattttgagccaatgtgtgtctctgcccgtgagatgggtctcctgaatacagcaccctgatgggtcttggctctttatccaatttgccagtctgtctcttttaattggggcatttagcccatttacatttagggttaatattgttatgtgtgaatttgatcctgtcattatgatgtaagctggttatcttgcccattaattgatgtagtttcttgctagcattggtggtctttacaatttggcatgtttttacagtggctagttctggttgttcctttccatgtttagtgcttccttcaggagctcttttaaggcaggcctggtggtgacaaaatctctcagcatttgcttctctgtaaaggattttatttctacttcacttacgatgcttagtttggctggatatgaaattctgggttgaaaattcttttaagaatgttgaatgttgtccctcaaccctcttccagcttgtagagtttctgcagagagatctgctgttagtctgatagttaccctttgtgggtaacctgacctttctctctggctgcccttaacattttttccttcatttgaaccttggtgaatctgacaattatgtgtcttggggttgctcttcttgaggagtatctttgtggtgttctctttatttcctgaatttcaatgttggcctgccttactaggttgggggagttctcctggataatatcctgcagagtgttttccaacttggttccattctccccgtcactttcagatacactaatcaaacatagatttgttttttttcacatagtcccatatttctcggaggctttgttcatttctttttactctgttttctctaaacttctcgctttatttcattaatttgatcttcaatcactgatagcctttcttccacttgatcgaatcggctactgaagcttgtgcatgtgtcacgtagttctcatgccatggttttcagctccatcaggtcatttaatgtcttctctacattgtttattccagttagccgtttgtctgatcttttttcaaggtttttagcttccttgtgatgggttcaaacatcctcctttagctcctttagcttgttattaccgaccttctgaagcctagttccgtcaactcgtcaaagttattctctgtccagctttgttctgttgctggtgaggagctgcgataatttggagaagaggtgctctcgtttttagaattttcatcttttctcctctggtttctccccatctttgtggttttatctacctttggtctttgatgttagtgacctaccaatggggttttggtgtggatgtcctttttcttgatgttgatgctgttcctttctgtttgttagttttccttctgacagtcaggtccctcagctgcaggtctgttggagtttgctggaggtccactccagaccctgtttgcctgggtatcaccagcggaggctgaagaatagcaaatattgcagaacagcaaatattgctgccttatccttcttctggaagcttcatcccagaggggaacccacatgtatgaggtgtcaatcagcccctactgggagatgtctcccagttaggctacacaggggtcagggacccacttgaggaagcagtctgtccgttctcagagctcaaacgctgtgctggaagaaccactgctctcttcagagctgtcagacagggacgtttaagtctgcagaagtttctgctgccttttgttcaactatgccctgcccctagaggtggagtcaacagaggcagcccaccttgctgggctgtggtggggtccaccagttctagcttgcctggctgctttgtttacctactcaagcctcagcaatggcggatgcccctccccctgccaggctgctgcctcgcaggtcgcaggtcaatctcagactgctgcactagcagtgagcaaggttctgtgggcgtgggacccaccgagccaggcgcaggatgtaatcccctggtgtgctgtttgctaagacggttggaaaagcacagtatttaggcgggagtgccccatttttccaggtacagtctgtcatggcttaccttggctaggaaagggaaatctcccaacccctggcacttcccgggtgaggtgatgccccaccctgctttggctcacccttcctgggccgcacccactgtccaaccagtcccagtgagatgaaccaggtacctgacttggaaatggagaaatcacacatcttctgcatcaatcatgctgggagctgcagaccatagctgttcctatgcagccatcttagaaccggaccacatcctctttcaaggtatgaaagattattgaccttattttgtctaggtggaggaactgtatcatacagtggtatatttgagctactgtgggactgatctagtccttctataaagagactatctaaatgccttataaatcttgatatttttctaagaagcactatctttgagaaaaaacttattttctggtaaataaaatgaggaaatatgaggggcaaatttgagagccttcatctttcaattattccctttaaagctcccatttgattttggattatgccacggtgaatgcaaacaaatcccacttttcaaatggaataatttattttcttaatgtttgtgtttcaacctaaaagaattgtttttatacctacatttgaaacttcagaaaacaagattcacagaataatgaaaaactacattttaacctaaatgtggaactgtgattacagacattaccgcaagcaagtgattcaaacaccacttttcctgtgtcatcttttaaacaccactgcagattttttattttgaacatgtacttggcttctgcttctatctaagttagaggaacagtaattggatgtacccttgtgcctgaaacaataacaagcaacaacaaaaacaaacagaatatatgaaacaagcttttttttttttttttttgagtctcgctctgtcttcaggttggagtgcagtggcacgatctcagctcactgcaacctccgcctgccgggtacaaacgattctcctgcctcagcctcccaagtagctgggcctacaggcatgcaccacaatgcccagctaatttttgtatttttagtaaagactgggtttcaccatgttcgcaaggatggtctcaatctcttgaccttgtgatccgccctcctcaacctcttgagaaacaagcatttttttaaaattgcaaaacactaggcaataaagtagaaggaacccagagagatgaaaaacacagtgctacatttgcatcattttcctgctttcagagaatttctgagccacaactcgagaaaggagagcccagatggaaattgatgaactctgtaaggtaaggaaatgaaaatgagagcacagggacagcaaggcttttggaattcacagaatagagctctggagaggagaaagatacagaaggaaccccaaatatttgcataaggtactcctcaagtattcatcagagtactgatcaggacatgcatgtgaggaaactgacatttgtagtaccatccatcaatagcacaacacatattcatttcaagtatacatgaaacattgaccaagatatatactaagccataaaataagtcttagtgaattttaaaagattcaactcacacaatgtatttctctaactaaaacaggatagacttaaaattcagtcagtccccaaatatttgaaaatcaaaaaaacccatggatcaaagaagaaataaaaaagtattttgaagtgaatggcaatgaaaatacaaacataggaaaaactaaggaatgatgctaaagcagttcttaggaatttacagcactatatgctgacattactgaagaaaagatgtctcaaattgatgacaccaacgatcactttaagacactagaagacatgaaaattaactcaacatagcagaaaggaaagtataaatagcaggacagaaatgatcaaatagagatgatgtcggtaatgcaatgttggtttaatatttgaaatcagacaatgtaattcaccatgcgaactaaaaaacatgcagaaaaaaataaagaagacatagagagctatacttgttcatcaacagaagactcaaaatgattaagatgtcaattctccccagacttatctatagattaaatacaatgccagttcaaatccttgcaggtcttaactgaagaaattttcaagcttattttaaaactcgtatggaaataaaaaaatatagaatcactataacaactttgaaaaagaacatatttggagtagtaacactatctgctctcaaggtttattatgatgctacaataatcaagactattggactggcataaagaaataacttggtcaaagaaacagagtagagattacagaaatagatccacatatgggcaactgttgttcgttttttttaaatttatcgtctttctgaaaaatcttcatagaaaactatttggtttagctctcagtagcctgcccctgagctgtgaggaagcttgccttcttttgagctacctgatctttcttctgagcaagggacattttgggatggttctatctcttttaacttatttcctgggcgtcttctcatagactagattctctcatatagcagcatgagctttcttatacatctcctccatgtctagagttatgccgttctttatatattgagaggattgtttcttgtaagcatcttcatcttcctctacttagtagcacatgtaatctgcgacattctggctgataatgtgcttccagtgtacttctgcattaaattccttgctttcagaatcataaccgggaatcgtttggtactgtaagggatagacaaacctccattcacagctccctcagggcgccagaaactttattgccagtagtagttctggcaaggccttcatctccagtcacctccacttggccttcatagatcttgtccataccaaacctattgagaagcctgtggtccagcagcaggccagtacaatacgctgcagcgtaatttgtcaagccaaccttcacgccatattttggcagttcatgtgcatatgctatgcagactatcatatccccttctatacaggcataagcaatatgacaaatgatatctgttacactatcatcctgtatttgggtgtttcctatttatttttatcctgtatcaccaagcgtttctgagcatagtaatcaattttaccgtcccattgtcttctaaatttcacttggtgtctcttaaagtaggccttagtcttaacaactttaatgaaccacatcctgcagagcaaatgcccacgtctgcggcttggcagagacttctaggctcagcagcgctaggtggggaaaagagggagcaactgatttctgatgaagttgatgacagggaggaacgggaactctcacacactcctggtgggaatgtaaaatggcatgactcctacctgtttggaaaatagtttaacagttttttagaaagtttaatatatacctacctatcatatgactcagccattatactcctaagagaaacaaaaacatatgtccatacaaagacttgtacccaaatattcatagaacctttatattcaatagtcaaaaactagaaataactcaaatgaccatcatccaaattgtagtatgtccatacaataaaatgtaataaactactgataaacacagtgtggatgaatctagaaataatgatactgagttttaaaagctagtcaaaaaacagtatatatggtgtgatcccatttatatagaactcaaaaaaatgcaaagtgatctgtataactgaaagcacatcagtggcttcctgtagagaggattgcagtgggttctaatctctcattataaaggagaacaaagaaactttcagaggtgatggatatgtttactatcttgattgtgataaaggctccagaagtgtatacatgtgttaaaacattgaattgtacactttatatgtgtacattttattgcagatcaattatactttaacgctgttaaaatatgaataaagcacgttttaaaacatttagaaatccaaaatatcataaattaaacataaattataaatgatgtagattgaatcaattataataaaattacttaaaaaagtgttatcagaaaaaaagaaaatggtactctactatggtcacaataaatctaatgaggagaaatatttaataacactgataaacactagtggattttgttcctggttcaaatctgtcaattcagtatttcctaagattaatattaatttattgtataaaacatttgtgtttagtcaattgatagactgattatttcttctaaatacagaggaagctttatctgggaattgcattatttcctagtgattcttactacctattctaataggacacaatttcacagatatattcttcttgatttttgactaagattttaaagaaataccgtcttttaatttttgattaatttttttctacaatcttagaatgaaaattttggagcagaaaagaccacagaaacctttgtaatatatctcctcaatatataaaagccagaagtgagctcaatttaaatggctaacttaggatatgaggagtaattggcaacaagtgctggaaccagatttcaagtctcataatatccagtccaaaactgtgagacactatgtaggtttcttcaacttgacatattatgtatgatagcagagtggattttctaaataggtggaagaagcctttaccttcgactgacagatttgctgagaaaagacaaaaaggatcacagcaggttcagatgaaaaattgacaggagcctccacctaactctgatactgactcagcatgagatatatagatgacagcaaccaatactctaaaaaaattatatatgtaagaaaagatgcagcctagcaaacacataaaagtatataactgtgataattattaataattattaataattgcagggcccaccagtcttctgtcagtaaattgattgtacacaggtttactgcctgagtaatttgtttatcttgcctgcatcagttattttgttgaattatcatcataataacgtgtgtgaaccagtcttcttaaaagtgtaaagactttggtctcttcttgttgatttatagtttagtcatgacagcagcaacaaccaccacaaaaataatagcaaatacttatagggtgttaaatacatgccagccccatattagcactgtataacacttcacatattcccactcctttaaatacttcaggtatttctaaatacattacatatcttaacttctttaattgccacaaggcctataagtttgatgctatttttacccctaatttacagatgtggaaacagaaagatccattaagttatggagcaagaaacactctggagataatactctaaaccactgttttaaactgtagaattaactttacaaaaaataaaaaaataaaaagctttagccaaaatttagaagaaagattgtactccaaactaatgctttctgctgatattggcagaatttttgcttgctgctctaatagttttctgtttaatgagcaaattgctttaagtacacatataacactgcggcattaaggataaagatattcagccaattcctttctcatctgtgatagttctagctctgcttatttgtacaatagcactttgaatttaatctttagaaaaaacacaagaaattgacattataaacttctttaaattaccagtgaataaagggggcaataaaatcagtaatttattaaataaagcacaatggaagcattcattaagatgtcatgaaaatgctaattaataatcaaaacgtatcctattgatttgagagcttttcagttagacttccagataacatctagaaataagcactgtacattcttaagtagagatttcatgactaggtcatatccttatatagcacccctcttttggggtgtaaggaaataccctgcagtgaatatcctctgaaagagactgcgttatgagaaaaaacacaaagattatcttctaggtcactaacaagggctgattattttatgtcagtcatattgctcttcttttttcctttttgtcttgataaattgtatcagctctccaaaacccagcttatctcatccctttaatttcctttagtttgatttgtttcttccttaactttccagaacattgaggtctatacatagcatctagcaccaatttatatagtatttctccttttggttattgattctaactacttggttgagcattaaatattataatatacaccctactggtggtgcatctgtctcatgtttctctagctccacgcacctatcaaagaactacaggtaggagaccctcaggagcactctgctccttttgtccactgaaaagaaaaagtgtatattcatttggaggtctttgcgcagtactctgttgagatctacagatgcagaaagttaagagtacagctaaatattatgtaagttgaaaatgattggtgcattcattaggtaagaaagtcttttagtttttccaatctagtcaaacttcattaccaaattatcttttatccaataaactcatttttaaggttgaataatattttactctgtgtgtgtgtgtgtgtgtgtgtgtgtgtgtgtgtgcatatgtatttgtgtgtaaccacattgtctttatccattcatccactgatggacacttaggttgatttcatgtcttggctatgatgagtaggaccacaatcaacagatgtacaaatgtatctttaatatactgattttctttctttggatttatccccaaaagtgagattgttggctctattatagatctatttttatttttttgaggaacctccatactgttttccataatggctgtaccaatttactctcccaccaactgtgtacaaaggttctctttcctcatattcttgccaatatgtatcttttatctttttgataatagacaatttaacaggtgggagatgatacctcattgtggttttcaatagtatttccctgatgattagtgatgacagcaccttttcatctacctgttggccatttgtttgccttccttggaaaagtatctactcaggtctgttgctcattgtttaatcagattatttgaggttttgttttttttcaactattgagttgtaacagtttcttacatattttggatattaagcccttatcagatgtatgccttgcaaacattttttcccaatccatgagtttctatttcattctgttgattgtttcatttgctgttcagatgaaaaactaacgaaacccactgaactactaaactacttaactactaaaactgctagccgggcgtggtggctcacacctgtaatcctagcacattgggaggccgaggtgggcaaatcacaaggagttcgagaccagcctggccaacatgatgaaaccccatctctactaaaaatacaaaaaattagctagatgtggtggtgggtgcctgtaattccagctactcaggaggctgaggcaggagaatcacttgaacctgggaggcggaggttgcagtgaaccaagatcacaccactacactccagccctggcgataatgcaagactccatctcaaataataataataataaataaataataatgaaaaaactgctaaaaagcagacgcttttagtttgatgcaatcccactttcctagttttgcttttgatgcctatgctttcactgtcatagccaaaatgtcatcgtctagaccaatgttaataagctttttccctatgttttcttctagtagttttatgatttttggaaatatgtgtaggtcttattccattgagttaacttttgtacatcacttgacattatgcaaagtgaagtaagccagacacagaaagataaatactacattatttatttctatatggaaccaaaaatatttgaactcaagaagcagagagtagaatggtggttgctgggctgtggtgaacggagtaagggggagatgttggtctggggatacaaagtttcagttacgcaagatgaataggctctggagatctaacgtacaacaatgtgactatagttaacagtactgtattgtgtacttgaaatttgctaagctcttattaagtgttctcaccacacacacacaaagaatcttcagggatcccaaaaagtttatatgaatgcttatgtaatttatttctccaaaatccatgtaaaaccccaataatactataaatgactaaataaatagtgtataaaaaaataacagaggctgggcgtggtggctcacacctataatcccggcactttgtgaggctaaggtgggcatatcacttgaagccaggagttggagaccagcctggccaacctgccaaaaccctgtctctactaaaaatacaaacattagctgggtgtggtggtgcacaactataatcccatctacttgggtggctgaggcacaagaatcacttgaacccaagaggcagagtttccagtaagccaagatcacaccactgcactccagcctgggcgacagagtgagactgtgtctcaaaaataaacaaataaataaataaaataaaaaataacagtgataacttgttctgatattctctggctgcattagaatcactaaaaatgattgacctatgaaattattaatgctacccatagtaggctaatgatggatcacttccatgaatctcatcttcctcgtctcttaatttgaattgtaactgccatgaaagaccttttctaattattttaaatttactgaattagctgtgaattaagactgaaaagatatatttggagattaataaagttcttcaggaaaggtattttatttacatatttattttggtataagattccctacatcttataattacaccatcagaaacacaaacctaacttacctttcctccttgcatatttagcaaatgccataatcatgcatggcctgttactttctgaaccatttcctattgattatatccactgaaatgttgacattgaatgattgctgaactctatctgtacaagcactgaaagtatttgaaagtagaaattactcttcaaatttcatttcttttatcttttctgttataagaacttatcagtgatttccttctgtatcccattatagaaatggcatcatgaaataaaatataagctgacagttctcagatttattattgtatttgatatattgacatttttaaagagtggtgctctgtagttaaatgaatccaaagagattaaatctctttaaaaggagtcagtcctctaagagtggaattttcttgccaatgcagcttgatcagaccatagttgggggtgggctttcagaaattgcaacacttttcatctgctcatctatttgaggcagtattatttttttgagtttcaatatcttaaaatactgatttttctatcaatcattacaattgaatgcattcacattagttgatttctatgaaagtatcaatatcaatagaaaattacatcttggaaatggatttgactcatgtacttgaaaaatcagtgtgtgaggaaatttaaaagtccagttttcattaattttagcacaaagtgttttattgaaacaaaatgcttcacctatctgtattttagtatttgttacatatgtagaataggtaatgaccaagtcaggtgattttgggtatccatcaccttgagtatttatcatttctatgtgttagtaacacgtcaagtcctctctcctagctacttggaaatatacaatacatttgttgctaactataatcaccctactgtgcttttgaatattggggattatttcttctatttaactgtatacctgtgcccactaatcaaccttggtttaccgccccccccaatcccacccttccaagcctctggcatctataattctattctctgtctccatgagatcaacttttttagctcccacgtatgcatgaaaacatatagtatctgttgtgctgtgtctggcttatctcacttaatgtaacaacttccagttccatccatgttactgcaaatgccctaattttattatttttatggccaaatagtattcctttgtgtaaatatactgtatttttaaaaaatccacttatatattaatggacaattatgttgattccatatctttgctattgtgaatagtgccgcaaagacatgcaagtgcaggtaggtatccctttgatacacatatttctttttctttggataaatacccagtagtgggattgctgaatcttatggtagtattatttttgattttttgagaaatctccattctgtcttctatagtggttatactaactttcattcccaccgacagtgtatgagttcccttctcctcacatcccgatcagcatctattaaattttttttgtctttttagtaagagccattttaactgggataaagtaatatctcattgtggttttaattttcatttccctgctggttagcaatactgagtattttatcatataccacttgatcatttctttttgagaaatgtctattgtcctttgcccacttatttatttatttatttatttatttatttatttgagacgttgtctcgctctgtcacccaggctggagtgcagtggcgcgatctcagctcactgcaagctcagcctccccggttcacgccattcttctgcctcagcctctcgagcagctgggactacaggcacctgccatcacgcccggctaatattttgaatttttagtagagacggggtttcaccgtgttagccaggatggtctcgatctcctgacctcgtgatccacctgctttggcctcccaaagtgctgggattacaggcatgagccaccgttcccagccctttgcccactttttaataggatttttgttgttgttgatgagttgttttgagtttcttgtatatttcagatattagcctcttgttgcatgaatagctggcaaatattttctcccattcaacaggttgtctcttcactcaacggattgtttccttgctatgtagctttttagtttaatagtcacatttgtctatttttgttatagttctctgcgcttttggggtcttagccatgaaatgtttgtaagattgatgtcttgaagtgtattttctgtgttcttttctagtatttttacagttccaggtctaatgtttaagtttttcatggatcttgagttaatttttctatatatagagagcagtccagattcattattttacatatgtacatctaattttcccagaaccgtttattgaagaggatgtcctttaccagcatgttcttaatgcctttatcaaaaataagttggcaataaatatatggatttacttctggactcactgatccattggtctatgtgtctgctcttataacaaaaccatgctgtttgtttgggttattatagccgtctaacatattttgaagttgggtagtgtgaagtcttcagctttgttcctttggctgaggattgttttggcttttcttgctcttttttggtttgatatgaattctataattttttttaattctgtggaaagtgacattcttactttgataggaaatgcataggatctatagatgctttaagcagtatgaaaatttaacaaaattgagtttcccaatccataagcctgggatactgaactgtagttttagtttgttgttgtgtctttgtctggtttggtacctgggtaatgctagcctcatagaatgatttagggagagttctcacctcttcaatttttttgaatactttcaggagaattggtattagttctttatatgtttggtagaatttggctgtgaattcatctggtcctgggattttctttgctgggagacctttcgttactgattcaatgtcactactcacaattggtatgttcaggtttttttttactttttcctaattcagtcttggtaggtgtatgttgtgaggaattcatccatttcttctaggttttccagtattttagcatatagttgtgcataatgatctctgatgatcttttgtattttgttggtatcaattgcaatgtttccttttctgattttgtttatttgggttttttctcttcttcacagcaatattggcctgtaattttgttttgttttgttgaatgtgtttttttgaatctctatgtcattgagctctgatctgatatttactatttctttccttctgataattttggatttgacttacccttgctttcctaattccttgaggtgcatcattaggttgttgattataaatctttctactttttaaatgtaaatatttactgttataaatgtcccttttagcactgcttttgctgtctcccacaagtttgggtatttttgtatttccatttttatttatttcaagaaattttttgatttccatcttagtttcttcattggcccaatggttggttatccagaagcatgtttttaatcttcatgtatctgtatagtttccaacgttcctcttactgatttctagttttactctattgtagtctgagaatatgcttagtgtgatttctattttataaaagatttgttaagacttattttgtgtcccaaactatggtttatcctgaagaatgttccatttgctgatgagaagaatgtatattttgtaattttggataaaatgtcctgtaaatgtctgttaggtctatttggtcaaaaataaagtttaaatctactgtttctattaaaagtgcaatttaaatctactgtattaacattttccactattattgtattgaagtgtacctctctctttagatctggtaatacttgatttatgaatttgggtgatttagtgttgggtgtatatatatttagaattgttatttcctattgcttaaacaatctctttgtcattatataatggcctttgttttttctttactgtttttgacttaaaattgattttatgtgacataagcatagctactcctgctcgcttttggtttccttttgtttggaatatctttttccagcacttcactttgagtctatatatgtctttgtaggtaaagggtgtttcttgttagcagtatatatttagatcatgtttctttttttttttttttttttttttgagacggagtcttgctctgtcgcccaggctggagtgcagtggcgggatctcggctcactgcaagctccgcctcccgggttcacgccattctcctgcctcagcctcccaagtagctgggactacaggcgcccgccactacgcccagctaattttttgtatttttagtagagacggggtttcaccgttttagccgggatggtctcgatctcctgacctcgtgatccgcccgcctcggcctcccaaagtgctgggattacaggcgtgagccaccgcgcccggcctagatcatgtttctttatccattcaaccagtctatgtcttttaagtggagaatttaatccatttacattcaaggttattattgatatgtaaggtttacttcctaccacattgttgtttcgggttgtgttgtatattttttgttcctttctttttcttctttcatttgctattgtggttaggtagttttctgtagtggtacaatttgggttgtatctcttcttcatttgtgtgtttggtttatcagtaagttttatactttcatgtgatttcatgatagtaaatgttgtcttttcgcttccagatttaggagtcccttaagcatttcttgtagggccagtgaagggccatcagtgtttgcttgtctgggaaaaacttcatttcccctttattgatgaagaataattttgctgtgcatgatatccttgagtgggaagtttgtttttttttaaagcactttgaatatgttattccattttctcctggcctaacaggtttctgctgagccccagtgttagtctgatgggagttcctttataggtgacaatatgtttttcttgctgttttatatagttttctctttaatactgactttagatggttggactataatatgctgtggataatttttggtattgtagctgtttggggatcactgggccttctgtatctggatgtgtaaatctgttgctggacttggaaagttttgatttattgtttttttaaataggatcttaactaaactcttgttttctcttcaccctcagggacattgataattcaatttcaaaacacccatattcaagttttgagattctttcttctgcttaatcttgtttattattgaagctttcagatgtatttttatttcatttaataaatttttcattttcagtatttctgattttttttaaataactattcggaaaatttctcattcatatcctgacttgtttttctgatttctctgtattgctttaatcatttttatttatctttctgagcttctttaaactcagcattttgaattacttttctgggaattcatggatttattttgattgggatatgttgttagaaaattatatttttgggaggtgtcatatttccttgctttttgatgcttcctgtatcctcacattgatatctgtgcatctggtgtagtagttgcttcttccaactttttaaacttacttttgcagagaaagacattttcctgaagatttatatatgttgttggttgggtagagaactttggcctcaattttgagtgcatgcgatattgtagtatctgtgatttcatcagctgtaaagtgtcagtggtatctttgaattcctcggtggcttagggcttagaacacagttattagtgaagaatgtggtaaagtcttactggggacgaggatgctggatagtccagtctttgagtcccagtggtggtagtggtgggctaagcatgccttaccttgagccgtagagcaatgtatgctggctctggtgttagcacattcaggcaggccaattcttgggcccccagatggctttctcagatgccagtagtggcagcagtaggccaggcttgtgtgtgggttcttgggcctctgggcagtggtgtggtgtgcataatggcataagcagtggtagcacaactcagtggaacaccaattcatgttggtgttggtgttgtcagtggctgcaacaggctggatgggcaagtcccttgacctgcagctggctcatatgggttagtgtctgcagtggtggtattggtaggttggataatcctgacctcagaccctggcagtagtgttcaagtgccagtgatggtgagctggtctggtaatccctaggcctttggaatgtgtgcttgggtactgttcagatgaaagctggtgagcagatttgtcatcaggacccctggtagtatgttcaggcactacgtatgataggcagaggcagaatactccccaggtcactagcagaatgctcaggttgggacagcagtggctgtgttatgagtctgcttctggggaggctggggccactctcattgggagcagcctaggaaggcagctgtggagctcatggtttgcttatgcactggtcctgcagtagcagcagtggtatttctccttgggacatgtgaaagttcctggccttccatctccctcctgtggcagctctggtagcagtggccccagggcagaatgcaggcctttgaagactaagctttctgaatggtaccagctatgggcctacaaccagggaaggtggggccactctcaatgacagcaacatagacaggcagctatgggacatacagttgcctcatatcttagtcccacaacagcccacagcagcagcagtggatttgttctttgggtgtatgaaatgtctggcttcccttatctctccctggactgactgtagcagtagcaccatcagctccagggcaggatgccgtccttttggaactgagctctcagaatggtgccatattgcagctgctcaaggctgagaagactgtgaaacccagcatgagctccctctcttaagcggtgcctctgcgcaatctgtaggcagctccctatgttagtttctaggctcgtgggtgccgaggggcttgctcttggctaagattgtgtaagtccatggcaggaatgtggagccctggggatcacacattttccctttccctgtgtctgggagcttcttccagctcccagtcaatcccaactgagaaggctgcctcatttccctttcattctttgactttgttgcttccaataatttctctgttgaatattggtgttctcttatagatgactcatttgaactatgaatatctacttgccattttggtgtcactttatggagaggcatataatagctgcatctagtcaaccctcttcccttatgacagccaaaatattattaattgaaatgccaactgtacttattaaagagcctagatctgtgatgagcagtgattcatgatttgccactgcaaacttgccatctatcaaaccttaactatagttaataattgaactttgttagcagcaagtcatgaatttagtcataaggactccaaagattatctgatatttgactatgtatactcaatctttagctggctttaaataacctgctttatgtttataggtgtcttccccaaagaagagagtttatcaaacaaaacataataatgctggtgatcttaatgcctctcccaatatgtttttctgatgccactacacatctagctagatttgactctttagtatgtagccaacattaatgactgttctaatacacacttgatttttatttcacagaatacaaaattcttgatttattggaaaagaatgataatgcctgtatccctgtatgagcacttgctctagccacggtcacagtgccatctgtctagggtctggggaatttaggcccattgatcatttggagaggttgaggagtaaaataaatagtacccagctctatcatcaagaggttagtgctcaggtctaccacttcactccatttttgataccagaatctctgctctcatcaccatcttctgacaagtttgaagtctggcaaccaaggagcaaaagtgggtggggcattattcaactaatggatccatgagataacttctttatcaatgcctgctttgttatacagcgaactctctgctaacactcataccatgagaaatgattttaacaaaaccctaaacttactccacactctaatgaaacagtttttgctagctagcatttattaagcgtatttttttaatcttactcacaataaataatttataccaacaattggtactcaaggaattttgaataccctccctccctaagctctccttaattggaacagaagggatatgaaggccagggacagtggctcatgcctgtaatcctagcactttgggaggccgaggtgggtggattgctttagccaaggagtttgagaccagcctggctaacatggcgaaaccccatctctactgaaaatgcaaaaattaaccaggcgtggtggcacatgtctgtaatcccagctacttgggaggctgaggctgcagaattgcttgaacccaggaggcggaggttgcagtgagctgagatcaagccaccgaattccagcctgggccacagaacaagactgtctcaaaaaaaaagggaaaagaagggatatgagattggaccagctgctctgttatatattacatattcacaaaccattttcttagccaccttcagttaatgtatttttaatttttatctttttaaattttagattcaggggatatatgtgcatgtttgttaagtggatataatgcataatggtgaggtttgggtttctagtataccaatcacccaaagagtgaacattgtacccaataggtaatttttcaaccctcatgctcctcccatactcccccttttcagaatcctcagtttctatcatttacatctttatgtccatgtgtactcatttgttagctcccctttaaaagttagaataagtgatttatgatttttatgtttctgagttatttcacttagaataatggcccccaactttactcatgtagctacagaaaacataatttcattcttttttatggttgcatagaattccatagtgtatatatgtttaatcctatcatccattgatgtgcacttaggttgatttcatgactttgctattgtggatagtgctgcaataaacatgtgagtatgggtgtcctttggatataataacttcttttcctttgggtagatagccagtagtgagattgctgggtcaaatagtagttctatttttagttatttgacacatcttcctactgttttccgtagaggttttactaatttacactcccatagtgtacaaacattctcttttctccacatccacaccaacatctgtggttttttgactttttaataatagccactctgactggtgtgatgtgttatcttattgtggttttaatttgcatttctctgatgattagtgatgtttaccttttattacatgtttattagccacttgtatgacttcttttgagaagtgtctgttcatatcctttgcccactgataatagtttggatgtatgtcccctctaaatttcatgttgaaatgccatccccaatgttggaaatggggcatagtgggaagtggttgagtcatggagacagatccctcatgaatggcttggtgcacacctcacagtaatgagtgagttctgtctctctctgagtttacacgagattgtttaaaagaatgtggcacctccccattctctctcttgttcactctgtcaccatgtggcatgctggctccccttcactttctgccatgattgttagctcactgaggccctcaccagaagcagatgccagcactatggttcatgtatacccagcagaaccacaagccaaataaaattgttttcttaataaattacccagtctcagtttttcctttatatcaatgcaaacagactaacacatgtactttttaatggggttgtttttgttattgttgttgagttttttgagtcctttgtagattctggagattaatcttttgtcggagtcataatttgcaattattttcttcaattctgtaggttgtcagtttactctgttaattttttgttgttatgcagaagctttttggtttaagtctcatttgtatatttttgtttttgttgcacttgtttttgaggtcttagtcataaattctttgcttaggccaaatgttcagagcagtctttcttaagttttcttttaggatttttatatttatttttatattttcaggtcttacatttaagtctttaatctacctcgagttaattcttgcatgtggtgagaggtatgggtccagtttcattcttctgcatatgactagcctgttttccagtgccatttattggatgatattgtttattatcattgtttctttctttccccattgtttatttttgctgacattggaaaatataagttggtcgtacatatgtggctttatttctgggttctctattctgtttaatagatctgtgtattttatttttgtatcagaaccatgcagttttagttactatagacttacagtataatttgcagtcaggtattgtgatgcctccagctttgttctttttgcttaagattgcttgggctatttggctctttttttttttttggttttgtatgaattttaagattgttttttcaaattctgtgaaaaatgacattagtaatttgatagaaattgcattgatactgtagattgctttggaagtatgatcattttaataatgttttcagttccaaaagcatggaatgtttttctatttgtttgtgtcatctgcaatttctttaatcagtattttatagttctccttgtggagctcttttaccttcttggttagatgtatgcctatatatatatatatatatgtatgcatatatatatatatacacacacacacacacacacatacacatacacacacacacacatatacacacacacacacacatatatatatatttgcatggcaattttaaatgagattgagttcctgtcttagttctcagcttgaatgttattgttgtatagaaatgtctctgattttttgtacattgatttttgtatcctgaaactctgctcaagtcatttatcaaagttaggagtcttttggaagagtcttagggtttctaggtataatatcatgtcagcagtgaacagagataaggaggatgatgatgaaattatcagaacgtagaaactgtatttttttatgattcagctccttgctgtgccctttagactagctggcaatggtagttttattggtaagtggaacctaaaggagaaaatcaaacagaaaattcactatcttgtaatgtctcagattttatctatagtacagaaaaggaacagagtcttgtgacaagggctgcattatcctggggaagtaagcagcaacttaatacaagaaaatgggctgaagggtaaactgtcttaatgattactgctgattatattgtaagcctatttgtattttatttttccctttaattttataaagtgttcttgggaacagttttagttttccctaggctcgatttctttttcaatcttgaggtgcaagaattaatatggtccaaatttggcaaagactgctctagatttttttcttggcaaggggcatagccatggtgtgagtcaggattagaggaatgaaattctcaggtagtaactctaaatatttgtgagtgcctagtcaggggtatagtatgaacaaatttggtatttttgtctattattttagtgtaacatttaattgaacagtgaactatgaggtaaattataagccctattaacagaattgtgaatccaaactttaagaccccttgtaaagtgaagtaaaaatcttggagtatctgtgagaaaagctcagaaaatcagtcagacagagggtgtgtagtaagaaatgttatagtcaggaatgaatgtacaatgtagtctaaataaattgtagacaaatagtaaaagtccaaatataatggacaaggctagaatctaaaaacaagtgtagtatactttttttttttttttttttttttttgagacggggtcttgctgtgtcacccaggctggagtgcagtggcgcaatcttggctcacttcaacctccacctccaggttcaagcgattctcctgcctcagcctcctgaatagctgggactataggtgcatgccaccatgcccagataatttttgtatttttagtagagatggggtttcatcatgttggccaggatggtcttgatctcttgacctcatcattcgcctgcttcagcctcaaaagtgctgggattacaggcatgagccaccgtgcccagcctatacttctgtgtaccacaattgtttccagtctctcacttttattaaagaaaaaataatagtaaaaaatttattggcaaagtaagttttaatctttttatacatggcctgattatttgcataaaatacagcaaaaatggtgattggccatataggctcttttaagttggctttgctgaaactttttaataaggaatctcaggttaaactttttaaaagtctcttcagattactcaagtcaatgatttatctatgcctgtagatacctgtatgaattgggtaaatttttctctttttgaagtatcagaataacttggtgtttctgggcctattagaaagtgacatttcttatttattacggttcagtaactttgtaaagaaattgcatagacaaggtacaaggccatttttaagggacttttatcaactttataagtcaactttaattttttaaagtagtctgatcatttctgaaaatatgtcattttagtcaaagccttggcaaaataaccggtatctctaattgtttcctattataaaagagaacagatttttattgaacttatgtaaataattaaattgccataaattaagaattctcacatatagtttttaaattctggaaaaattaggtagagagaaagaaatatgtttcaaattttgcttacaaataaacaattgcttatttgtaacaatttttattcaattgttaaaagctataaatatctcaaaagaaaaagattttctcccctctggaaaacaaaatgaaaaggatcagtaatcttttaagtaaaatttaaaaattattttagtcctccattggtttagtgttttgctggatgttgggttagcaatcctcatgaacacataagctttttaatgagagtgctagaagttttttatgagtccaatgttatgatttttaaaattattagaaacctatatttgagtcttttttacaaatttttttaaagaagtaaatttgtactgtagaagaatcaaagtaaaagctaacaattgtctatagatgacaaaagtcttagattagtcacagataaaggcataattgacaaggaaatttggttatttttgtgacacacaatttaacatgattatcataattattagtgataacataactaagacatttaagaattgaaccagaaagaaataaaaatcctgaacagacaaataacatataatgcaattaaaccattaattcataatcttccaagaaaaagaaaggcccaggagcggatggattcactgctaagttttaccaaatgtacaaagagctgacacaagtcttatgaaaactattcctaaaaatagaggactaaggattccttcctaactcatttaaaaaaaattattactctagtaccaaaatcaggcaaggacacaacaacaacaaaagctacaggccagtgtgtcactgatgaacacagatgcgaaaattctcatgtaccctaaaacttaaagtataataataataataataataataataataataataataaaagttagcaagctaaatccagaagcacatcaaaaagaaaatatatcatgatcacacgggttttagtgcagggatccaaaaataattgaacatacacaaaccaataaatgtgatttaccacataaatagatttaaaagcaaaaatcatatgataatatcaatagatgtagaaaaagcatttgataaaatccaacatcccttcatgataaaaaccctcaaaatctaggcatcaaaaaaaaaaaactacctcaaaataataagagccatatatgacaaacccacagccaacatcatattgaatggggaaaagttgaaagcatttcccctaagaaatagaacaagatggggaatatccactctcaccactcctatttaacatagtactggaagtcctaaccaaatcacccaggcaagagaaagaaagtaaaggcatccagactggaaaacagaaaatcatttcctggaatttatccatttcctctaggctttctagtttgtttccatagagatgttcatagtagtctcatgatcttttacatttctgtggtatcagttgtatgtcacctttatcatttctgattatatttattagaatcttctttatttcttggttaatctagctagaagtctatcagttttgtttattctttcaaagaaccaacttttcatttcactgatcctttgtattatgttttttatttcagtctcatttatttctcctctgatcattattatctcttcttctgctagctttgggttttatttgttcttgttttttagttccttgaggtgcaacattaggtcatcaacttgagatccttctatcttttggatgtagacattcaatactaaaaattttttcatagcactgagcttgctctctcctataggttttggtatgttgtgtgtctctttgcatttgcattgaattttttttttatttctgcctcaattttgttgtttgtttgcccaaaagttattcaggagcaagttgtttagtttccatgtacttatacagttttgatagttcctcttggtattgatttccaattttattccactatgttcccagaagatacttgatgttattttgattttttgaacttattgagacttactttataggcaaatatgtaattatttttgaagaatgttctacgcacagataataaaaatgtatattctgaagttgttgggtataataatccttaaatgtctatcaggtccacctggtctagagttcagtttaagtccaaagtttctttgttgatttctgcctcattgataatgccgtcatgtaatgactggtgatagtgctgtcaatggggtgtcaaagtcccccactatttattattgtattgctgccagtgtctttttgtagggctagtgtaatagtatttgttttgtgaatacttcagtttttttgttttggagatggagtctcactctgtcacccaggctggagtgcagtggcaccatctcagctcactacaacctctgcctcctgggttcaagcgattctcctgcctcagcctcctgagtagctggaattataggtgtgcaccaccgcacccggctaatttttttgtatttttattagagatggggttttgccatgttggccaggctggacttgaactcctgacctcaagtgatccacctgcctcagcctcccgaagtgctgggattacaggtgtgagccaccgcgcctggccaaatacttcattttatgaatataatgctctggtgcatatgaatttatgatagttaaattttcttgttgcattgaatcctttattcattatatagtgtgcttctttgtcttttattactactgttggtttaatctctcttatgtaacataagaaaagctactcctgttcacttttgtttttcttttgtatgatacagctttttctaccactttactttaagactgtgtcattacccattatgtgagtgtcttgaagacggcagatagttgggtcttttgttttttgtaattcaattagccagtctatctatcttttaagtggagaatgtatgccaactatgttcaaagttaatatttatatgtgaaattttgttcctgtcataatattgttagctagttgctttgtagtctcaattgtgtaactgctttatagaatctgtgagatttgtacgtacatgtgtttttatgatggcaaggatcatccttttgtatccatgtttaggactcctttgagcttttcttgcagggctgttctagtgttgatgaattcccttagcatttgattatctgggaaagactttatttctccttcatttatgaaattacttgtgtcaggatataaaattcatggatggcatttttttaaagaactccacaaacagtgcccttatttctttgagcttatggggtttctgtttagaaatgcatacttattctgaaggtattttcttaataggtaatgtgatgcttctttctagctgcttttaagattttttctttcacattgaccttagatagtctgaagacgatatgctttggtgatgttcaacttgtatagtatcttccaagtgtcctctgaatttcttgtgtatgataacaacactcctagcaagatccgataaattttcctaagtttgcccatcaaatatgattttctttttcttcttctccctcaggaatgcttataagttataggtttgttcactttacataatccagtatttaggttttttttcctttttaaattttggtttttaaaatttttctcttactgaattaattcaaaagagcagttttcattttttaacttttaagttcagggttacatgtgcaggtttgttacacaggtaaacttgtatcatggtggtttgttttacagattatttgatcactcaggtattaagcctagtacccattaggtatttttcctgatcttctctctcctcccaccctccaccttccagtaggccccagtgtgttttgttcccctctatatgtccatgtattctcataatgtagctcccacttataagtgagaacatgtggtatttggttttctgttcctatgttactttgctaaagataatgacctccagcttaacacatatccctgtaaaggacataatcttgttctttgttattgttgggaacaggccccccaaaatctggccataaactggccccaaaagtggccataaacaaaatctctgcagcactgtgacatgttcttgatggccataacacccacactggaaggttgtgggtttaccggaatgagggcaaggaacacctggccgcccagggcagaaaaccacttaaaggcgttcttaaaccacaaacaatagcatgagagatctgtgccttaaggacatgctcctgctgcagataactagctcaacctatccctttattttggcccatctcttcgtttcccataagggatacttttagttgatctaatatctatagaaacaatgctaatgactggcttgctgttaataaatatgtgggtaaatttctgttcagggctctcaactctgaaggctgtgagacccctgattttccacttcacacctctatatttctgtgtgtgtgtctttaattcctctagtgccactgcgttagggtctccccgaccaagctggtctcggcatgttatggctgcatagtattccatggtatatatgtaccacattttctttatccagtttatcattgatgggcatttaggttgatgccatgtctttgctgtgtgagtagtactgcaatgaacatacatgtgcatgtgtctttataacagaatgatttctgttcctttgggtatatactcagtaatgggattgcttggtcaaatggtatttctttctctaagtctttgaggaatcaccacactgtcttccacaatggctgaactgttttacactcccatccaccatgagtaagtgttcctttctctccacaacctcaccagaatctgttattatttgacttttcaatcatagccattctgactggtgtgagatggtatctcttgtggatttgatttgcatttatctaatgatcagtgatgttgaactttttttcatatgttcgttagctgcatgtatgttttcttttgaaaagtgcctgttcatatccgttgctcattttttaatggagttctttgtttcttgcctgtaaatttaagtttcttgtagactcttgttattagacctttgtcagatgcagtttgcaaaaattttctcccattctgtaggttttctgttatctttgttgataattttcttttgctgtgcagaatctctttagtttaattagatcccatttgtcaactttttcattttgttgcaattgcttttggtgtcttcatcatgaaatctttgcctgtgcctatgtccttaatggtattgcctaggctctcttccttggattttatagttttgggttttacatttaagtctttaatgtatcttgaattaatttttgtatatactataaggaagggattcagtttcaatcttctgtatatgcctcaccagttatcctagcaccatttattgaataggaaaccttttccttattgcttgtttttgtcatgttttcaaagatcagatagttgtagctgttcagtcttatttcttggttcttgattctgttccactgctctatgtgtctattcttttaccagaaccatgctgttttggttaccatagccctgaagtatagtttgaaatctggtagcatgatgcctccagctttgttctttttgctttggatttccttgtcaatttgggctcttttttggttctatctgaattttaaaatagttttttttttctagttctttgaagaatgtcattggtagtatgataggaatagcatttaatttataaattgctttgggcagtatgaccattttaatgatattgattctttctatccatgatcatggaatgtttttccatttgtttgtgtcatctctgatttcttagagcagtgttttgtagttcttcatataaagatctttcacctccctaataagctgtattcctaggcattttattcattttgtggcaattgtgaatgggagtttgttcctgatttggctctttctttgactgttgttggtgtattggaatgatagtgaattttgcacattgattgggcatcctgagactttgctgaagttgtttatttgtcaaagaagctttggggctgagactctgggattttctagatatagaatcatgttgtctgcaaatagagataatttgacttcccctcttcctatttgcatgcctttatttctttctcttccctgactgccctggccagaacttccaatactatgttgaataggcatagtgagagagggcatccttatattgtgccaattttcaaaaggaatgcttccagcttttgctcattcagtatgatgttggctgtgggtgtgtaatagatggattttattattttgaggtatgtgtcttcaatacctcgtttattggagagtttttagcatggatggatgttgagttttattgaaagccttttctgcatctgttgagataatcaagtttttgtctttagttctgtttatgtgataaatcacagtttcttaatttgtgtgtgttgaacttgcatgcatctcagggataatgctgacttgatcttggtggacaaacttcctgatgtgctgctagattgccagtatttgtttaggatttttgtatcaatattcatcagggatattggcctgaagttttgttttttgttttgttttgtttttgttattgtatccctgacaggctttgggatcaggatgatggtggcctcatagaatgaattaggggggagtccctcccctcagttttttggagtggtttcagtaggaatggcactagctcttctttgtacatctggtagaattcaggtgtgaatccgtctagttctgggatttttttggttagtaggttatttattgttgccttgatttcagagctcattattggtctgttcagggattcagtttcttcctggctcagtctcgggaagaggtatatgtccaggaatttatccatttcttctacattttctagtttatgtgcatagaggtgttcgtaatgttctctgatgtttctttgtatttctgtggggtcaatggtaatatcccccttttttgtttctgattgtgattatttgctcttctctcttttcatctttattagtctagctagcagtctatctatctattttattaattttttccaaaaaaacagctcctggttcattgatcttttgaatggtttttcatatctcaatctccttcagttcagctctgattctggttctttcttgtcttcagctagctttaggatttgtttgcccttgtttctctagttcttgtagttgtgatgtcaggttgttaacttgagatctttctttctaactttttgatgtgggtatttagtgctataaatttccctcttaacactgccttagctgtgtcccagagattctgatatgttgtatctttgttctcattagtctcaaagaacttcttgacttctatcttaatttcattatttacccaaaagtcattcaggagcaggttattcaatttccatgtaattgtatctttttgagcaaatttcttaatcttgatttctaatttgattgtgctatggtctgagagagtggttgctatgattacagttcttttgcattttctgaggagtgttttacttccaattatgtattttacagtatgtgccatgttgcaatgaaaagaatgtatatctgttgtttctgtgtggagagttatgtagatatctatcaggtacatttgatccagtgctgagttcagttcctgaatatctttgttaattttctgtctcaattatctgtctaatatcatcaatggggtattgatgtctcccactattactgtatgggagtctatgtctcattgaaggtccctaagaatgtgctttatgaatctgggtcctcctgtgttgggtgcatatatatttaggatagttagctcttcttgttgagtttaaccctttaccattatgtaatgcccttctgtgtcctttttgatctttgttggtttaaagtctgttttgtctaaaattaggattgcaactcctccttttgtctgttttccattttcttggtaggtttttctctatccctttattttgagcctatttgggtcactgcatgtgagacggatctattgaagacagaataccattgggtcttggctctttatccagcttgccactctatgtcttttaattagggcatttagtccatttacatttaaggttagtattggtatgtgtggatttgactctcattatggtgttagatgattattttgcagatttgtttatgtggttgctttatagtgtcactggtctgtgtacttaagtgtgtatttgtagtggctggtaacaatcttttctatccatctttaatgcttcctttaggtgcttttgtagggcaggtctggtggtaacaattccctcagcatttgcttgtctgaagaggatgttatttctcctttgcttatgaagcttagtttggccagatataaaattctggtttggaaattcttttttttttaagaatgttgaatattggcccccattctcttctggcttgtagagtttcagctgagatgtccattattagtcaggggcttctctttgtaggtgatgtggactttccctccagctgcctttaacattttgtttttttattttgaccttggagcatatgaagattatatgtcttggggatgatcttcttgtggagtgtcttactgaggttctctgcgtttcctgaatttaagtgttgccctgtctagctaggttgaggaaatcctcatggatgatatcctgaaatatgttttcccaattggtttcattctccccatctctttcaggtacaccaagacattgtacatttggtctatttacataatcccatatgtctcagaggttttgttcattccttttcattctttttttctctagtcttctctacctgtcttatttaagaaagccaggcttcaagctttgagattctttactccacttggcctattctgctattaatacttttgtaattgcattatgaaattcttgtttttaagttctgtcagggtggctatgttcttctctatactggtcattttgtctgtcatctcccataatgttttatcattatttttagcttcctcgcactgggttacaatgtactcctatagctcagtgtacttcctttccattcaaattctaaattctacttctgtcatttcagccatctcagcctcagcctggctttaaaccctctctgaagaggtgatgcaatcatttggagaaaagaaggtactctgactttttgagtttttagtattcttgtgctgattctttctcatgtttgtgggcctatctaccttcaatctttgaggttgctgacctttggataggttttttttttcttttatcctatttgatgaccatgagggtttgattgtgttataaggtggagtcagctgactagcttcatttctgggagattttagggggccaacactcagctctcaacctttggactgtgtactataattctgggggacttctattgggccccaactttgttctctggtttgaaccttgaggtttggagttcactttgccgggggaaccaaagtgtggcagctgcagcaaagtgcaagtggatacaggggttcctacctccctgagagcattcaccacagtggtagaggcaaggcagcagctgggacagcaggttgtggggtgtcctgctggagactgtgctgttgcactagaggtgatgttggctggtttattttttgttggttttcaactttctcttggatctcattgagcttccttatagtctatatttctaattttttatctgtcattttcaaattttcattctattgaggatccattgccatagaagtagtgtgatcttttggaggtgtcaaagcactctttttacactgctggagttactgagctgattccttctcttctaaagaaaccgtcattttctttctttctttttttttttttgaaattgctattgtttgcaagggactttatatttattttttcctcccttgaaggtgtgactgtagtacatattttgtatgatcatttggcttctgggtgcttttagacaaccgaggctctgtatgaattcattggttatagatagcttttgtgtggtggctttctcaaattctgcttgttgtagctatacattgggcatatgagccaattcactctcttctaggaggccaggaatacagggatctcaggtagctgatgtcctccctagcactgtgtccttctgtcagccactttttgttttgttttggtttttgttttgtttttggtgaagtttggtctccagtaggtggtgccagagccagtttccctttggatattgagatgatgtgtggaagcacctgccctaatgaagctcatggagggagtttgtggtgggatgcactgaggtttccagggtggtaaagagagggctgcaccagctccccatcctgggaagtcaggaatatgatccacttccatatcatgcccctatctcagggttcatggccttcagttcagatagtcactgtcctttatctccaggccacaatgcaacttaggtctgtgagaaatgcctgtctggtggctactgatgaaatgacctttcagcagaacctcttcccccaacaccaaacagatgactctgcagttagttggtttacactgttttgcagtgatgctgccactctgtgtagaaaggcagaaattagccccgttctatgtacaagcctaagcagtgggcacaccttcactgaggacacagctatcccaaaaaatgctggaaggaggacacttacggcaacctccaacaggaaaggccttggctacctctgcagcagtgtacgggacagtgggagatccatttctggccactagggtcacctatccactagggcagaacagtgccccctttggagatcagcactgttacctgcatttcctctgttccgaggagcgctttggcagtctgcattccccctctctccctctctctagggtcagcacactcgaaggactatacctctagggatcccacagctccccagggacctgatggacctctgtagttgccaaagtcaccgtgggttttgaggttccctgggtaggttaatgacccataacagatacacaaacagtgtggtccctgccacctgagtctgagtttggtgtgagtgtgagcacacatggaggaaatggctgcctcgtgctgtgcctgctggaagttcccaaattgccaccaacaaacagcattgttctgggttgattgataggggaaccccgacagtttggctgttagtagtctgtcacacaggtgagaggagcaagagatccccctattgtaaccttttgtcaggactctaacttcctctggggtcaatctctgccagattctggctgccttccttttctgcatcccaacttctttgtatgggttctccaacaggtttcagcacactttcctcagttccacttgggtcatgattattcacctgcaaatttgatcttctttctgaggagaaatggcatccaacatctctagtcaactgtctggggaaaaaaactaatttactttctaaatgtttccctttagttagttaagtttaaaatgtgatttcctccaggaaataatgataatctctctcttttgtggctgaaatgtatgccccactctacatagcatacttagagtcagtgatgtggatcccaccctcatacacccttactctttttttatttgaagtaataaaataaaaacctttatcaaatgaaatgagttaatactgacagcgtatatttgaaaatgaaaaattgtaaatttataagcataaaagtatctccacactaataagaggaattattcaaagaaagaaaaaatattttacatgggttttagtgtgtgaatcatttcctttgtgatgaaaatgatcgtgtttaatgatatgaatcatatcttttaacagttatgataaatcttctaaattcaaactgaaaattatatatcagagtcttccaaattaaaaacaaaagaaaaaccctcccagggtgagttagtaatttttagagctgtattatctctcagtttatgcacttgaataccacttggtaaatgtacctgctgcaccaaagtatactttagtttcatgcagagtaaagataactcattatatcctttttatcatttgaacatcaatggctatggaaaaagtaattttcatcctgggtaaatttgctcatattctcaaggtgtacatggacctgactttgagctgtgtgtatagggttcttggtatattatttagtataggtctagcacattccagagcagattaatcatcctctaaatgctcacttctcacaaacagaaaccaatgtatcgacctccatgtgccctaacctgctgagctgtgttgatttgatttatgggaagttgatcattcacactaataatcttttatcaccttatgtatggggagcacaaggcattgggttatttttttggcttttgcaggagtctatccttagaatacaacagtgatttataattatttttctgaagtatcatttagatattctaagcaaaaagtctcatacagtgtaatataattagtactctatttctgaatggactttccctttcttgctttttttgaagcagattatctaagctcatttctattgagagagatctgctaacaaagcattcaagttagggttatcactgtcaaaatgaagtggaaaatggcaacaactccttttttcattaaaagctaaataaacaaaaattcatttagtattaaaaaaatgatgacaggaagaaaaccaacaaagctacctgcgaatatttcattacataattttaaacaacttaactatagataaaattgttttcagtaaacaaaatactttaaaaaaaaacaggtaagtcaaatcaaacatttactttagtgaaattgaaattattatttacctacctaagtgtcatctttaagaaaatgaaaatcaccataaatatttgtcaatgctgcaatatatactaattattccaaccaatactactactatctaccaaactatgtgcattcctgaaaggacctttgtgaagttacattacttttcattaattttaaggactttcttttccctggatctttaatttacatgtgtcagagtgctcccaaggattcgattacttttcattttattctagaatgttgataagatatatttgggaacatttatctaagctgccatttcatttttagtaaaattaggacataaacatgcaaacattatacctccttgtaaggcttaaataggtcagtgtactgccctggcacatagtaagaattgcataaatattatctagtttgaaaagtttttataattcctactaattaacattcactagtttaaagtatttctacaaataatttttatatttttctcttttttcacatgacctctttgcaattcttctatccatattcttctccaagttctttggttttatttccaaaataaaagtcctgaaatgaacaatcagatctaaataccacattcaggataatgaccatgagcactgaatggcagcataacatttaatgttttattcttttgtttttaatttttaaccgctttttttcttctatacaactaaacaatggctcgtatctttattagctgcctgaaatgactcctaagtattctaaagagattattgctaattcaaaatatatgattatgcactggtaattattccaaataaatctacttaatagtagcattattgatttgtcaacttgcagcattgtatttgtatctaggcctaataattttgtatttatttccaatttttctgtggttcagtgactaacattgcattgttactacaaactagatgaactgaaaatcagcatgcacatggtcagttgcttctggaaataattttaattttgccttgagttatactttcttagaaatggaattattaccatcccatgaatatcatttttcacatacttaacatattttttcataagttagttccatttatgtaaatatggttgtagctgcctagtgttaaaacttatggatgacaattagcacaaatattgagttacatttacttatataggatttctaaaagtgctttgggaaaccccaagtttatactaagtgctaactttaatcttgtttccaagttctaaaacatgaatgacatcatgaagtctcattctgaattttcagtgttgatatttattcagcaataggagcaaagaccctacagtcagtctctgtgggtttgaatcccacccttatcactcactagagaaaccttaggaaagttacttaacatcttctcaaataccttgttgaatttggaatgactgcttttaggataaatggaggtaagaaaagaggatattccaataaagtggaacagtttaataaaggcatgggcaggagacccaaagaagtaattgattaagttaggggatgcacatggtgtaataagttggaaatgtttaaaaaaagtgggttcacattatggaagacattcttgaacatccagagaaatagttgggcgaaaggtactataatgaaagctgttttaaaaacactacaagagtaactcatgcatgaggaaagaataaaaaatgaatgctgttgaagcaagaaagtagctactgcattcagcctgatgggtagtggagaaggttaaaccaatatgatactgtattaaaaaaaaaaaagaaggaattggaaaaatatgagagaattctaatgaaataattgcacggatgaatgcttctgagcccatcacatcctagtcacaattcctggtttcatttattttgtttcactgtttttcaatagcaagagaggaattaacagctaactgaggcaagcatcagcacagaggcagggagcattaggggtggagcagtcagggaacaggaagactgcagtgtcatcttgagtgacaccaaagaatatagccccataccacctatttcctccatctgttaacaacatttctcaaaaccagggctactgtcaaatttataaatactgttatttctaaatgtatttaactgatttaaatatgtttgctactgctggttcccttataatctccatttataatatttaaaaggttctgtgttggcattcagatggaagaaaaagcatgagaaatttcatcttgaatatgaggttatctaaggaaagaattcggttagcttcaggtgaatttattcttcccccctccagccccatcttttttatttatttatttatttatttatttatttatttatttatttattttgaaacaaggtcttgctctgtcactcaagctggagtgcagtggcacaataacagctccctgcaaccttgaactgccaggctcaggtgatcctcccacctcagtactctgagtgtctgggactacaggcgtgcgccatcatgcctggctaatttttaatttttttgtagagttggggtctcactatgttgtccaggctagtctcaaactcctagactcaagcaatcctttcactttggcctcccaaagtgttgggattacaagcatgagccactgcacctggcccttctttttctttttaccaaattatgcgtaagtatttccctgattggtttggggtgtttcgatttagtttaaaatagaaatatatgttttaaagtagtgcagacctctagcttttaatccagtgacagcagtaaataaaatgagatttgagaatatgctgtcattgatctgccctagcttcttttgttcatgaaggattaatagagaagaggtgatttttcagtcttctgtataacaacttctttggttcaatattacaggagccttgggtcactgtggtgaccatgttccctttgaccttttactttttgggttttttttttttttagattttctttgcaatttatgaacctcaagtgtcttaataagtaagtgcctctgtaggtagcctattgtgcagagttgcaataaaggaaaacactactagaaatgcaacacagcactaatcccattaacaaatgcagccagtgtcagagataccataagaggcaatttgactgagatgggaggacatcccacatcgtttatgggctgttgaacaagagactttcttagcctcatcagcaggttagctgcatatgaatcctcatttttatttagggacagagccccttgcttataatgctattggtcaaaaatgagcagtttttactgttgcctgcaacgttgctagcaccttatttggggctctttttataaggacccgcgatgaaagttgtagatggtaactgtgaagaaatctcccctccctatacccaccttttcaggctctgagatttgaataaaataacttttatagaaaatattttctatattaaattctataactctaatccaaatttgtagatcctcaatcttaaataaataagcgtagttttcttcaattttttatctaggatattttgtctcaagatcctatcaatgttacataatataaatcctcatattctcaccctgacccactaacttaacaagcagctgatatactgcccccatcttggccattctcacggattctataatacttctacagccacatctgctgtttccagctctccactaaatcatcaatgggcctaattttgccagaccctaggcccttagcactgtgatccaaataagttaataagaaatctctaattattggactagtagcaaaacttcatgcaatgggcttgggctgataatgcaacacaaacagtaacatccccttgttagaaacatcccaggttgccgtgcctgctgctgattcctgaatgcaaattgcaggtatgtttgggctctagaaaattagaaccagaaccccattagacaaaatcaggtatcaactcctgatttcacagttgagaaaaccacatccaagagtgttcaattttctgaccaaggtcacacagagactttgtgtcaacataaggccaagaatttaagtcttctgacttccggcctaatgttctttccacttcattttactgccactaagtccaagtcattaacattaacataaaaataatttgagcacatactccattgaaaacagactacattaaaatatcaaagatgtgaactgaaacatcagtctcccaaatggagtgagcacaaccttggatcgttctcacgttttagagagatgcctgtcagtcacttaagacccttaagattcccgaacccatgttaataaatttctagaatactttggatgctttagactacaaacatactagtaattactgctaaaaataatgtaaaaaatggaagctttattagttcacaaaacaataggccagaggtggtgaaagtccagagttagttaattcatcagtttaacaatgtcagggttctggttctctgtgattgtatcagctttcctttcctgatgccactatattcccaggcattagacacaaccatgggcaggggaaaaagtggctaatgcctgcctgtggcccttttctcagagttgagaaaaatttttccagtcaccttccccagtatattacagctcattagtcagaactgcatcacatgtccttgcctaaaccgatcgtggtctagaaaatggaattaccacaatttttttagagtaatcaacattcttgtgaatcagaaagccttcaagtatcttgacaaaatcagaattctgttggcaaaaaagaattaggatgtatgtaagggaggatggtgattgattcatataattgtgctatatttcttaattaccaggcatatggttctttttaaagatagttatgatgtaagatatcaggatcctggattcatcagcatctaacaagttactacttctggtggccaaatctggaagcgtctgttgcatgcaataacatggcacctgggaatatgcacttctgtgcccattatgactgatatgcgatacttggaagaatcattattctactcacagaaggaggaaacccagcaaatgttagagaacaagacttttaacgtaagcagtagtggaagatctgatttactcaccccagcccctttcccagatgtacttgaataaaagagtgagagtgaattcttttttttttttttttttttttttttgagacagggtctcgctctgttgcccaggctggagtgcagtggtgcgatctcagctcgctgcaacctccgcctcctggattcaagcaattctcctgcctcagcctcccgagtagctaggattgcaggtgtgcaccaccatgcctggctagttttttgtagagagatggggtctcaccatgttggccaggctggtctcgaactcctggcctcaagtgatccacccaccttgacctcccaaagtgctgggatgacaggcatgagccaccgcgcccagcccagagagtggactctttaacaatcaggctttatagtgcttcaaaatttagaccaggcctaagcaacagggtagtagggtaaggttgcaagtgggcaagcagaggtaacaacaggcaccttgtcttccaaacacacggagtagactaacttggctctagccgacagctcctgacagaggtgttgccagaacccgagctgaagtagaggcaagcctggagtgaggatctagataagttatgagcaactaaaagatgctacccttttccagctttctttcataaaaatcttactttttacgttatttcttctaaagctttctcattatgctgctagaaacccttctaaagatatattaccttaataaactagtgaaacaatgccagttttgaaaatgtgatcaggctgagaacccccttctccttctccccacttatgcttcaaagaagtggagaaaaggactgctctacctatggagtagccattctttattctttcctttcctaataaacttgcacacacacacaccacacacacacacacacacacacaagaagtgtagaaaagatctgaaaggtcaggttgtgtttagattctgaagggtttcctagtgctaggccaaattatttgtagtctatataatgcactaagagacgcagagaggaggtatgtacagagtagggaaagaatgaaaccagggtttcagagacattaatgtggttgggctgtgtgggagagaagagcagaagagaagagactagggcagaataaaataaagaagtgataaaatcccaaaccagggaaataactgaggcagaaagatccactggaaaaaaaaaaaaaaaactataataggaattaatgaaggactatctatggtaatctaggtgaaagtcatggtagaagttgactctagtggccaaggctgggtgacagagacaatgacagaaatgaagattatttttttaaaggagcatcagtggttttgttttcctgaccacaatattttcttgaagaaaaagatggcattcttctcttcctcacatctcatatttgtaaccccagaatatctcatacaatgcctggaacacaatatatgctcattaatattattgaagaaataggagcttgatttgtcatttagttgctgtcaatatgtctctgatactgtgatactgcagtggtaaattaacaatgaaaactaattttgtcaagcatttttcaggatatgcttttcaaatagctgccttcatctatagcatagagcatttctctactgcctcacatcttaaaatgttactctagcaccatctctagtgcgacaaaattacacacaggatacaagctcaggtgaaatcgttctgtcaatttcagtaagcttatacttattttctagactcctctgtgttctagcccctaccaaacagtccagcttcatctcttgctacttcaccttatcgctaaccctaaattcttctatctagccacagtgactcttctgatttctcaatgccatgctgttttctttgggtccttagttataggtagccacctttgcctggaaatgtttactccacttttacctttatgtggcacagtcctgctctttttaagcttttagctcagttacttccttccagaacttcttgtactcctacatatggggtaagggcctcccttgctcccatgatactctagcctttcttcacatagcatgtaccatactatttaattgcctgtttgtctacattcctcctgtatgaaccatattcttgtaagccccaagcatatatcctggttgtattagtccattttcatactgctataaagaactgcacaagactgtaatttacaaaagaggtttaattgactctcagttcagcatggctgggaaggcctcaggaaacttacttacaatcatggcagaaggtgaaggggaagcaagacaccttcttcacagtgcagtaggaaggagaagggctgtgcaaagggggcagggcgccttataaaaccatcagatctcttgagaactcactcattatcaggagaacagcatgggggaaactgcacccatgattcaattacctccacctggtctctcccttgacacatgaagattatgtggatgacaattcaagatgagatttgggtggggaggcaaagcctaaccatatcacttgtacttagcagttgctcaataaacattgtgaaataagtattgtgaagtaaacactacgaaattaattaatgaagaaaataaatgtaaagtatgttggttggcaaagttagaagtatttgttaaaaagtccattaatgatcttgtagaatcacgtaaacatgttgatatattagtataaatatattgcctacagattggcatacagtacagtgaaagtactacagtaagctgtacttggtctattttatgctccctttttcttcccaggaaaaaagagaagaataagataatggctatcagagaaagaataattggaacaccttagtcttaaataggtttgtttgacaagagtatgattaaaataatttcacatatagagtttaataaagcaatgacaaaagaaggaaaaatatcttcatatagccaaagagaacaaggaatttgcaaaattcatgaatagacatgaatagatgagaataaatgatgattggatatttaactattttggccactgaagatattagtaggcatttgcatagaaggcaaagcaaacattctttgctgatgttaatattcaggtttacaaatcactgtggtaagcacagttctgcccaggaacacaaagtgtgcgttcaacctacacagttgaaggcagtggctctggttctgccctatttactaggccacaattgctctattccccaaattgttctaatttacttaaagttactatatagtcaaaagggaatttcttgaattgtaacatttaattattttagacccgagatttttattttagtgtacagaaatactagtttagattccaataagtctgggacataatttcctttgtttactagactataatttgtgcttattagactggtatattattgaaatcaaataaacactgtaaatgaactctgtattttgtaaataataaaatattgataagaaaattcaaaacagtttcaaagtcattaataggtatattgcccaaataactccacttgtccttaaggttaaacctgtgttttgttgagaaagcctgctatacccccaatctgaattagctgctttgttttgtgcttctacaatactttgtacatacattattgttttagtcttccttattaatagataacttttaagtttcaaaagttacacctgcatttctgaaacaaatgaaaacatagttgtatgaaaagagataattttgtggattttcctccacatgtttctctgtcttggacatatttctatccatgctgttagcacactgacttaaaattgtttgttttagatccccctcttccattgaatctcacctcacccctggctgcaagttagaatcaccaaggacatttttcaagacactcaaatataccaacatttcctccctaaattctgatttcaatggtctgaatgaggtgaaaaccaggtgttacatttttaaaaccaccccaggtgttcttgctacttggtttatctctgtattccccatgttttattcttcctcttcttgaagtctcataagaaaatggtacctatagttgttaaataaattgattgtttttaaagagataaaattgccttaattggactagagaataccaaatctatttctaatttgcatacagaaatgcctcaccttaggcaaaaaaaaaaaaggcatcagaaaaattgaaagcaaaatgtattgccaaaaaataaattacattttcttatagaatttatataaagttggggtatattttagatggaaacatttggctctaacaagttaaattataagttttgaatatttcaagtataattaaattatggttcaaaattaacctgcacactcatctaccaccagaaaaatactagccattatttataaaaatcaaaattactcagtgatagttacttctccagggaagaaggtgagtcggtaataagctatgcccccataaccttacaatcacgctgggaagcagcagccagtagccaaactgcatcctggtggcactgactgatccttctgggaaccaagcccatgaccctagttttgtttcaaactcaaacacagaggatccctgcaaatccggttactcactgatgtgagaattcattttttcaaataaactgaaagctatggagtcttttttgggcactctagtccattacttttagctctttcatctaaaggaatttattctgcactttgttgcttattctctactgctgtttcttgattatttgctgaaaggtacctatcctgttgaggatggctgttgatattgcgtatttagtatttgtcctacggtttttatcctaatataaaaagcctgttctttcttctgtgctctccccgtctctctacctccgctgagcttcagattgcttttaaagggtgacctggcacacttctgtgtgcatgcactggtattacaaaacacaccttcccatttacttgtgagattaaatatatatatatatttatttatttatttatttatttaaagggattatgcttatatttaagaaaagaatttatgtctatataaaggaatatccatatcaagtattaggtcatatttatctcaagatgggaaataggacatattttaactacatgggtgagtagagaaataagtagtttaaactgctgttgtttgacttcccaagctggccacccctaagtgtattaaatcaaggatttttctcagcctagaaagttaaatagcaggtgtagtacttaatgaactgcagcgagttggacttattggtgtggcaaatagattgcgatatttctttccaattaaagttcttttgcaaagatcaatgaagcacattttcacaaattgaattacactaaactaataaacaaaattctcccattcccactgatggcaaattattgtttccttaacatttaaaatcccatcacaccattaattataaaatgcaagggctaggaaagatcaaatatttatttgctcatgtgtttctattttacttccaattttataagaaaggtaagaaacattatatgtaaagaaagctgcataagaataattttccaaacttgaatttttttggtctttgatccataagcactttttatttactaaataacatgcatgtcctaatgattaaaaggtctgatctttagtaaattagaaaagaatctgctatagagtaacctttaattaatgaatgcatggaacacatttacatcagaaacaatgggcttgatagaaaaatgaaaatagcttaggactttgcctctagaatcagtgagctgcttcagaaaaattaaaatattagtttagcaaccttaaatgtcattactttactcaaataatgcataaatgttatgatattcattttctaggacctcctcacccttcacctccccttgatatttcttttcaagtatactttggaagaaagtttatacttttatgtagttttcattttaaagtttttagtatttcaatattgatgcaggataacgaaaatggagtaacctcagaagcaaagaataaagctttaataggaacttctgttttcaaaccacaaaaggcaatatttggtgaagatgcacatgcaagatttcctctctaagaatatcctaggacttaagaagactttcccacaccgtggtctactacttcaaaattttcccagttgctcatgagaggatctgtattttgtgaacattcctagcatgatgaagagcctatcaaatagtattcccaagcctagtggcattttggtgacttgccaacccacgtctgtgtagcatctccaaagagatccagcataaagggaaaaaaaatagaaagaaaaatgtaaagaaaagtttctgatattccatcccaccccctcctttctcctcctctactaactccatgtttctctttagtggctcatctatgcagacgacttttggatttttatgggtcatttgatttaatttaaacagaaaatatgctgtgggtgtttgtcaaatttattttgcaaataaacaaacatacacacaggcatgctcaaaggcatgtcatttgtgacatacagttgcacacagaatgtcaaatgcatgtcataaatgaccatctgctaccattttatgcaggaaatgacattttaataccaaaaatagtagaaaacccataatatcagaaaaaatatttctttaaatgaaataagtttagcttcccaaacttacttatttttctcatttcttcatacaatggtgatgtttgtcataaatcaacataagcccacaatccagcttttgagaactacaataccaaatgccgtggctcaaccctttgtactaactagaaaggatctgaattatttctcaaagcataatatgcctactacttaccagggatcttgttaaatggacgtgctggtttggtaggtctaggagttgcctgagactccttatttaacaagctaccagatggcactgaggatgctcatctgtggaccaaacttttagtatcaaggaacaaaactgttttcttcccagtgttaatagctagcctgtcagccaaggcattattctttttagaacttttaagtatgtgtgttgggggttagtgggttggttattataatgagaagccttaaaaacccaaataatttaatctgtaaaaatgatgtaatggggcatcatttggagggataatatcttcttaatctagtaacctaaaccagaccaaacttaatttgtttacaaattatcttgggtcaaatcatgccacattaagtatcattattcttattctagttggcaatatcctcaccaacatttgtttctgattaaagcttctttaaattatttccagactattccttattattgattagctttttttttttacatgtattccagttacagatgaagcatagtattcgtatgacatccaatactttttcactggttagcatactgagataaaaagcagaaaaggaaatagagatattgattttaaaggaaaagtaacttccatttttgtagtattttatgatttccaaagggttaaccacaattaaactgccctccatgagcataggaatcatgcctgtttctccaaaactagccctagcacacaagaccagtgcctggccaataatataataggtatagtggattgaatagccccttccatcctataatgtgtcaatgtcattttatctgtatatagtggattgaatagcccctcccatcctataatgtgtcagtgtcattttatctgtaaaaagcatctttttagatgtagttaaggatcttgagatgggatcatcctggattacccaggtgggctctaagtctaataaaaagtaaccttatatgagacagaaaaggagacaaaacagaacagaagaggaggcaatgtggaagttgaagcagatactggagtgatgcagccaaagccaaggaaggctgcagccactagaggatggacgaggctaggaatagaatctcccctagagcctctgaagggagcatggccctgctgacaccttgattttggacttctaaccttcagaactgggagagaagcaatttgtgttgttttaagccatcaagtttgtgaaaatgtatcatggcagccacaggtaactaataacagtaaaaaagccaatattcatggaatgactgaacagctgaagtaggacagatatgagaaatcataataagaagagagaaattcagagtggcagagtaagttgcctaagtttgctcagccccagcatgatagaggtatttgtcaaatatctttttttaaaaagtcacagtacttccggccgggcgcggtggctcacgcctgtaatcctagcactttgggaggccgaggcaggcggatcacgagatcaggagatcgaggccatcctggctaacacggtgaaaccctgtctctactaaaaatacaaaaaattacccgggcgtggtggcgggcgcctgtggtcccagctacttgggaggctgaggcaggagaatggtgtgaacccaggaggcagagcttgcagtgagccgagattgcaccactgcgctccagcctgggcgacagagtgagactaagtctcaaaaaaaaaaaaaaaaaaaaaaaaagtcactagtattctgtatactagtgttggtctactaaaacttataaaatctgactagtttttaaactcttacaagccatccacagaagacaaaatgttagataaaataagattgtgaatatctttctctagagtaaaattaagcatttttataaatacctttcagcatccagtttttaagaagtttaagaattataaaatgttcacattataatcaaactggaccatgtttgtgagacatcagtgctcctgatcgtttaaacaatgagttagtccaattgcatgataaaaagaggaagtagttaagaataaaggtgaggcaggaaatttttgtcagaagacagacaaggatttgaatcatggctctaccatccaggtgcagtgagactttggccaagttacttaacctctctgtgcctcagtttcccaggaataaaaattataattcttttgggacatgtaaagattaaatgagaccacatttcaaggctcagactctggcatattgtggccattactatctagcaacaagcacacagtagaatttgatcagcatttgttgagtgtatttattcaaacctgcagttggactataataaactaagataatttaactgccttttggttgctcgagtcatctcagggcaatagtatactttttaagtgcaattcaaactattaacttagctacatgaagtcatataatgtgcagattctagatatcaaattttttttttttttgcatcctctcttgggtcatgagactttcaaaggactaccattaagagatcctgcatttgagaataagaagaaaaactttggtatagattcttttttattcaaatgcccattattctgaaattgatttactcttcctgatggaaaagtataaaatttgttggcctgcaggggaatttgcaaaaggcctatctggttaataagtcacttatctaattgatactagagtatcagcagggtgggttatgaaatcatgaaacaaatgatctgacagtcaattaattctgtttcatctttgtgtatgttcctagaggctctatgataggatccagtttataaataaaaaataaagagatgctttttgtctaggttaaacttgatttcattctgaacttatattgtacagttgttcatgagcatgagttaattgacaatgtttagcagtctttttttttttttccttttttgagatggagtctcactctgtcgcctaggctggaatgcagtggtgcgatcttggctcactgcaacctctgcctcctgggttcaagtgattcccctgcctcagtctcccaagtagctggggctacaggcacctgccaccatgcccagctaatcttttgtgtatgtattttttatagagatggggtttcgctctgttggccaggtcggtctcgaacttctgacctcaagtgatccacccgcctcggcctcccaaagtgttgggattacaggcgtgagccaccatgcccaacgtgtttagcagtctttgagaaaattttggttgaaggacattgtgttggatccaagtatactttggacacctgagctcccgcaatttccttgcatgagctactgaaagatagaaattacacacttgggcagtgcaattggattgaaatggatttaaatctcgtatctcaaattctatctatctttaaatctattattttataaaattatatagttcaaaatgcacatgagaaaaaagtgtctattaatctgacaattttcaatttatcttttgatgatgttattaaaactatccaaatctacttttggttgacatattctcttctaacttcttcatgaaagcttcaattcatgtacatgtgataataataataaaagttaacattcattgactacttattaggttctaggcacgggggaaggcactttatgtatcatttatttagtgtatgtggtttttttaaagcttggagtgactgttcaggaaactagcctaaatttttcattatatacataagaaaactgaggcacagagaagctaagttacttgattagccgaggatacaaagatggttagaatgtaactttgtagcatcatatctttgtgacaaaaagaacaatagccaatctgtgacgcaaaaacaaaggcggtttctcattccattctgtgcaaggcagagctgctcagagaacaaagctgtctttgaagctggggatggctccatctcaaatcagctctgtggggtgcagagtatgacaagatgcagccaacacagcagaaaatcaagttcaaaacactcaagttatttacaatcctttggtgccaaaccttaaagaaagaattcttattatgttttatgtatgtttctaacttgtcttcattagcttccctttgatatttttggcaaatcagtttaaccttcaaaagtcttcatttattctacttgattaaatcaaacaaatgaatagataacatagaatcaaatagcagtattgtctgttctgagaaagcaacagcacaaagaggtaaagaaaatgcaaattgaagctagatgattgtatacattactttattgaatgtcttaaatctgctcagatttggatggtggggaaagaaatacaaatgtttctagaatctacagttgaatatttgaactgctgggcatggaaggtttaaaaacaaaagctagttagaaaaaaagattgaaaaggtaagtttcagactctggcatttttgtcttttttaagttagtttctgttgaagccctaccttcaggattttcttcccaagtactttccctagagtatataaatcaatgcaacagtaccctgtaatagtatcttaacctggagaaatatcacaagactataaaaaaatgcttttagcaaaggtgtcaactttgcccctatatcatcgatgaaatgtcagcttgaaagtctaggtatgttggaaccattagagagaaaaagaagggaagacagattaaagaggccagaaagtaggcaatttaaaatgaaaagtttaggctgggtgcggtggctcatgcttgtaatccctgcactttggggggccatggcaggtggatcacctgaggtcaggagttcaagaccaacctggccaacatgatgaaaccctatctctaccaaaaatagaaaaaaaaaaaaaaagtagctgggtttggtggcgggtgcctgtaattccagctactttggaggctgaggcaggagaatagcttgaacccgggaggtggaggtggcagtgagccgagatcacgccattgcactccagcctgggtgacaagagtgaaactctgtctcaaaaaaaaaaaaaggaaaagaaataaagaaaattgtatggcacggcacaaacacagctagaacttttagctccataggaatagaattgaagaagttgaagataaattaggaaatggaaatgttgcaggaaaatgaaagggcactgttttacttcaggttccccaagaaatactctgagatgaagatctgcatccaggagtcttattagaaagtgctcttgggaacacctgtaagagaatgagagaaacagaattgtacagaaggagaagttacaatgcagtggcaacagaagctcagttgatcctacggaacatctggagctgggatggctcttcatatttgtctcaaatcaaagaaagggtttgaaactttgacccctacatcaacaagtcattctctgctagctggccttaggaaagggacaaactcttgagcaaggtaacttctttcagctgagggctattcctgacgatagacccaggtgggggccaaaaggagccaacactttctcagctgggagaatgaatgttgtggtgccaaatgagggatcaagtggggtatcacagcatccattagggctcaaccctgtgcttctcagatctccttacttcatgcagtcaattcatatcatctgggagcagcacctcaaagaaagattttggttagtctttgtcctgaagaaacttacaggagaaagtttcttttagacagactgtagccccatgtagcagttgttcctgaggttactcattgattctcttcttaactttcattctgtatttccatcaccctgggctatcatctatgtaggtctggtgaagtgacccaaatcctaattcctggggctccggcaactggtctctatgcccttttcaggctacagtagcattgcttgttcatttactgtcaaaattgggcagagggagaaccatggaatggcaaagtggatcacctgggtcccaaacatactttttgctgtttgcttctatagcaaacataggtaggtaggtagatgcctagctcttcctgatcatcaaggtcagttactccagccagggtaatgactcctctgcttttcttctgggccgttggcatgatgagcctgaagtgaccaggtggcaatcacagcttaaagtttaatggaactcttactgtgtacccagttgaagtgttttcccctgagaatacatccacattacttaaagttacagagacagaaaggaaaaattctgcaatcgggcccttgggaagtacgtaaagctacttctacttctatcatttggtctctggatttatatattcctatccactgggaacaaagcaccatataatagtcattggtttagagtgtagattgaatgctggagaatggtaccccgtccaagcaaaatattctctctaatctggcctcctcaaaaggccatcccagagctttctcaggtagacagccttggcatcatcttgagcacatttctacatctgcttttctgtgaagaaggtctctaggtctgagattatcttaggtgttatgctatgccatttgaataaacactctgtaagccttctgataatggagctggctaaagctttgtgtgcagaaaatgcagacccatacctggaaaatgtatctatttcagataagaagaaaggctacttctgccaggatagaaagtgtctaataaaacaattttgggatgggcacagtggctcatgcctttaatcccagcactttgggaggctgaggtgggcagatcactcgaggtcaggagttcaagatcagcatggccaacatggtgaaatcccacctctgctaaaaatacaaaaattaactgggcatggtggcatgctcctgtgagcccagctagttgggaggctgaagcacaagaatcacttgaacctgggaggtggaggttgcagtgagccaagatcacaccactgcactccagcctggtcaacagagtgagactctgcctcacaaaaaaacaaacaaaaaaaccattttgtcacaatgttgctttgtggaattctttgaagaatttttctgtatcagtgacccaacgttggtttcttttaatggtatgttgtgctgttttgtccacacacagctctgttcctggcaccacagctactggggtggctgatggaagatactggctgttgtcaaacggctaagtcaatctgtctattgacttgttggtacctctttgatggtagatgctctcttgaagacattagcatgtaatttacaacacagtggttccatatccattacatgaggctatgttcctctgttctatcagaggtaccacatctgatacctcagaagcattagggaaaatattttttggtgttttcagtgctacaccataatgaatcaatatctgtctcatttttgaagtgatcagattagttagttaaatggggatattatggagactaccacgctccatctttttatctttttaagggtgactctaatctccaaaaatcaccccctcctcacatttgatttttcccattatatagttcagaggctaaggaactaatataggggttctgtcacctaccaggtagctgaaaatgatcactagatacgtccatggccacatgtaacctggaatggggataggagttccttaattaccttgcctttatatgcccatttgcctcaattttaacaaagaaagttatgatgtgatgctttagtctcgagatatcaatgtcagcaattctcaaatggtttaaatatttcttttttcccattatcggaggaaatggctgtaggacccttttaagagaggaccaagtgaatgactactgtataccccttccatgatgttgcaaaatctttctacaagggaatcatgcctttccttttaaaatatcatagatctgagaattgactcaagtctggttagttagaaaagagatcttggctttttattggtgcttctgagttcagcttctcgattatatatgcttgatttccttggattacatagattgagcaatactctagttggctatctatcttgcacctagcaaagctatgttttaatcactttctccttaatgttctgcatgtcatgccaccctggctacccactctaatctttccactcgttaacttaattgtgcccaccttgcatctgacagtctaatatcatcacccactttctactttggaattcgatcatcctccttgcttactgaaaactcagttctgtaactatctatcttactgtcagtgctggcctagaaaggacagctgccactaccttcccagtgtcattggtgtccctctcaccggaacatttctcaacactttgatgaatggaataccctgtgggctcttccagagaacataatcaggagatagatttcctgtgcttaggtaacataccactctgccatccccacactgagacttggaggtcagactgggtattggagctccagagaaggtggaatcctcagtctttagaaaattggctacaccaaattcagggctttgaatgggaagaaaaaatgagacccaaagaattgagatggaaacaactgagtcaaagcacttataaattctaaatctccagatttcaccatgtactgcggcagtggcatttgtgagtatttattgtaggttattgctttttactcagtcttccaagaataatcctagtagtatattattccattcttccagggctattgccaggttgttaatcctttattacaggagagtgctcccatataggtaatctctcccatatccaatatgtcccatgccccttgacccagcaccctcagaaagcagccatttatataatcctgtagggctgagggatacatgtcagttacatcatctatctccttcggcatgcagttcctcttctaacagattcagcacttctctaggttgatcacgctctgatttaactctggtattggccaggttgccaggaggggagctatagatagatcctgaggggggcacatattgccttgcaagactcagttctttgaatcatctgcgaataaggggagtactaaatttaagaaaagcatgctccagttttgataacccagaaggctcagaggaatctggggatttaggatttttaattattttcacccagatgtcccatctgaattctttggatcccaattttccttcccattcaaggttctgaatttggcatagcaaattttctgaagactgagaattccatcttctctgcaattctgccacccagctttatcctcagtttgtactgccctccagttggtggagttgaaaatatcataggttgtcaaggagatcctctgattagttaccctcagccttttattatctccaatgtatccctggaatccagcaatagccatgaggtttcagagtccttctaatggctatttctcaaagaactgagatatgccctgcccttctttcatttccagattgcttactgtcactggaatttccattttatgtcaccactgataacattttaacaattgcaaagcttcaacatgtcaagagctctttgtacaacacagcctaccagcattaatggggtcctcattgccaactggtctatgaataatctagatccacaatctcattttaatgtttgctttctaggacctattctggtaccaaatcttttaaaattgggttccagggaaatagactttgaggcagagatttatatgtcaaagagttattagggatgctcgcaggaaaagaactgtcgggagtgagagaagcaaaaccgatgaggaagaacagtaatgaacttgcaacagaggcctcagctgatcctataggaagttttgaagctgcggtggcccttcataactgttccagatcaagaatgtgaccaggtcctgtaccctcatatgaaccagtcagtggatgcctaacaatgagcaaggaagctgtctttggccaaataaaatttccagtgatagagcctagttgtagccgtcagtagccaatactcctagcaactggagaaataagtcttccattcctgaaagaacatctctgtgacgccccgcagcatccgctacacactgaacacagaatattgaagtgaaggaactgcctaggtgaataaaaaataactatttttatttattgaaacaactatgggttgtttcaaataagctttctaaattaacatggaggaatatatatatatatagatatatatataatttcaacctttccacatttaagtaaaaactgtacatgattattttagtgacgatgctgatgtgctgacgatgctgatgtgtgtatttaagttccagctatatatttctaacagtcttctggcctatagtccagttataagcactaaacttggatttatgtagctctaccatcccgtttatggtgtcatataaatgtttttctttcctgtgttatgtttagatatcaaccatatgtctattattttattattaggattcttttttttttttttttttttttgagatggagtctcactctgtcgccaggctggagtgcagtggcacaatctcggctcactgcaacctctgcctcccaggttcaagtgattctcctgcctcagcctcccgagtagctgggcctacaggtacccaccaccacaccccctaattttttgtatttttagtagagatggggtttcaccgtgttagccaggatggtctcgatctcttgacctcgtgatccacccgccttggcctcccaaagtgctgggattatggctgtgagccaccacgcccaagcctattattaggattcactttacataaagtactcattagtagttgaacacatggatttagttatcttgttgcaatttgaattggctattggaaggaagacaatattaaaagtgtagttgaaaacatttttatggtgagcttcagggcatattatttgaagttctttggtgcctttttattttttattatttaatttggacaaagaagattctatatttattatattttcctttgaaatgggtggggtctcaaatcaccctttggagcataatccagttaaattttaaaagtatttgctaaattggagacatctggacactctggagttaaaattaaataggtataaacaaagaataattcaatgaggaagactaagtaacacaagtatagacatgtcaggccctagtgtatacctttttggagattagaaaaataggttgaagaacacaaatgaaactagcttagaaccaggataactgatgcaaattttcaaacatgtatataaatataatagccagtattacaacttaaggcatttttgaatactttggagaaggctcattaaagatgatataaatgtaggaaactacactgtacacaagactattcaatattagaaatattgagccggataaaggctgaggtgagagttacagtttgagttagatagctgtacagtttgggttacataaaggaatatcaaatgcatagaaatagagtgtttttgttgtaagcttttacttaaagaaagtaatgtaatgatatatctctacaagtaagatttaaggtaggagaaagtttttataaatattcagaaaggattaatgttagatattaattttctaacagtataaagactaagagctaggagttctctgctgttgaatgaggcttctagactacctcacttcttccaatataactgatcaaagacaagtttacagagacagaaaattgaagcaaaacagtcacttgcctgcaggtacttgacgccagtcccccatttctgaaagaacaaccttatcatactgggactccattggaacttctaagaaatcatggtgccaatcctttctgtatgaataattgctaaggttattgctgtgtccaaactaattttttctctttcgtagtaaagttctctcactggaaatgggtaaaagagactacaccatttaaagaaaaaaagagaaggtttaggaagcttgttgtaaaaatactgaagtcacaaacttattaagaaatccactccctagaatcttaaccctgacctaaccattagacacctctcacacagttttttctgtcaaatgagactcaaaaaattgactttgaagatctccacaagcatgtttcattattttcttgcagatatcagggatgtagatggctgtttctgaatcacagctgcagagcagctacatgataatggcagtcatatccatttatatttcaaattaacttaggagtaccatgaggatataatgttgtttgggccctgttaaaatcaggtctaccattctgatattctagggagagaacaataaaaccaacagacctcctatgggtattttttacaggaaagtgcatggctataggggatgatccaatgctggttcacatttggctcatgagagccaattgtgacatccaattctgcattaagggatattacgttggtaggttgattttcagccatagtgggaatatttatactttggtaatcaacaaaccctaaaactcagggcttcctttctgtcttttatcttctttttttaggcttagtgttaaatatttctacttgaaaacaagacaataaaccaggtgactaaagaattactcttaagaccttaattttttttttctagcaaagaacttggattcctgctagaaattcctgctagaaaggacatgactagtggtagagatgatgagatatttatctaaactggcggaaataacatactctttttttagaagttgaagatattatccactttaaaaattatatataggtgaaacccaaagttagctaattctatttgtaagccattcagtttagcatatccactacaaatagggaggaaacaaaatcaagtttatgcagaaaatcaatagaattcattttgaattgatagtatatctatttcctgtaacttttaagaaaaaaatatcctcagccaagtgtggtggctcacgcctgtaatcccagcactttgggaggctgaggcaggcagatgatcaggtcaggggttcaagaccagcctggccaatatggtgaaaccccgtctctcctaaaaatataaaaattagtcgggcatggtggtgcatgcctgtagtcccagctactcgggaggctgaggcaaagaatcatttgaacctgagaggttcaccctggagatcatgccactgcactccagcctgggcaacagagcaagactccgtctcaaaaaaataaaataataaaatttaaaaaaaatcctccagtggtattcctatggttgtgaaattagattgctggtccttctatcttttgtttctctctcttctgttgattctctctgggacctttattatcaacatagcttctaaataaggatgctccataatagaatgaaaaggtgagccacaattctatcagctttttctacttgtaatgggttcttaaaatggtttggtagaaatactgtaacatatttcaagaatgtctataattatctgaaatcctaactatttatgattctccagtgcctctgtcccaatgtataatattgccactacagaatagttgcgatttttgttgtttttaattatttctttggacaactttgaactaaagtagttacatcagctatgtattttgacacttgatagcatccagttcaatgttttattaacactggttagtactgtcttcatttttgatatttataaatgatatttctgccaacagaaagcatttttgatatttcataagtattcaaccacagcaatcagaagttttagggctagtaaatcaatagatacccaatcaaatgaaactgataattgcttatgctcaaagagagttagatttaagtaaggtgctatttagaggttgattgcattattaagaaattgcctgttaagtttgggttaacagctcagaggtgactgagttacctttttggtaatataaagaaggaaaactacttctccttaattacagaaaactgaaaagacaagtccacacattttttttcttcaaatatctcttgttggtctataatcaaccaggcactagattaaatgatgacagtaaggcaaaaataactgagatgactaattttaaaatgtattataaaataaagtaagtatagtacttaggctggatgggccacctgctgtttaagtcaaagcaatgttgtaatttaattttccatcactatttcatctctttttaagacagccaaaccatcctagggaatgtttgatagaaaatttgttgtaagggagcttctcaggagtagaacgtctctatttcagccaaacaaagctttctgctcagcttgtagtattagaaaaacatgcttatttgttcttacttgcacctattttatctgtcatttcctgcaaaataaacttctcaatataaatttctcacttttagaaactgacactttattattaaaataccaccttgtctttttaaaattccctcctttcaatttgggcagaacttgtgattgtgatgagatattactctcttgattcggttatgttactggacaaaaggggttttgtagatgtcatttagtttatttatgagttgacactgagttaatctaaaaggagattatccaggtgggcctgacctaatcacagcctcagccagcaccttaattgcagccacgtaagcccctaagcaaagaatccatctatgccatgatggactcctgacccacagaaactgcaagataataaatatgtgttacctgaagttgctaagtttgtggtaatttgttacacagtaatagaaaaccaatgcattctacatgcaagggagggaaggattgaagaaagaacaagaacgcaagagagtaagagacatgtgtccctcatctctcatgggtgtcttccatccagatccctgttccttaattttctttgacgatagacccacactactcattcttctgctccaacctcttactccacattcacagcatatgggaagggtacacacgtatacatcctttcttcatacatttaacataccctttcacctgccccagcgttatccatttttgcatcaggagcttttaaaagttaacacagaattcctggagggttgccaatttctttttagaataatttatgaaattttaaatgaatctgaatataacaaaatagggcagtttccaagtatatgtagaatattgcaacattcttagagggagaggaatatggatgtgagtatttgagttgtttctgctggattccagtgccctgccccagagcatgatgggccgtgggtgaactgcgcacctgctgctgctccagcaggcctgatgtatgttgcttggttcttcctcttaccacaaacttagcagcttcagataacacatatttactatcttggagtttctgttggtcaggagtccattatggcatatatggattctttgcttagggccctatatggctgtaattaaggtgctggctgaggctgtgattaggtcaggcccacctggatcctgctcactccacatccaccctctctgccccactgggttttcatctccactcagaaacagtcttctttaactggcaaccagataaaatcaacctaagtgaaggagtcacctttctccatattaatggtgcatcatcaggtatagaaagggaactaattaacataaagaaaatatcaagataataaaagaaaatttgttcctggaggacacagatcattggaaaacagagagatcttttaaaaatttaagtaatacactcagaacaatttgtgaatacactggtgtcccccaaaaaatttttttgcatagtgcctaaaagggaacaacttgaaaaagaaagaaccgtcctaggtggaaagctatgattgctaaagtaaaatatttaactagaaagagttgaaaaatacatatttggaagcctaaaaagtgaaaaagaaagacagaaaacaagggatggaaaatacaaaagacaccaaggatcaactcaagaggtttaatattcattcaacagcagttctagaaagaaaaaattaaaagagagggaggatagcaaataaatgataaaagaaaattcctcacaattgaaatacccaagcctttagattcaaagagctcactgaaaactcagcatattgaatgaataagagactcacagatagaattacccttgaactacaaattttcaaggagtctgcagagaaggaaacttgtaaatgagaacattctaaaaagcttctgagatttcaaaaaaatgacttgcaaaggaatgtgaatcagatgagagtcttgagttctcataagcatctgcagattctggatgaaaaaaaatgaatcaatgttttttaagttctgagagaaaatactttcaatctagaattctggagccagccaacttatcaaccctgaagcaatatcaggataagcacattttcagacatggcaaaaagttgatgttcaattcacttttttccttagcaatatgtttagaaatgtactccagcaaaagaacttcctcttaattaaacaggaaactagaaaacaactgactcattccaggatggcaatgaagaaatcttctagattaactttctgcagacctagagaacaagttccaaggtctaagggctctggcagggaggtctccaaggcaaaaagcaccgttaacagaagactacaagataaaactgactaaaagttctcttttttagttggggatgtaataaagaaaaaacgctacaagaaaaattagaaaaaaatgagaaactccaagaaaaaaaacaaaattgctcaaaaactcatgatctaaatctggtataaactgattttaaggaacgattttaagtaattggttatatgtttaaaaaataatttatttgactttaattccaggaacatccttctgtaaatgtcctaaagcaggggttactaaagcaggggttcccaaagcaggggttcccaaacccatgaccatggactgatactggtccttggcctgttagaaactggaccacacaacaggaggtgaaaggtgggtgagcaagtgaagcttcatctgtatttacagctactcctgtatttacagtacattcttgcactagtgcctgagttctgcctcctgtcagatcagtggcagcatagattcccacaggaagggaaccctattgtgaactgcctgtgtgagggacctaggttgtgtgctccttaggagaatccaatgcctgatgatctgtcactgtctcccatcatccccagatagaaccatctagttgcaggaaaacacgctcagggctcccactgagtctacattatggtcagttgtataattatttcattatatattgcaatgtaatagtaacagaaatagagtgcataataaatgtaatgtgcttgaatcatcccaaaaccacccccagtggaaaaattgtcttctgtgaaactggcccgtggtaccaaaaaggttgggaaccactgttctagaggttacaaaatccttagaaaagaatgcaatctatttggcctattattaaacatatttatacgttcataacatagtcataagcatatacacacttttcattatccattattagactgaacatattaataaagttgggtgtactgtttgaagccatagcattgaatgtaactctccacaaccctgacaatgaaaaggttagctggcaaaagatgagatttgggagatgatggaaaaaaggggtgaaggcaacaggcagggaattgaaggaaagtcaagtctttaaaatgtacatgttacaaaatgggaaggccaaagatactgccaaaaatgccatgttacaaaaaaaagtataataactattttatttaaaaatttagggtactaccaaacattagtggaagtagaaagaagaggatgttgtaagaaaaaagtcctcatcttatatatggaggaattaatagatacctcattaagaaagcaaatcaagaaacagagttgtacacaaatggagttgccaaactggctgtaaaactaaaagtagaaactggagaatcagatttttaaaagagaggtgttagaagacctacttttaataatagatctttctatattattttatttttaacacacatgagtaatgagggtaaagcatattattttaaactggattgtatttggtcataggaactgatagaaaaaaaattaaaattgaaagccaaagtataaaatacatggcaaaacacttcaaatcctgaaatgtttatatatgtttttacaaataaggtatatttgacaaaatgttaacataggtgttatatgtcagtaattacactattatccctagcaggttagggagctgacattaagccaactaagacaaacttagacacaatggggaaatagatttaaaaattaattaaaagctatttccatttagttagtctagtttctacccaagaatgtcttctgaattaactttcagacttcaaataaaccataactgaaataactaaatgactcccaatgcagtaaataattttactgagcataattaataaaattgaatatctggcttactgagtctggaataataaagtagaatgaacaatggaatagaaagaacccagcaatgatactaaggtgagagtacatatttagaatgcagttctgggtctcaaactcaaccatatgcgaatggacttgtgaagaacaaataggttttttgttctcttaccttaataatgatgggtgtccatttctacaatataacttttcttttttctcaaccctcatactttcactgaaagcacattcatcaagtaccatttattgaaaatgctgttctatattcaagagagagtatcagtatgtattggaaaaaggaggtatgtgtagatgttgtgcatttgaatgactattcaaaaccttactttcttgtgtagaggagataacacttaataaagtcaaagtcctttcaattgtttaactttttaaaatcagaaagtcatggctttgaagtatttgaaataaaaactggctttcctggtactacggaagcttcaacttgactctgcttttcaaacttcaaaaatcaaaagacttttatttggggtatcaaattccttgcttttataaatatgaattgcttggagaaattatcatttttactactgtaatatgaacttttgacaggttcttttgaaaattttttaaattgaatatgattgtgtgttcttcttcattagccagaagcaaggtcaatattttgaaagttcagcgtttctataattttttaaaaataatgaaaatcagggtcaaacttggaattttttaacatgatcttatctaaagtgtgacctaaatcataattcatatatggattataacatgggaatttaagatcaccaattctataaggtatgttattctctgctcctgcagctgaataacgttcgaaaccagaatcactgaaacttgttgcagtttcagactaagaccatactctggcatcatccctctccacagagaagaaaataaacacaattctgaactgtcagctccagaagctattgctcctcatctcatatggttttccttagttctagtaactgggctcttcattcatgcacatttgaccaagacctccccttgtacctcagttcaaatgaatgagtattttttttccttattctcagatatatatttattcattgacccatttatcaatttttattgcatgcctattatattccaggccacacaatatgatgggaaacaatcgttcttacctttagtaaacttaaagtccaacagaagaatgaaataggtcagtagtcttatttgactactgaacccggtatcccagatttgcttccctaacccagtcttcctaaatgcttctagggctggagtcctacccagagcccagtcactccacagttggattttgacagctttttgcaaagactttgttgaaattgacttgccatttgcctggacttgacatttggctaatatctgctgttggtccctggcctgatcacagacacagaccccatgaatatttctgatttcttggatgtgctaattcccattctgtctgtcttagtgacaaacaattcagcccgctctcatctctccctttgtctccttccccactgtctttgccttaactcagactttttttaatttcttgcctaaacaaaattttcttctaaaacaatttttctgtcttattttcctactccaacatataaactatctgctctatttaaaaagacaactattacttgcatcaaaaatgttgaaacccgaaagttctctgaattataatttataacataaatatacccctgaaaccactactcaagtctaagaatagaacattatcagcacctcaaaagccacccacaagcccactcccaatccctttctgctccctcatctccagaggtaaccactatgctgactgataacaccatacgttattattatattataataacaggccactattattgaactgtaaacaaataaaagcacatcatatatattctgtaccctggctcttatgttcaacatcacatctgagagattcatcatgttttcacatctaggaatagttcattcaggtttgttgctatgcaggataccattataagaatatactactaattattcattgtattattggctaacatttgaattattttcatattagcttattacaaataatgctgttgtgaacattcacaaacatgtaaatgcatatatgctgggttataattaggtgtgaaatttttctcatagagtacgtgtgtattcagctttaataattgatgccaaacagttatccaaagtagttgtgccaaacatagtgtatgagaatatacccacatgctttcaaaaacagttttgtcagtcttgtaaattctaacccttccagggagcgtgttgtagcattttattatagtttaaatgttcatttgtaaattctaacccttccagggagtgtgttgtagcattttattatagtttaaatgttcatttctcttatgactaatgtggctgagaactttttcaagttaattgactatcttggtattctctattatgaagaatgcctgattcaaatctcttgttcatatttgttttgggttttgtaatggttctatatcttggtgacaagttctttggcacttctattgaaagatggggtctatgtcccctcctcttttctttggcactcctattgaaaggtggggtctatgtcccctcctcttgaatctgtagaagcttgtgatttcaataatagaaaactgaggaaataacgctatgtgacctgggactaggtcataaaaggccatgcattagccacattgctcactggaaaacttgcttttgaagccctgaaccacaaggtacaaagctcaattcccgtgagactacaattttaaaggggccatgtgtaagcacttctgctaaataagcccattcttccagccattcccaacaaagcatcagacatgtcagtgaagctgttctgaactcacaacactagctcattctccaaatgaaactactgaatgatctctgtcgacatcattaaaaatggaagaatcatctatccaagccttgcctaaattccctattcataaaatcatgaatcataaaatggttattttaagccattaagtttggggtttgtcatatttcagtagacaatgttaacagaatttggtacctgaaagtaagataagtgttataataaaaccaaaagtatgtggcatcggtttggagatgaccagcagccttgaagatgctattggtaaaggctcaaaagaaaatgagtacactgttattggtggtggaagaaagcagaccctggctacgtagctgtggaaagtttggcaatactgttgcctgtggtaacataaaaagttgtcaatgtacctaataaacttaatggtctagctaaggagacatctgagcagagtgttgaagatgctgcctggcttcttctagctgcctataataaaatgagagatgagacagatgaactaaagaacaaaatattagggttttttttttagtagaatttggaaaaaacataaaggctcaaggtagtcttatatcccacaaaatatccataaaataaaatatagctgcaaggcaaagatcaaatcctgggcattaccagtaaaatattaccctggggaatccaggtagggctgaaagtttctttattaagatgttagaaggacttaaggtggcgcctcatagatcacctcagttaaacaagagtcttaagtaatgttaagggcattatttaaaactctctgctagaccatagtgcttctaaaggtattatcctgacgatattatcacagtggtgttatgagttggggaggttactctcaaaaaggtttgtgagtgaactttttgtctaatggagtagctcataaattgatatataagcaacctaaaggaattatatcagcttggactagaggggatagacagtacaaaatgaaaagaggcatttgaactctgaacttttatgtacagggagtaagctcagaaaaccattcagctgtgaacacaagctactctccatggaaaaattaggactccaaggaaagcatcaagacctcagaggacagagccaagattcatggagaatcattcttagaggggcagttctgggtcctaagcaaagaattggcaacacacacttgggaaattctaggatcactacggaccagtgactgctgtgcaccttttatctcccacttttttgagcagagtgtctactgtcactatcttatgctgtcccaccattgtatacgggttgtgtggagggcagataacttgtctgtttcacaaggtgtcacatgaagaggagtgataacctagaaactgaacctaaagcatctccttcacacatggacataattcagattatgagacaagattgtgaaccttgagccacacaggataagactttgggaagggagtttaaaagggatgagggtgtttttcacatggaagaaatgaaaatgatttgcgaccagaggttgggctctgacaattttttgacatggccataaattctttgacattccttcaatcaaatagcaagatcattgttttcttcctttatatctttgagggcttgcagctgctttggtcaatagagtatgattagaagaaattctatgtgatttccaggtctaggttaccaaagttatgaagctgcttttttatttgctgaaatgttcacttttggagtcctgagctgccacataagaagcccagttaccgtgagaacaccactctggagaagcaagtgcaagtatcccatctcagctaggcttagccttccagccatccccaacaaggtgacagaaatgtaaatgaagctgtctcagaccctccacaccagctcatctcccagcatataccaccagatgactctgttggtgccacgtggggcagaaaaatcccccaccgcaccctgtccaaattgctgaccaacaatatcatgagctataagaatatggtagtgggtataagcctctaagttttggagcagtttgttacacagtgatacataaccagaatagctgtcttttccaaattgttttgttagtgttctttatacattctggctataagaatatacggtcatctttatttttttttacttttacaattaaatttacaattcacttgatctatttgcttatcctgaataaattcaacactaattattgtaactcagtaatgtcttggtatcccactttattattattcaatattatcatggctattattgatcctttgcttttgcatggcacctacctgcagggagcagactccctgcatgtgtacattcaaggccaaatagccaagtccccagaatccttgaattcccttaccatttcctgacaaaaagaacaaataaaatgtgaaaaaagaaggaatgaaactgttaccacttgtagcaaacaagattatgtatgtaggaaaactatagattcattttgcctaaaacaatttcatataaatgcagtcatacaatatgtaatcttttgtgtaagtcttcttttattcagcataatgttttgaagattaatccatgttgttgaagtttatttcttgtcattggtgagtttattatctgaatatattatagtctgtttatccattctcctattgatggacacctgtgctatgtccaacttttgggcattttgaatagttatgaacactcttgccaaatactttctgttagcatatatcttcatttcattggtataaatgcatggaattgatatagctgggtcataaggtatgtgtaagttttagttttataagaaactaccagagcattctccaaattgttagtatcattttatgttctcaccaccaatgcacaagagttccagttattctccttcatatcaaaatgtagtgttgtcaatcttttttgttttagttattctaatgaatgtggatggtgtctcactgtgattttaatttgcatttattttatgacgaataagttattttttcatgtgctcgttgagcatttgtgtatctatctttatgaagtgtctgcaccaatattttacttacttttttgagttataggggtgctttctatagtctcagaaccattcctttctcagatatatgtgtagtgcatattttttcctaccccttggtttgcttattcatttcttagcaaagctaatgttcctctcaaaactttatgagaactgctattcttctgtatgtaatttgtcctttttttcctggctacttagaggatttttctcaataactttgaatatcagcaggttgaccataatgcaaggttttctttttatttaccctgttttggttttactggtttcttacctctgaaacttatatcttccagcaaatatagaaaaatgtcaaacatgaactcttcaagtactttttgcttcattctctctttcctctcttctcggactccagttgcaaatataatagacactttgatattgtcccacagggacatgtctccgggctctcttctctgtcttctctcttctgctcttaagccaatacagtgaatttttatttcagattgcatttttcagttctagaattttcctgtctacttaagcctagtaaacaggctttaaagaaccatcttgagtagataatatatcttttgatatgtaagagacacaggattattatctgactcctacctagagaaatctgataccaagaggctatatggagttggcaggaaaagaaaaagaagcctgagttgggagtgagctcctctcccatacagtgaagcaatggtgtgtatttccccaggtctacatgttgtccccttggaaggctcagattcatcataaaagggattctgcctaagagaatctcatggagaccatatgatcccaccatagtaataagctcctagaagcctagaagctaaagagaaggttgttgacagctagcaggagcaaaggcaataccaggtgaatggatgtgtaataggagatctctaaacaggagatctctaaaaaatttctaaaatgaatccatgaaaagaaagatatcttcctctgagcataacctaaagttgccccaaaacatcagctaaaaggcaacttggaataagaaaagaaaatagaatttgaccagatattccacctgacttcaagcatccagcctgttgcaggctaagctggacaagcagagaagcattaattggatcagagtggagattgtaatactacttgggaatgaggatgtatgatcaatacactagaatagattttattgtaatccttccgtgactagaaaacctatggggtttaatatttaatgtaagggctgaaaaaatattaatgcagaaagcaaatttgaaattactaaaagagaaagaataaggttagtatctgcatatgtgtatctgtgtgtgtgtatgtttgtatgtattcagtagcattgtaggatcacttctgtcatattatatccatatattaaagttatctatcaattatatgccttcatggtatatttatacacagataggattgtctgtgtgtctgtgtgtgtgtgtgtaaaatacttaaacattggccgggcgctgtggctcatgcctgtaatcccagcactttgggaggccgaggtgggtggatcacgaggtcaggagatcgagaccatcctggctaacacggtgaaaccccgtttctactaaaaaaatacaaaaaattagccgggcgtggtggcaggtgcctgtagtcccagatgctcaggaggctgaggcaggagaatggcgtgaacccaggaggcggagcttgcagtgagccgagatggcatcactgcactccagcctgggtgacagagcgagactccgtctcaaaacaaacaaacaaacaaaaaaaacaacaaaacttaaatattgacagtgatgcatgggaaaattgtatcaattttttttttagtttttagattttttaacttctacaatgaacgtatattctatttgacacacaaaaaaaatatactgtctttttcaatggactgtgagtctcttagtctgtttggtctgctataacaaaataccatacactgtgtagcttataaacaacagaaacttatttcctacagttctggaggctgggaagtccaagatcaaaatgccaacagatttggtgttggtgagggcacatttcctaattcataggtggtaccttcttgctgtgtcctcccatggcagaaggggcaaacaagctgccttgcacctgtgttctaaggttcctattgccattcgtgaagactttgccctcatgatcctatcacctcccaaaggtcccacctcttaataccatcacattgggcattataatttcaacatatgaatcaggagagacaccaaacagagtatagcaatgagttagtacttttcagttaacaaacaagtatctcagatattctaatcatgtcctcacagttatcatcattttcaaagttttgattttaatggtttgacacattagagagcaagtatttcagtatatttgaaggataaatcacatttaattccctttattaagtgatacacttgaaaattcccaaatactattgtaacattctccttaaggaactgcctttatttagactttcttcagtcttgaaattccattgtgatactcagcctcagagctgtaacatttgtcacacagataatgctttttgtccttgactttttttctctgtgtgtgtgtgtgtgtatgtgtgactatctcctaacatttttttttcatctcttctcttccctggatattgattacagcattgaagcatctgcctaagtttttactttttgaggctgtttgacatttaaagtatacataaaaaattctggtaaatctatgtgctttggtcattctttttttatttatatttttgctcttttactgctggctacataaactaaactatttacactccctcagtttttatgctgcctgtgagctaatcatttaactttaacatacattttattttgtcattgaacttgctttcaattattttctcctaacatttacagagagaccttacacatagttactatactgtcaccccatgttaatagctctctgctgtgggttctagacataaatgggtgtgtcagggtcctccatttctatttttcccccttacaaataaatgctttaatacattgaatgtgtaacttgctgccctttctacttgcatcttctctggttcttttaattattttatatcaccctgttacaaatgggtcataatctaaatatttatttggtctaactatcaaatgtttctttattgaataaaattcacaaaaatctgtggaaaaaatgcagtcaagaaagagggaggtaactttaccaaaaggctaaaaatcaagctgattaattcaacatttcttaagtttactactaaatatatataaaattactgaggaaaaaaaatcgacagtgatttccttttctaaattctgtgataatactatgcatagagagatcagtgtaataaatttcttaagctcaaaagataatcaaggctaaaaaaagaagtcatattttcaaacctacaatttagtttagattggtttaaattatagaatgttctggtacccagaatcaatctgcaagagatgtagcaatcttgatgaaggtctcagtaaattctttctttacttctagagggagtttaacagatcacatactgcctttacaaagtcctgtatttcataggtaacaaaatacccagtcagtcaaggatcaaatgctaatatgtggtgtttaatcacccaggagtgaaagatgccattgcataaagatatgattcctcccctagatttcaaagatatttaaacttctcctgcatctcaattctcctttaatcacaagaaaatcaccatgttatttatacggtcagtgtaacccgtaattgcaattattatcacatgaaatatatcaaagccactaatttccaacctgcttctatcacacttgtggttcaagtatggtagcatgtgttttgcagtgactgaattgtattaatgagaaatatacatctgaaaatataggctgtagaaaccaattgtcttcactgatgtcagtctcttcccattcatgctcctcaataaagatatacacaaaggataaatacttgaggggatagatatcccattttaagtgatgtgattatattacacattgcatgcctgtatcaaaacatgtaccccataaatatatatatgtaccccataaatatatatacctactatgtaccccaaaaaattaaaataaaaaaatcaaaaaaatgatatacatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcagcattatttctgagggctctgttctgttccattgatctatatctctgttttggtaccagtaccatgctgttttggttactgtagagttgtagtatagtttgaagtcaggtagcatgatgcctccagctttgttcttttggcttagaattgacttggcaatgcaggctcttttttggttccatatgaactttaaagtagttttttccaattttgtgaagaaagtcattggtagcttgatggggatggcattgaatctataaattaccttgagcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatctggctctctgtttgtctgttattggtgtataagaatgcttgtgatttttgtacattgattttgtatcctgagactttgctgaagttgcttctcagcttaaggagattttgggctgagacagtggggttttctagatatacaatcatgtcatctgcaaacagggacaatttgacttcctcttttcctaattgaataccctttatttccttctcctgcctaattgccctggccagaacttcagattaaagacttaaatgttagacctaaaaccataaaaaccctagaagaaaacctacgcattaccattcaggacataggcatgggcaaggacttcatgtctaaaacaccaaaagcaatggcaacaaaagccaaaattgacaaatgggatctcattaaactaaagagcttctgcacagcaaaagaaactaccatcagagtgaacaggcaacctacaaaatgggagaaaattttcgcaacctactcatctgacaaagggctaatatcaagaatctacgatgaactcaaacaaatttacaagaaaaaaaaaaaacaaccccatcaaaaagtgggcgaaggacatgaacagacacttctcaaaagaagacatttatgcagccaaaaaacacatgaaaaaatgttcaccatcactggccatcagagaaatgcaaatcaaaaccacaatgagataccatctcacaccagttagaatggcgatcattaaaaagtcaggaaacaacaagtgctggagaggatgtggagaaataggaacacttgtatactgttggtgggactgtaaactagttcaaccattgtggaagtcagtgtggcgattcctcagggatctagaactagaaataccatttgacccagccatcccattactgggtatatacccaaaagactataaatcatgctgctataaaggcacatgcacacgtatgtttattgcggcactattcacaatagcaaagacttggaactaacccaaatgtccaacaacaatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcataggtgggaattaacaatgagaacacatggacacaggaaggggaacattacactctggggactgttgtggggtggggggaggggggagggatagcattaggagatatacctaatgctaaatgacaagttaatggaaatgacgagttaatgagtgcagcacaccagcatggcacatgtatacatatgtaactaacctgcacattgtgcacatgtaacctaaaactttaagtataataataataaaatttaaaaaatgagaaaaaaataaaaagaaaaaaagaaaatgatatacattttactcctgaagtaaacatgttaaataaacacattgcttgtccttttgatcaatgtcagaaattgtggggaaaaaatgagaaaaacattttcctacataggattgcatgcaagtgatcccaattgacacaatatggaagacagtggagaaatatctaggctgcccataatttatcaatcttctctctgccctcttctctgtagtggacatttggtgtctgtcaaagaacaaaacaactatgtatacagtacttgcaaaaaattaatgttttctaaagcattttaagtttttcttttcttattttggatgtactgaaagccccaccccaaccatatttctctcttaattcatagttatatactctattttgcttcttctagcagttactctagaaatttcaacataaacatttaccgtaaagataatccatgttaactcttcagaaccatgcaagaacctataagcaatttatctcacgccacagttttctctcttggctaaacttttataaggtgatattttagttctatcttattttttaacactaaaaattatgttaaaattttaataatgattttgtattacctacatgattactatgtggttgtctcaagttttcttcttctatctcatacctttcttttgtggtcatttgtattctggaaaatgttactggcagtccattcatcccaagtaatctcagtgtttgtctctaataccctcattttgcctattgtcttcaaagtcttattaatatggatttgtagggaaccattttctttcagcagtttgaagacatccttctgtctccttctgtcttctggctcccactcttattatggagatatcacttttaatctaatagtcaccccttgaatggtccctgtcatttctttggctactttatgatctcctttgtatctttggttctctgcagtttcactatgatgtgcccaatatgaatttctttacatttattattaagattggtgctttttatcaaaagcaccaatggattattatgtcattttcttttggaataatttctctccatatcctatgatctcctactgaaatgccaatgagaaatatcttataccacttcacactattctcctttttgtcaactttaatattcccatctctttgtctctctgggctacatcctgttcaatttcttttcatgtatcttctagtgtattaagtctccctttagctatgtctaatctgctctaccccctcccccagtcttctgagtttctcatttcaattcttctctttctcctttgtggaaatgctattttgttctctctaaaatgtgactagacatttgtatagtctcttgttccttcatcattttctgatattgtcctttattttttaatatattcaatgtgcttattttagtattgataatactattatctacaatctttgtgggtctgacttgcagtccattattttttataactctccttcatgtggcttgttaccttatttattttgtaattgtatttattgtgacctctgtttcataataattctttgagaactggatttaaagagattcctctagggaaggcttattcatgcttctgcaggtatctagggatgtttggattcaagtaaaatgtcaaactattagagtcagggcttttcaggtcacataattcatgtgaatcctgggtccaaactcttaggaacgtgagtttatgattaacaattttcctggattttaaaaaacaaaatcctgtttcttgtctacccagaaccatgctggaacctgcacatattcttgatgtatctttctgaagtgcaagtttttctccaatttactcaatgttggcgtctcccagagctgcaatattcaacttcagtgggtactattcacattgtggtccatgtaaaaagcattccctggaggtgtgtagtgtcttatgcgatgctcttggtgtcaccatttggacatcccagttttaaatgagcatctctgatccgacccttgcatctacccaagcttggttttctttccccagatcacttgatccattaaagtacacggttttctaggtcaccagaaatgagcagatagatcctttgggcaaacgccacctttagtgataccttatctttagaaattttgcttattagttttccctcatgccaaactatagcccactctcccatgcatgccaattaatgaattttaaaagatttctcacataatctgtacattattgttatatgttttttactggaaggggttctctggacatttggtttatcatattatcaaaagcagaacctatggaatctaccactgaaaacagagacctaatcactcttctttctgcttctcataccacccctgtaggcagaagagtcattagccatggtttcagataataggagctctgcttgttgcagtcttctgtactctagtggctttctttgatcatggagagcctccaaggactcgaataataatgggagttgggggttgaggggcacacagttagaaagggagaacaggaggaaacttgtacttctaacttgtcaggttgatcatttgttcctatgtttggtattcttggcttccccttgtcatatacattgttatttcatattataaaataattttgcctactgcatttagaacctatgacttcctaataaggaattcattgatattaatttgctacctttttttccttctaaaaaattactgactttcttacagtttcacagagttataagaggaaagaaaggatcagttattgaaggcataatataagactctgctgtgtactatgtatgagttatttttattattcctattttatagagaataataacagcaacaatagtaatagtaataagagctaatatctattgtcaggcactgctctaagtatttgacgtgtatcaaatataatcttcacaacaacctgtgggttaagtgctatttctattcccattatatagatgagaaaataatcttagagaagttaatttttcaagtttgtataggtaatgatgataaattgggggggtttaaactcaggtctgcctgactgcagatcctatacccttactatatacaaaataggctactctcctaaaatcatattgggcatttgggaaggcagtatttttacttgacaaaacaacaacaaaacagcatttttggtgttgctaaagagttaatacaactttagagcacgagagagaatattttatcaaactgaaaaaagtttaatgctttggcttttcaaagagcatttaattctcataggcatgcctatcctgtatttcttcatcaattgcagatgaactattaactttcaaattggtcactgcagggttctatttacatctttaatagagtaaatatcaaaggaacataaagtgtaggttaaatctaagaggattttcaagagaaataagtgatgagagcaacagaatgtatctcaatgccctatatatcagtaaagaattaattaaatgtattaaggaaaatgtagtgtcaatttgctctaattgagaaaatttttgagataaattattaaaaaaacatttaaatgaagaaggtttggtctgcataatctgcaggaaacttgtctggccaccaaggacttttttgctaatgagctttgacttggttacagtccctctgagagagaagatttagtctacaattggcttactaatgagcactgtcaacatgtggattggtctcagatgctctactctaaaacaaggtggaagttatcctctcaactaaacttgttgaacagaacttggtcagcaattttccctaccaccttcagtcagctacaaatcaccacaattgtgtaatattctggacaggatataacgaataattattgtaatatgagatgaattataatttttgaagcatcaggagtttccctttaatagctctcccagccaaataactgatggattatgaattttaaagatcaacattattagatatttcctagatttaacatatattggaatattatttgagcaagaaaaacaaatattttctatatttaagcaagtctctttaactcttaaatagctatactcagtctgggtgttgacatgtcattttaaccaaagagaacaaattgaaaagcttaactttccaccaacttcacttttataaacaagttctaagataatttgaaataaattttgaaagctctaaaattttcacagaaacaaaattctatagtttaccatattgttaagcaagattgtgattgtcattttttctgagatagatgcaaatccatttatcctaaaagtttatcactatgcagttatatacttaattagtccactagggccaaaacttttcaaaatagatgaaatcactttagtataatagtgttgctacaatttaaaattatcctttgctctgtactagtgcagggaagtttaaactttccctctgaaggttctataattgaatctgctgaaataaactgacaatagacaaattagctggaggcaaggcttacaaatttattatgtgcaagcacaggggagtcccaaaatatatgagactcaaataagcgtcaatggttgaagcttaaataccctctttctggggaagaaaaaagcgaggaatgtagtcaattttagaggaagagaaaatgatttttaggggaaatgaatgggcccccaaaaatctaccacagcctgggacaaggttcatctggactctgagtgtagtgtcaactctagtcttccttcttgcacgacattcatgaatttctttcagttaacaagatatgtggagaagggattcacaactgaatatattctggaggatccagcttttaggtagatagggaaacttcagagaaagccttttcactgcatttgctattcacgatgttctctcagcttgaagtccaaaatggcatatattggggtatcattttatgacccccagtgctagttagaaatggccaataatttaatattaatcggtaatattgatcagtaaaagcactgatgtgtgctttcttgatttgcttcaatcttcttattgcgcaagtggttgggacactaaccattatttagaaatctagttatcaagtaaatgaaaattcttaggctacattctacacataaacacactcatttatgttttggcctttgtttctaagcttatctattattatagagtcacattaaatgtgaatggttagtctaaccgtgagatcactccttaacctaaccttagttctccctgcagctatctttaggaagagaaactcaaacacttcatccaggttgttttgtttaagcatataaccaattttaaagtttattttagtagagatggttggacttacaacttttgtgttgctttttaacttgtaaatttagaaggctctgaagattctggaaataaaattctacttatcagagacaacatccccacttttctttttagctcctgtccttttatgtctttttaaaacccaactccaagtagaccctttcttctgtgaagccttttaattatttacttcacctgtttccaatcattttgcacagcattcaaaaattcacctcaaattatatttcacaaagagataattgcgttatgttattcttaaattgttttattgttgatatcttatctgcagctagggtgaatgtttatcaggcaataggcctttcatctttagaactgaagatatctctgataactacttctcttctggagagaaggattatcagtcaggattgtttactgtggtaacaaacaatccccaaatttcagtaacctacaggagcaaagttttatttctcaatcacataaatgttcattgcagggacttagattctggttcatgtcatcttcagcactggatacaggttgaggaagtagctactattctggtatactgttcatttcattataaggagaaggaggaaactgataaaacatgtcacttccacacttatttggtcaaagtaagtcacagagtcattcctaagtacatcagaatgtggctgtacacttcttccacattgaggagctgaagcaatcttatggccaagcctgaattccatgtttaaggaagaggtcatacatgatactttgaatttaaaacaataatgctttctaccacagagggaaaatatagaaagataatgaacgtatatcagtataactttatctagctatttgttctaaatgggtgaattaacttgatatttcatttttcacaattctttttttcttaatgcggggaatcctgacaatctcgcatcctctccagcctcatagcctaatatcttgccaattgtttcctcctcactgtggctagttgataaagcattacataacaaatatatgtttaacaattactatttaatgagacagctgcaaaaataccttatatcagttcctcttgaaattgcaattcaccaagcatagttccaagttcattaaggaaacacaagaaaactcaacatggtacttgatattaagcatcttataattttataggaaagttaaagtacaaatagctgtaattcagggtggaatgtgatgaatgcttaacaagaaataaaaaaatgccataataacacaagataggaaccattcactcacaaatttggagccacttaactgccccaatttttgtcatttccatctctaaagttccattgattcatatttgtcttccttcaatgttcttgaactattctttaataccaggactcttaataccattttcttcttttgcactgcagggtcaggttcatcatttcttccctctctcctattactttaatctctacctttttgttattatgttttctccaacttaccacttttcccaagttttcttccccatcaataattcttctgaacatatatttcactttccttatagttctaaagcttcttgagctagaagtctcgatgtactacctgtacttctgcaattctcattcatgactccaaccactgtaatctgcccctgctatcatcctcaaaaataaaagggcttctcgatggctaaatccaaaaatttacatttctgcccttcactattgaaacctgttgaccgctccttatttctttaagcaatattttctcttagtttctgagacatctctagtctcaaagtacatatttttaaatcaatttccatacttttaaatattattttaatgttgatgtgtcctgtggacccacatttccgtttaccacatggatatcttacatgcaattaaaatgcaataggttaaaaactgaccctgtcaacctaaaaagaaactcactcagagagacaagctctccagaataaatgaatttattttggaatagcagagaatttcaattcagagtacacaagcaatggcaggtcatgggcatatgcaggggggctgaggaaagagggcatcttttaaagacaaagaaaagaagttcatgtaagctattttgaaaccaaaggttacaaagaccgaaggtaataggggttacagaagttggtgttagctaatttctaggtgagtatccttgggcaagcaacttacctggaatgctacaatcttgaaaaagttcttgctataagttttgttcacagtttatgtggaggaatgtcttttgagaagtcctgttacaaacattcaagcatgggagcttctttctcatggcctctctcaactctattttgttagaatttgacacaagtggctccgttttacaacccagacgtattctttctttagtattctctaatttgactaatgggttcaccatcccttctaatcaagaaacccaaaagatttagtggactttttaccaccttcacaccttctcatttctaaagagtcaccactatcttttcattctattacaacatgacttgtaattcttcctgctcctttcctctactctactatagtatccccagtgactagtaatgtcggacatataccagattctcaataaatatttgttgaattaattaactcattaccaccttttgatgtttcttccatgtaaaatgtccttcatttgttgtacttgtacaaatagctcaagtcacgctttctccttaaaatgttccctgactccaaaaagaggtacttactcctctgtgttcccatagtactttgttaataagtctattataggtgaaagttatttaccttttatgttatatttatgctactgtttgccttatttttcccattagacattgacattcttaaggacagtcatcagagtgctatttatttttggtatcctcaccgtctttgcaatgtttaggtgaatcagcacagggttggatattgggatggatgtgaagttactaaaagcttcaccgaagagacagcatttaaacagtgctgttttcaaagtggtttctgattaaactgaaagtaaacagcattttctaagagtgcccagaaggctaccttagctgaaatacagggacactttggaggaagaattcatggcaaataagggtggggtggtagatcagagatgattgtggggtctcctgaatgacagataaatgcattccttttttttcctttgggcagaggtgaactatatatggtttgtgagcagagaggtgtacctttctcaaatttatagctttaggaagttattcagatgtcagtatgtcatgtgaaatggtacaaagcctgcaaaggctattggaaaaatattgtgacaatccagaagggaagaaatgtgtaaatgagaagtaaaaaaagagaatggtaaggagacacattgtaaaggtaccttccaaaggaccaaggaatgtggctgctagaggataaggaagagagacgataactgagatttcaagcctgagtgacagaaggcgcgctcctgcttttaacaagagataggaaatacaagaggaagcatgagtttgtgggagaagattatgagttcaattttggatatagtgagtttgaagagcaaatatgaatctgaacgtgaatatcagcacctacttaaactcttcatatcaggattgctttcctttccctattaagtgacttgaagaactgtcagttggtcagatattcaagaccaaattctttctgctaacagcagcctttaataatgactgccattttgactgattggaagatgctatcctaatgtgatctaacagttgaagcataaagtaccactaccagtgaagtgaataacaaaattacaagacatcagaaatgtaaccctatgaattttaaatagaagagaatgcatgcttcaggattatttttatataatatgagggtagtgttaagaaccaaatggaaaaaaaatccttgtttccccaaattgattaaaattttgatttttcacagtatttccattatgatataaaggtgactgatgctcatttcctatactttagatcttttgaaatacattaattttccctgctgtgaaaaatgacattcaaaaacagggttgtagggagagatgacaactttattagtctgtcgtataaaacaagttcttcactctcttcaagatctgtttctttctacaagtgacagtctgacatattctattatcaaattctaagtagccttgataaagcaccaataaatttatccttacaactaaaaataaaaaggaattctataaatgcatacctaggaaaaaaatgttaagaggctggtcatcagaacgattctatttgccaggttttttttttttttttgagacaggagtctcgctctgtagcccaggccagagtgcagtggtatgatctcggctcactgcaacctctgcctcccaaattcaagtgattcttctgcctcagcttcccaagtagctgggactacaggtatgcatcaccactcctaactaatttttgtatttttaggagagatggagtttcaccacattagccaggctggtctcaaactctgactttgtgatcctcctgcctcagcttcccaaagtgctgagattgcaggtgtgagccactgcgtctggccttgccaggtatttttaaaggactcttacactgtgattcctgtgcatgactgatactgtgactatggtcgtagcaggtatagagcttctaccagtagacttttccactatggaggagagttttggtacgacctacttttgtaaagcattactcagactagaaatatttttaaattttcttagagaacgattactcaacgcagtgtaaagtgatggtttaaaaacatatatgtttctatatattatcatttatggattatatccatttataatccataaacgagaattccagtagataactctggggattttggaatttaatgaatgtgtatcaaattaagatctgtgcattatatcatttatgcattgaatatgtttgagttaccataaaatcaaccaaacatggtttgattgctgcctgaatgagcttctaatcattggaaaacaattggaacacagcagggaaaggtaaatacacaaagagaaagtaatggaattaaatgcccagtgcttcagctcctgccatctgctttaacttagactacatgtagtacctaaacagcttgatatagttgaaaaaaaaacacatttgttagcatgaatgctgcccccaagtaaactttcctagcctgttacatcccaaaatctgttatactcttttcagatcgaagccttaaactctgaagcccaattacacagaggtggtaaggaaggagagagctatatctactattgctcttggcctctctccaactgcacctctttggtcaccctagggaggagggttcctgtggggaattagtgggggacaggattggaaagttggcagagacaaaattcttgttgctttaaaatgccatatcaaggaattgaatttgtaatatcttaatgctttcatacagaaaaggttaagagtgatgaaaaaaatatttaaaacaaatttttaaaaaccaaacggctagactctcaagagtggaaagtttggaacctactataacaattcatgtgatcaataaacttcacatctattataacaaggcaaacgattcatagttagctgcacttgtactgactgatttcctgtaaagcatactttcattatctttcatgcatgtttgaaaccacctattctggtatgagagggaggaagagtttcataacattaaagaaactctacatcaaacttaactgaccctaattagcctaatggattaatgacattttagtacttatgatttatagtaaacacctaaaagcggaaaaggcttctatgatgtgtgattggaagtagcagttctacagggaaaagatgaaaactctctgaactcaaagaagattcttcaggaaacatagatagactacataaaataatgcctttactcccaacatactttttaaaaattctgtagacaaaatgattttgctgtttcatataaatatactcccaactctctcatgccctttttccctaccacttgtccagtgtgacacattgtcttctgattataatcatgctgtatcacccagctccactttttttccttgaagaaaattctgttgctggattgtcattctaaatgttttaattctatcaatttctatctcttcccacaataaacatcattctcacaatatatgaacatttttcccccaattctctgacctatatcttgaaggttagaataatataaacacatgataaaaagctttgaaagcttttgtgcagacatggtggttagaaaaaaatgttctccttttaaagacaaggatctcaatattgagtttttcctatcacagcttgaactttctatgaagtctacggagcctcctctttagttacataagcaaaccattaaaatgctctctatcagtcccttgtcattagcatatttttgaaatcacttttttcatcatcgcactagttatatgtttctttcctaaaatgtcacatctgttcagatatcccatgttcttctttactcacacctgcaacccacatttcattctgcttccaaccctatcttttcctgtcttttcttatcaaacttttctactataatatctcctctgatttcctagtctgtggtcaagaaaaacctctctacctctttgcttcattaatacttggtgttctctcacaataaggcccaataggtcattttcacaagtagagacttcatttttcttttctcagcataaggagaaatttatttttgttctatttcatcctacctcatgctactcatctcaggttagcataaagtagttcaccctgttttgaagcaaaatttctacccatatcaacttaatctcacctcaatcaacaacctctgggccatccttccctatttttggaaaatagtacctagtccatagttaccctctttccactattactattatcctgaacgaatgtaaaagatggtccatctactttgattagaatctaattcagtctttgattcctcgtactccaatgacagaaattcaagtcagtttagaaactaattcacataatcacaccatggacctttgtaattagctgaaacccttatacctctaagaatctaaattctgaaattcccatttctgcctatatcttaattttacaattctttatcacctctactctctttcatatccccttaatcaaaaatcttcaccagaattcctcaatacttatgttgttcaacttcgcccttttggatttgcttctcaccttccacaacagaaccccgtactttaattatttcacgtgctgttgcctggccccttagtcctattgtatatatatattctcatttacagattatatccatttataatccataaatgagaattccagtggacaactcaggagattttagaatttaatgaatatgtatctaattaagatttgtgcattacatcatttatgcattgaaaatgctgtgttcctttatcatgggcacacctcttggcaacctctcaccttgtatcaaagtactgtctcaacttaaagactgtatatgaagaaaaagaagaagtttggtctaacatggaccagaatcttcttctgcaactcactactagttttgtaatgctgcgagcttcagttttcttgtccgtaaaatgaagataacttttcttttcatattataggaggttataaaagccacatgacataaataccctggctcagggcagacacttgataatgattctccttgcttctacctccttctccacttaaagagggtctgtaacctactcacattttaactgtatctcaatattcttcctcggctctttttctcattctctacaataatttatttcaatgttttctttagacatatgcccccacacctggttcctgattctcaacatgtggcatgccctctttctttcctttttctagttaaaagactctaaatcatgaggttatgaactccctcaattttctttccacacttatttagatattttcccctgctatctcaggggaagaagtaacttcttttcaaggtcaaactgtctatcactaatattgattttatcatattttgcctctgctaagatgatattctatcaatgatttcttctctggcattaataatctctcacctctggatcatgtccccactcaactaatctgcttcatcctttaaaagaattaaaaataaaaatatacatttctacccctcacctcagtaatgaatgttgaaaactcttttttcaaaggtcaaaaatgatctggtcattggcaaatgctgacccttcatttggttcttatctctgcagtttcccacaatattgcccagaacctctcttttaactatcttcccatggtgtctataatgcttcccttccaggtttatttgccccatagtttcctgagtaaccttgtttatccatctttaccaggtcctcttctgcaattccaccacaaatctctccatattaaactgacattatgtaaataaaatggaattctacccatttttttcagtagagttgtttttagaaaaagaagtcatgacaaaattttaaagttattgctatgtgtccactcccatccatgtccttaatccagtctctaccatgtctctcattttgattgctgtgctgtgtattaaaacagcagtgctcaccataacatgtattgatcttttttcctatgtttattgaggtataatagagaaattatataaatttatggtgtacaatgtgatgtcttgatatacatacatattgttaagttattaccacaatcaaattagttaacacatttaacacctcaccaagagagtgagagagagtgtgtgtggtgagaacatttaaggtctactctcttggcaaatttcaagtatacaatacagtattgttaactatagtatgatctaacatatatgtaatgttaaaaagttgcattcatagaagcagagagcagaatggtagctaccaggggctggggtggaggaaatggagagacgtttgtcaaagagtacaagctttcaattttaagacatatttctctttgtttatggatgccattttattgaaaaatctaacgtgtttatttctcataggcatacgttagagcaaactataataacacaattctgttgaagggatgagcaaatgaagtcatacttgggccaagtctctatactatccctaaacttcttgatactttcaggtctactcgtagctgaatgttccacttccaggcttttagtccccatcctctgtgcttgctccagatcgcattagagtcctggagggattttcactttaatggaggcattgtcagtttcagagattaaggtgggctattactgggataatgcatcacatctgattggaggtctccagaatgtagactaacgttgaggacattcttcagtgaggttgctctaatatatatactcgacagggaaaatgtgttgtccctgtgtaatgacagcctactcagtgttttaagaagcatatgttggccgggcgcagtggttcacacctgtaatcccagcactttgggaggccgaggcgggcagatcacatgaagtccggagttcaagaccagcctgaccaacatggagaaatcccatctctactaaaaatacaaaattagctgggcatggtggcgcaggcctgtaatcccagctactcgggagtctgaggcaggagaatcacttgaacccgggaggcagaggttgaggtgagccaagattacaccattgcactccagcctgggccgtaagagcacaaatccttctcaaaaaaaaaaaaaaaaaatagtatatgttgctcattagtatttgcttggtttcaggaagataaattcatataagccaacaatataaattataacacataagatatgaaacaatatagattataaaattataaatatatagttatagataataatttttttttttttgagactgagtctcactcagtcgtccaggctggagtgcaatggcgtgatcttggctcactgcaacctccgcctcccgggttcaagccattctcctgcctcagcctcccaagtagctgggattacaggcacctgccaccacacctggctaatttttatatttttagtagagacgggatttcaccatgttggccaggctggtctccaactcctggcctcaagcaatctgcctgcctcagcctttcaaagtgctgggattacaggcatgagccactgcacccagccgatatgtaatatattatgaattatatatatcttatatgtagttcattgctagaccttctcctgtcttctctttgggaatatttcagtctcattgttctctcctattgggtctctcctcttttgcataaaattgatatatcaggtaacagattcatacagcaatcagatattagtgattctttacacaggagatttgatgttcaagaatcatatacaaaggtgattagggacctaaatttcatgctgtattatgtttcgtctctattatagaaattgtataaacagcctgcagtgtgttctatttcctttccatggccaaatgggacaaatagtgatttcaactttccttgaagcatcatgccagtgtaagaaacaagtctctatcatttaagctgcaaatttaaacaagatcagactttctttcctaaaacaaaaaaatcaaactgtatatagtcaaggatacaacaaaagcttgagggaaaacagaataaaacaaggaatcttcctgtttaacattatttgaaatatatctctgggaattgttttaaaccaaattttaagactccaattttttgttgagaatacaaaggtaggtgtcaaggtcagcacataaggcctttctctgtgctatttatccgcatgcctggagaggattacatggatttcagagacttagtcccaagaaatttacaattgagggcaaaagaatatgtcatttgactatgtacagtgttttataatatcatgacttcttgataaaaggattaaggaaatgggatatatgtatatattttgccaacatgtagtagaaaatcccaactcttcctctgctatcactgttcacttccccccaccccaaataaatgccatgacattctgtcacccaggctgctgtttttaagattagaaataaaacttgtattgaaatggagctattcaaatatatgtaccagcaaatggggctacctgcatttcctgatgctctgcaatgacaaagcagtattcacaagggaaggaaaaccatgatgaatattttaggtagctccaagtctctgggaaaatcagagagtataccaaagaatgtagtaaaattgtatgtttttaatatttatgaaatcctggtgaggttaaatatgcctccagactggtactttcttaatacagggaaataattgcttcagaaaaaaattgctttcagaataaactataatactgaggaatttgtttgggcaattttataatatctttaataaaatgtcactttctaacaaccaacagatacaaagataatagggcagtgctatatggcaaagcaaaaatatagaattacagttttcctttcatgatgctactgattacatgagacataactaaaaggcaatgaaactgatcacaagagccacacattgtatagttaaaccttataatgcagattatcctctcagaacaataccaaaggtagtgtatttgtgtgtgggatcaaaggtaataaattatttattaacgtgagaaatagaaatatattaaattgttaaataggctgtccatggcagggaatgttcaatttattaattatccatgtaaagaactagagagagagaaatcttagagcaaagaccccaatctatcagaacaacggctcttacttcctaatttaaaagctctttcaatgagggagatgattttgctgatgggagtgcaaactgggaaggagaggccttctttaataaagaggcagaggtggagaaggtgagcaatttacttttgctgcatacctttttttatctgcttccaatgatgaatggaaacagaagatttttcagattttactttctcatagcaacagtatcataaatcatggttatatttgaaagaatgtgaatgattccttcaactaaagatcatttagcaacaatctttgagcgcacactatgtgcacaaaactgaaccatgttccagggatatggaggcaagtaacacagacatggtttttatccctgagcttgtcagtctaatgaaagccaaagctagaaaaattagaatatagtaggatctaaggctataacagaacgtagaaagtcagtgaggagcagtggctggcaatggggttaagaaggtaggttgaggccagcttggcaaagaacctaccttgagttataggataaagagattggattttatgttatgggcaacttgtaaacactgcctttatgccaattatgttaaatgaacttccaaaagtatctgcttggcagcaatataccaggaagggaatctagaaatgactctaaaaaaatccagaatgattttcctcagatcaaattcccaagtaagcaaatttgtccaaaatctatttgccagaggttaaaattaatccttacaataaaatatatctgatgatacactgcacaggacagggaattttaggagttaccagcttatgaacatgaacctctcgatatttcatgaaaaataaaaagtatgcctgttcacattcatcctttaccagctgatacctctagctcttgttgccttacaaacttgtttttctaaaatatttggtatcataaactcttttatcaaatagaacggagtgaagcagaacagcaacaactctaaatttctcaaaaatatgcaaaatgctggagaggcagcctgcacctgcagccccaaaagcaaatgtgttgaataatcagggatcccaaacagagctgcactagagtaatttactcagctaatcattatatgaaatagaacattagatttctgcaacaaagttgcatcaaagtagatgcatacctcattcgattaactaaaacatcacaaaatcatttagctcattagatggtttttaataagcactccttcctgggagagggcactgtgtcttttatttatttcttgtgcttgacgtttctggcacatggagatgtggtctgcatgattcaatatcctcaactattcatctcagtccttagtatcttgtagaaagatcaccgtgctttcagatatttaaaatacccttaagataagcatggtatttgtttgtcagtaaaagtttgaatttgggtcttgaacatgtgtcagaacagggtatctcaccttaatcagccacagaactaattttcaggcaggtacgtgttaaagattagggaaggacagcagctttagctcacttcctttagctcacactaactgacctttccagacctcaaccaattttgaaacagaacttcaatttaaatggttttctagtgtaaataaaagtgcttgggtttccaagaaaaatatgtgaaattgttagaaaatgtggaagttgaagtgtctctaaaatgggcaatggtagtattctggaaacttattacagttgccaataaccagtttacgaagtagggcaaacatttttctcttctattttttcgttaccttggccttcaaattctcagtttattatctgagactagtatatagcttttcatgacatctcctacagcgaatagtctctcaaccagtatgagagtgcacgctagacacctgtccatgcccacctacaacacacaaatacacacacacaaacttacttatacactgcatacaagaaaaaatcgctgtgcagcaatactgttcctgaaatgtgaacgtatatggtaaagttgtggtaacttagtgaagaaaaggaagagtaaaccaggtatgctttgttgtctaacactgtatctatagatttgaggtatatagatttctagccatggagagttgggaactatatggcatcatacccactgtgcttttgtgtttgtttttttcttttttaacatatctacagttggtaatgaactaagcacagtggttacctctggaatgagagaaatggagaaggaagatttcactatgtttgtattgatttcacaagttaacatttctacaattggaaattgttttacaattgatagtgtgttggtttaattggaaggttttttttctttcttggtggcacataaaataacagtgatcttaagatctatatgcttcagattctgcaaaatactcagtttttaaagcagtagcatatgggtgatttttgctttcttatgatcttaggtgtttttaaagtttttagataaaaaagaagaaggaataaaaaataataaaaggaaaatatgtgacaaattgttgagaaacaaaatagaagccgatagtggaacaattcatggcagaattaaatattataaggtgaattaaatgtatttaacttattagtatacctgtctcgtctcaaattagaatacaagagactgtgaaatctaaatcacctttgaattgcctctgggatacagcaccttgtctgctaacaacttagtaacttagtaaacattggttaaataaatggattatgaagtaagttaacttttaaatatactgtgcaaaatcatttagaccatgttttctatttctcacattccttaagcatttcttcaaactctgcctgcttgacctaaggaaaccaaacctatggcaatctaaaaaaaaacagttcaaaataataggaccaaaatggaaattgtttggtttgacactatattttcttgataataatcttgtattgtactgacattatctttgatatctctgattaaaaagagcttattacagtcagcctaaccaagcatttagggtgagggttcttctctgtgttcacatggcactgaacattctctgacaagatctcccaacgacttgtctgtttgacctttttgaaaagggaaaaggtttcattcatctttgtaactgagatgcttagtacaatgcctagcaatgagtgttctgtaaatgttgagtaaatcacatgactgaatgacacagtttcacaatgtagtatcagttgaccctggaacaacacaggtttgaactgcctcggtgcacttatgcaaatttattataaaaatttaaaatttagcaaaacatacacatgcaggcacttacagaccatacatggtgccattcccaatggagagaaatggaaacaaatgtaaagatacagttttaaataataactacctaaagttaactctagaacaccctgtactactgtaataatttcatagccacttcctgttgctattgtggtgagctcaagtgttgtgagtttccacttaaaacaccatgtgacactaaccatctccccgtgagcagttcatctcttcggtaagttgcagatcccaataaaaagtgatgtctcccggttccagtgtatttttcattgtgctttctgcaatatcgtaaaccttaaataacaccgttggacccatacgaagtgccactagtgatgccaaaagttctcccaggaagcagagaaaagtcttaacattatgagaaaaaagttgaattgcttgatatgtaccatagatggaggcctgcagctgtggttgcctgccatttcagacagatgattcatcttgtacacagacaatgtgaatttgtggtattgataaatacagtacagtacagtgaaggtattttctctttcgtattattttcttaataacattttcttttctctagcttatggtacaactacagtatttaggacatataacatacaaaatatgtgctaatcgactgtttacgttattggtaacgcttccaaccaacagtaggctattagtagttaagttctggggtagtcaaaagttaagtgtggaattttcaactgtatggggtcagcacccctaacccctgagtattgaagggtcaaccatacttgatattagcagtgcttattggtagcagaccacaaagatctctcttaggaacgtagccatacagctatgttaagcaggtgtggcaagcacaataatggcccctcaaacatatccctatcttaatccccagaatttgagaatatgttactttatctggtgagagggatgtttgcagatggattaaattataactcttgaaagattactgtggattatccaggttggtccaatatgatcacaaatgtcctggaaagagggaggcaacagtatcagagccgagaaaggagatgtggtgacagaagcaggggtaggagtgacacagggccgtaaaccaaggaatgcaggctgcctgtaggagctggaaaaagcacagaaagggattcttctctaaaacttccagatggaacacagccctactgatacactttagacatctccagaactgtaggataataaatttgtgtcttttaagctactgaatttgtagcaatgtgtgacagcagcaattggaaactaatatatcaggcaaatcgttggagataatttggggcttcaaatggcaggaaactcaaactggtttaaataataggatagcaagaagatgcattggcttagatattaggatgtctaacatggggcagaatgagttgctccattggctcaatgatatcatcagtgatgccacttaatttctgtctctatctctgccctgtatttctgtttcactgatgttatcctgaaactggttcccttataagtttgggaaggctgccagtagcaattggagttaaatttgtccttgttcacttttatcaggaaagagcccaccttctcataattatctaccttgatagacttgcactaatcaggacccatccctggagctccccctaagggctacctgtcacagggcccatgcctgaacaaaatcagggtcctattaggaaaaggagagagggggtatatgccagacagaatatttgccatgcaccacaaagaatgtcacagaatcctgtgccaagaatgtgaagggataaataaaagtggttaaacaaattgcagggacactgtgccctcagtcacagacctaggaaacaagttccagcttttacttggcaatgtttccccttgctctataaggacagttgtataatggaaggagcagcagcagttagtaaaacctcatgactcgttctgccaggcttagactggcagttagactggactttcttccacctggggaatggcaacgtgcccagcaccttggctcatcataccaccgtctggcttacctgctgcaggtcactgaactctggagtagattgacatcagatagcctcttgtgaattatccctaaaatgatgggtttcctttgaaaactgctaactcttcatacatttctacatatactttactgcattcttctgtgattgaaatttgcttcttaatatgttttataaatatccaacatgacagttcagaggaatttcctacccaaccaactctgtagtcaaagtaacaggaagaaaaagagacagatgggaaattatttcatttaatctccaacttccaatgaattattttctctaatattacagaagaggaaatttgagaactaaggaactaagctgcaaagcctataatgtcagagctgttattagccttagggaaatatgattcccaagcccatgctcttccttttgtattccttggagtcactccaagagttggatatatgtataaagttgatctacaagaaatgtctccttctaatactctccatgtgacttaaggcttattccagaactggtcctcatgtcctacagggaggctaagaagtctgaagacatcggacattctccaaatttatgtaaattagagatagaggtgaggaaagatccctctagactagttccagaagaaagcaagagtagatcaagttgcttaatgatctccttaggcctgttctttcctttaattgtaagggaaatctaagcacagtcacattgatcatcagaattgattagggtaatttggcttgccaggtgggcatactaaccatggccctaagcacttgcagaggactaacaaacaccaaagagaattcttcctcttcattatctttctgtttctgggaatcctttgagaaacaacacacaaatcaccccaactcgtgtatatagctcaggatagcactggtctccaggaaacagctccagacttaatggacataaataagcaaggctctaaggttcatgagggcacactgcattgtatacacactgcattcttagttccagacatagtgcctgacccctggcaaatcactagtgttatatgaaggaggtaagagcaggatggtgagatggtggtgaagtgcactagatttatgtcattattcaagaaaaattacagaaaacttttccttaaacaaggtagaccaaacctatagtaatggcctttaaaacagtgcaaatttcactattgttgttcacggggtagaaactagaggcctttttacccaataagatcatacgaattttcaggttttgcaaaatgtttgttagcatttgaaaagcatttccagttactggcaatcttcaagaaaatgcctaaaacaattttcagaaatgcttctattgaactctactgaaattacattttatgtagtcctgtgtgattgcttctgccttattgttcaagaactgttaataatgagtgagagttttaatatgcagaaaatgagcaacagaatgggacccaaagttcttttattttattttttaataaaaatttaaagaccttgttagagtcagtttccaggaataatttactggcatgtatgttgtttaatttatttctaatttaaagacaaattaattaacacataaagaacttaaaacagagcatatcttcaaaatgagatggctcagaagcattcaggattcacaaaacgttttttcacggcagttgtgaatttaaatcacagaatagaaatgataagcaccacagcatgtcgggcagcagcagtatgctgaacatggacaccactgtttgcatcactgtttccagtggacattttccacgatgtgaagtcaattattgcttccacttctacattagtgtaattggtttttgctctccagaggagaatttattaaggcaatttcagtaaataagggaaagggggtccaatttgctactgaatccattgggtatggataatcacttcgattttcctccagatcctaggggaattcttggtcctgctgcatgtattaaaaccctttttcctctttgcaagggaaagcagaatgctacctttttttccccaggaaagttggtatgcttgatgaagacgattctacgaagcagtacccctgaaagtattgattagcatgattttaaagaatactcagggcttgtacagagaacagttcaaaggaatgtacaaagcatgcgccttctctaaacatttttaaatgcttagttcttacgaagaaaacacatgctaaagctaaattttctaccgtttctgcatcaaatcagatccttgatcaaatcaagaggtgcttttctttcattaaagtaactctaagtatgaaagagcaatgatacctttccatgtgggcaagttctttctgcatagagcataagacataatgagatataattcataaagatgttgcctattttcagccaacatttttcatttacagtaaaatatttttggaatgcccaggagatttcattatttgaataggaggctggaacatcacatttacagcatgtttggcaaagtttggaatataatgtagaaatcagaattatctgcaaaattgttgatgcattcttcacaaattctgatgctgagtgcagctggattctatgggtgaagctcagagactccaggtgaagagcaacatcactatctgtgccatgtccagggagacattggtgactacagtttttctggccctggagaccccaattcaaagtagtagtcaatctgttacttaatccaatccaaacaaagcaaagctaaagaaaacaaaaacactctattagatgtctctgcaaatacaccaagggctagaacaccatttaattcaggtgaggacaagcagttctgcccctattatctggagtgttgctttaaccctcagctttgctttgaaaaccaggcctcgctttgcatcctcagtgcaatattaattcagaactgacttggatttgttccttgggcaaaaggttaagtgatccataaatttatttccctgtagatttggaaaaagaaaagtaaatatcacggtgatttgttagccaagttttgcagcaacagaatcattgaatacccctccagtaaccagagtcaatgctgtgtgatgaatagaaaataattaaaatatttatggctcacccacgtgaatgatgccaatgaccagaaagatcaaatcctcacagaaatctgattaatgagaaatgagtctaacctgcttcatgtttgactaagaactaaattccatcacaaatgtgcaaagaagcataattcatccctgcataatggctttttgttaacataacttcactgtgaagaaatgcacagtatctctaaactacaacatatttgttgcaaaatagaacctacatttttcaaaacctgaccttagattttgtgggcccctatccagtgactcaacattagtgtaataagtacgtttataactcatggcagctggtgccatgtgcagcagatcttgtttctgcaggtaatagccttcagacttaagctctttcacggaggagggtgtgcttgaaaagataatagtggtggagagattcttagagatggcaccatcctctctcagcaacaatagctcagttattgagtatccatcaagtatatgacattagtctatgctcactgaaagtttccatattgaatcctagtctcctttttctaaatgaagagcattgctttcatgtccctttgtgtctccaaataattgttcaatatgcagccagacaataggctttttcttttgagagtgatggaaagatatgccaggtacagagagcatcatggagtagaaggagcttcatgagatccgcttgtttgggcttctgcctctctaagcatgactgttgctgaagcgtttcataaaggagctctgaatgtcacacaactgaggccatgcctatccccatgcctgtacctttgctcatgaagcccccaccctactttcatgcccctgcctcactctcctgtcccacaaaagacaactccattcatctgaaagctgctatcctcttaaaacatactatgcttgtccctgagaatagaggtgaaaaaacacatttcaaccttcactgaacttataatccaatagggaagataggcattatgttaagattatcacaaataattaagtgattacatattgcatggcactggaaagaggttctgatactatgaaggcatataataaggggtcctaagcatagtctaagaaatcaaaagaggcccccaaaagatttacttagactacactgggcacagtggctcacctctgcaatcctagcacttcggtaggctgtggcaggcagatcacctgaggtcaggagttcgagacaagcctggccaccatggcgaaaccccatctctactaaaaatacaaaaattagccgggcatggtggtgcacctgtagtcccagctgcttgggaggctgaggcatgccaatcgctggagctggggagacagaggttgcggtgagccaagatcgcaccactgcactccagcctgggcaacagagtgagacttcatctcaaaaaaaaagaaaaaagaaaaaaaaagacatatttagactagaagttgaaagaaatgtatttaatgaggataacaaggtgtttagaggaaagaccattccggccagacagaatctaacttgttaaggctgagaggtgggagttgggtgagggcaagtgttgtgaaaagtatatgggagagagattatgtaaaccacaggcaaaatgggaagtcatcaaaagacaagtgatgacatgatcaaatttagatttcttaaaactcattctggctattgtatacattattgttcagaaaaagataagtttctagaccagagcagaggctgttgcaacaattcatggacatggcaaacctttaaatctctgttgataaaacaactttgcccatcagcctgttatcactgacatattacttttttactccaggtgattaatatatatttaagacactggacccagaacgcttatgatagcattgttattttgaatatgagctactaaagtgtccaagaccatctcagaatatttcaatttaaaaccaaatctgttttttaatgaatatacctattaaaacacttaacataaagtacacttccccttaatcttggccactgaagatattggagttgtctgaaaggacttgctattcatgaaggcatgacaatgcctatctgcactgtttgttataatgctttttccccaatcatttttgttttataagtggaattttcctttcctacttaaatactgttggtacttattagcacccatttttccctagagatgctacagataatcctgtgaaacatgaggtgaagaaagttaaatataacagttaatatgaatgtactaccaataatacctatgtctccagtgtgacattttactcaggaaactgtgttgggtttcagagtagtgccatatttcatacaagggaggaaggtctgacaaattttcctctccacaaccagtatctctgctttcttcctccctatcccatgaataatgtataagaatttcaagcatcttggatgtcctcctggataaacaatctgtatccttcaccaagcaatgggtatgtacttacaagccagtggcagaacatgttttccaggcagcaaaactctttttcatttccctaatttctgcaataggtcatcaaacatgccatctgctgagctgttttccaaagcatatggctgctgcttcaagtggcaatgtagaagaataactaaaagaagtcatatgtaggagagagtaactaaagcacatactattgagtcactcgtctccatgtccttaattctatccctgagtcaagttgaattcctaaagtcctcatacttgaaacacattagatttctcctttccatattcactgtcaatgagatccattttaacattatattttcaccattgacaaccagagacaaccatagaaaacccatggtatgtttactatcaaatggtattgaaaatgtgcttagtcctgtcataacactaatagtcattagataggaagtgagcatgatgtgctacgcacagctttcattgttccagacaagcagcatagctagtagttcagtacacagttcagccaagacacctgggtacgggttctgaatctgtcactcaatagttgtatgctcttgagagttaacttcttagtgcctcatttgtaaaatggggtgaaagataacagtccctacctttgggattagtgtgaagattaaatgacttgatatatataaagcacctagatcacttcccagcacacggtcaacattatgtaaatcttatatatcagtatctcatttaaaccacatgcaatctctatttgatatatgaagaatctgagtcacagagggctaaataactaccaccaaggcattctgactctagagcctatgatcttaacgagttctttatataaagacttgtgagagaatatttttatttttagggttatatctttgttttattaaaactctaggccgggcacagtggcttacacctgtaatcccagcactttgggaggccgaggcaggtggatcacatgacgtcaggagttcaagaccagcctggcccacatggcgaaatcccgtctctactgaaaatacaaaaattagccgggtgtggtggcacgcacctgtagtcctagctgcttgggaggctgaggcaggagaatcacttgaacctgagaggtggaggttgcagtgagctgagattgcaccactgcactccagccttggtgacagagcgagactctttctcaaaatataataaatgaacaacaacaaaaaaactctaaacttattttttgagttggctgacaacaagcacagatccaaatctgaagttcaacaataaagtcattgtattgaatttgctggtttccatttgctttcacatggtctctttttcgggatcttgattttctattaatattccaatttggctctcacatattatctgccttttataataaccacctcataaaacgacttaaaaagacaaaagtagggctgggtgcggtggctcatgcctgcaatcctagcacttcgggaggctgaggcaggctgatcacttgagcccagaagtttgagaccagcctgggcaatagggtgaaaccccatatctacaaaaaatacaaaacttagccgggcatggtggcattcgcctgtaatcccagctacttgtctacttgggaggctgaggtggtgggatggctttagctcgggaggcagaagtggcagtgaggtgatgtcacagtgagccaagatcacaccactgtactccagcctgggcaaaagagccagatcctgtctcaagagaaaaaagaaaaaagcaaagacaaaatttatgaacattgttttttaagaaacatttttctctgtggagtcagctaaatatggaaatatggaaacaaagtttatcaaatagataaatgttgttctaacaaggaccactgaagaatgaaaatgagaacactgtataagactatgaaacaggccaggcaatgtggtacatgcctgtaatcccagtactttgggaggctgcggcagatagagcacttgagctcaataattaaagaccagcctgggcaacatggagaaaccccatccctacaaaaaataaaaaagttttagcctggcatggttgcacacatctatagtcccagctactcaggaggctgaagtgggaggatcacttgagcccaggaggccgaggctgcagtgagccaagattgtgccattgcattccagccttggcaacagagtgagacccttgtctcaaaaaaagagaaaaaaaaaaaacaactatgaaatagggagaactactttgcttttgacagttgcgtaacttttctatctcagcttctaacagtcatatacaggcacactgcactccaaacccaattaatttaacttctccaagtcaaatttcttgacacattatctttttacctggagcatttttactacttccttctacccagattgttttctgttcagtctttttcccttcaacttccttttatattttaagatttagctcaaaggtcatctcctctgtgaagtaagcattgtctgacaccttagccatttgatgtctctccctcttttgtgttcttaagatgccatatatataatattggtaaggcattctattgatttattttttattcttttaacaaatattcattgaatttctgctatctaatactctatattaaagtagaattatcatatatatgttatttccacttttaaaaatagggcgatgtttgatccatcaggaacctgaaacagagcagcatctcagtatataactgttgagggaaagaactgaccaaataagataattttatgatttatagtcacattctaatttttaaccaaaggtgatattattccaattggacttttactttccaccacattctaaataccttttggtgctttcaaaaaataaaatctacccttagaaatattcaaaagtgtggtatatgtccatcctcacgctgctaataaagacacaccagagactgggtaatttatgaaggaaagaggtttaattcactcacagttcagcatggctggggaggcctcaggaaacttacaatcatggtagaaggggaagcaaacacatccttcttcacagggcagcagaaaggagaatgagtgcccagtgaagggggaagccccttataaaacatcggctctcatgagaactaactcactgtcaggagaacaggatgggggagccaccctcatgattcagtgatcttcacctggtctctcccacagcacgtgtggattatgagaactacaattcaagatgagatttgggtggggacacagccaaaccatatcatgtggttataccataagttttacatttctctccaagtgatgaaaaaaatacctactattgctatatttttaatatatattttaatcataaaatgctaaaattatcctagtacatattttttaatgtatttgatacatttttcctgttggagagattcacatttttggaaatgctagaacaaaaagaatgcacatattccagatctactgacctggaaaaatattaacaaatatttttatattttatattttattaacaaataacaagctcacaaatagatacaggtttggtagagcctggcacataaaatagcagggtccctatttaagaaaaaaaaattattaatagaaaattgctaggtcctctccctcctaaggccttggaagggcctatacaagtgaggggccctaaagtacatggttcattaatgtcatggtatacctgcctgtgtctgttatgtattgttaaagggaagaggaaaagttaaagaatatatatgatctttacatcctcctgaaaataattaaaccactttatgttatgtatatgttttatgggcaaatgaaaactctggaataatgcagaaccaaattattaaaatcaccttcatcaagacagaattaagtcagagggtaagataaagtaggagtgtgtgtgtgcatccacgcatgtgtctgatcattttttagacacctttattttcattattacagcaataatgcactacttttaaatttcaatcccaaaataaactttactgggtggggaacaaaagcatgtgcatgtgaaagaattccaaaaaaggaattttttggatgtctttggaataagtccatatcttcccaaagttactatatgaatataccacatatattggtttctgaaattctgctatatttgatacaaaattagccactttcttttctgagaacattgcctgtattaatagactgttccccaggcctctcataaacacaagccacaagacaatcagataagaagcgagaacgtaaaagctcagtgacctaccaatggggtgccaggtaaaccatctctggtaaataaaagacgcccactgtatcaccctgaaatcacttaaatcaatcatgttttgaaatcaagagaaatatttctctatagataagacaaacataaaatgaatacaaaggcatatgtaacccacaagaataaaatataatcaagacaagtcaagccaaaaatatatctcaaaacatccatgcgggaaccagttgattgtggcagagaaaaatccaatatgtatttcaaaacaacttatcacaaaaagaaattaaggcaaattcacactaggaaaaaaatgtttttcaaaataactagttctaccaaaatttgtgcaatctaacgtgtgtgacagagttgtgccaacagtattttccagcaggagactctatggttccaaaaggcagaatttcatagcaatacagggctaatgattgcaatgtatgatggtagttctagcctcagctccaagcatgaaagcagatacctttctcttaggtgttctgacaggcagatattaaagagcagcatgtgtcagaagatgtaggaaatcaactggcctctttgacagattttaatgtagaatgtttgtactgccagggcagtgggtatgacaaatttgagagatgacagtaataggagtgtttaagtaagagaacaagcttaatagagatgccactattgacaataacttgcttatgttaaaggaagagtccttgctttcattttccactgaaaatcccaatgccaattttttgaatccatttttactaaatattacaaaaataccttttagtcatttgcaaggatagaagactaaactgccagttatattgcctcatctgtttttcaagatacctcattccatcatatcattgacattcttcagttagggcattagtctggaccgaggcagaacctatgtaaaacgttgaagtgactgtgaaatgactgcctattttttgttggagtgcacttcaaattaaccttggagcccaagctcaggaatggttattaaccaacgtttgtactgaagcccgacactatgtgtaggataccttgtaattatcttaagccaattgtccagttattctgtaccacaaataaaatgtatgaaacaatacaatttttctctccaaaaatatatacacattttgtatttcttgcatttctctagtattcaagttaattacagtttcaatattatacctccagtaatggcctccttcctaggtatttgaactcctccagaaatgttttactctaactctgtatgcatggtcagtggtagagcatttgggagggtgaagtgccagttgtgaattgatgctaaatgaatgggtatgcttttttttttaaaaaaaaaaaaaaaaaagtccttttcactcatgggctttaatacccatgtaattataatgatttcaaattctctcaaggctaaaattaaacttggcttcctggatggccaaacaattgactattcttctacaccactcagctcccactttatctcaggctcactttgagcacaaactggttaaaaacagtcataatccaaatgctgaattaaatatgactaaaagatataaactgaatgggcagtttaaatctagtatcatccaattagaaccatagtggagcattcatcccctttccacctccccacactcccaatggagtgggagaggcaggggagcacagcctgagttctaggggcaagtgtgggtcatggtgctaaagtccaactggatggaatatgtagagccaaggggaaagttactagaagcatagttccattggagagcaagatcaatgtcacagagatgatctgaaatggagctgccagtctatagaaggcttggcaaaagagacaaggccatgtacaaaattgataggcagaaacaaggagattttcatgagaaaggagtcttgaaacaagtgcagagtaaaaccaagaaatattgctaaggttgtgaagaggcagctgggtgggcaagaggattaggtatttgtgacttcagatgtgatggttcttagaagatcttaaggacagtggaggacactattactacaccagagatcacaaaatcatgacctgactgttgacaggctgtttgcatatggatttgagcagagacactgaacccaaacatactgggtatgaatcttgaccctactacttactagttttatatgatacaaggcaacttccctaagctttgtagcttcaatttcctcttctgtaaaattgggataatcattagaatgattttgagcagtaaattggttaatatatgtaaaacacttaaggaaaatgaaggtcaaagaaggaaaaataaaaatatttttgcttcatctttttcattcaaaatttcattaaacgtatttcttctgatctgatgaaataaattttaaactatattcctaaaacttagattacctaatttattgaataaaatataaatgggaaaattggcactacattttatccaccaaaatgaaaatatcacattgaagaatgggttaaatatggtcaattaaatgccaaagctttaataatagtaaagaaggaaatgggtagaaacacacaaggccaaaggaaacacagaggatacaacagagggaaagaaatgtcagtggaaaacagatcatggagcggtaactgacttaacagagtgggagaagtagggactcaaatgcctaaagaagacgacttccacataaatgagctaatttccaccactgagctccctagccattctggaattgatgtcaccagctacaaagaatttaagaatgaagtttggatctgacacattgtataaagagcattctaagcccctagatcttctctccaaccctgctcaaccaggcaactggttctatttgaaccacaattatcaagagaaaggaggtttgtccttcagaaaagttaaatcaaaaggggccctggactcaggaatacaaggcacaaaatatgaacacaacgcagagatttggaccaagagaattctgtccatctttccccttatccagttcctggaacacaggtcaccagtgagcaaaccacaagattcattgctgaagaaattgaatagaacccaaagaaaatgcctacagatactaacatttgagggtcacacattaaaaatgtcagcttgccactcagtctcagaattttttttcttctttttttgagatagggtttcactcccatcacccaggctggaatgcagtggcaggctcttggctcactacaacctctgcctcaagcaatcctcctaccttggcctctagagtagctgggactacaggcaccagccaccacacctggctaatttttgtatttttattagagactgagtctcaccatgttggccaggctggtctcgaactcctgacctcaagtgatccacccgcctcagcctcccaaaggctgggattacaagcaagagccacagtgctgagcctcagaatcttatccctgtactcacccttcctcaagaacccccagaaggtgagcttttcccatgacagcaagcccttgtttgggaggtagagtctttaagaaataatcttaaattcatcaaaatcatcaaaatgaatttgatgcatttgacctggggaagaatagtattgaaagaagttttatagttctgaagaagagtttaggagtaattagtgacaggtagatagaaaaccaacctacaaaggaaaaaaaaaaaaagatcatggagtggtcactgacttaacagagtgggagaagcagggacccaaacgcctaagagaaatacttccatagaaatgtgtatgcatatttacaataatatagctactaatttgttaacactgaacctagaattgtgttctaaattagttgaaagaatgaagagataataactgggtagaattacataagagtctaatattctctcttaataggaagtccatagaaaatgtttaaaattgatgtattaagaaatactagtggaattcattattatccaagcagctaaaataatttaaagtaggtattgctgggaatgaaacttcgtggtggaagggtttaaggcagaagttatttttcactatagttctatagaacttgatttcttaaaccatgtcatatattttctcaacaaaagttaaaattgaagcacaaatatcttgtatgaaagcagtcatctaatctcttttcttgaaattagattaaacatattttcgtgaatctcagacagtttatagtgggtaacttatctttgttttggttgaatgttacaatagtttatgctctgctctttggctatcagcccctgaaggaaatatacaaaatttggctttgtcttgccatgtcccatctatcaccaggtagggaagttttgttcaatgatcccctgaattgagtttaatatgttattttttaatgttagactagtccactggataataaacataaaaggcaagatatttatttaagtatgtactcaatggaaattagtattttcaggtctaaaaaatttttatgaatattttcccaaaatagcaaaataattaaactaaaatataattatataaaatataattaatgaaaataaattgttatacatatcaagatcatttaagtcaaaatgtgtgtgtcatctgtgcaaaattaaacatgatcctatatctcttttgcgtttgattggaacaaaggatattttagacccccaatgctttacaacactcataatgtgaaattggaaaaacaaaacagaaaattgttatacatgagaagtaatgaaggtattaatttctagaaaaagaaacacatcaaagctttagatttgctctaaaaaatgttttgaagggtgaatattgtgctattttgaagagactcctaatttagaaagctcaaataatgtctattttttaaaatggaatctttctccagtcataggaaatgtaccaccacaactatgtaatcaatgtgaagcagatggtggagcaattatctggtgtatttgggcactaccattggccaatacacagaatatgggccaggaaatttattctgtgttttcaagctgcttttgggttgtgatggatagtgttgcttaatgaaaatctttgtattaatttagtttccattttacagtcctcatctaaataggcatctctctttgtctctgtctctttctgtctctatttctctctctgtgcctcttttttctatgtggctttttttctctctctctttctaagtcaagtaagatctatacagtgatgattttagaaatctaataatttgagctttatttttaaatatcagcatagcttgttactttttttttgaggaaatagctactccctataccagtgtacaaatctgagttatttcatttacttaaaatcatctagagggttcacaattgagagaagacactattttgctgattctgattatgtaattgagtaaaaaaactttaaaaatacattttaaagcacctactttgagcacttaggataatatcatcctaagagatattttacctttaattccaactaaaaattagctattaaactcatattggtttcaaacttttattttttactttgtctttttagatcagttttagtttcacagaaaaattgaaagtacagagatttcctatatatcccctatccccacacatgcacagcctccttgattatcaaaatcccctgccagagtggcacatgtgttacacctgatgaacctaaatgacacatcattatccttcaaaacagttcacttttggtgtggatttggacaaacgtataatgacgtatatccatcatgatactatggtatcgcagaatagtttcactggcctaaaaatcctctgtgctctgcctattcatccctacctccccacaactcctggcagccacagatctttttattatctccatagttttgccttatccaacatgtcacataataaaaatcagacagtatgtagcgttggccgattggcttctttcacttagtagtatgcatttatgtttcctccatgccttttcatggcttgttagctcatttctttttatcactgaagaatattccattgtctggatgtaccacgctttattaattcacttactgaaggacatcttggttgctttcaacttttggcaattatgaatgaagcttctataaacattcttgtacaagtttttatgtggacataagtttccacctctttgggtaaatacaaaggaacactattgtgaaataattggcaagagtatgtttacttttgtaagtaaactgctaaaccatcttccaaagtagctgtaacattttgcatcctcaccagcaaggaatgaatgttcctattgctccacattctcaccagcatttggtgttatcaatgttctggtgtatgtggtaccttactgctgttttaatttgcatttccctgatgacatatgatgttaagcctcttttcatatgcttattcaccatctgtctatcttctttggtaaggttgtttaaggtatttgacccatttttaaatatttttatggtaagttttattttagtttcaatgtgcagatttgtgatataggtaaactgcatgtgacaggggtttggtgtacaaaatagttcatcacccaggtaataagcatagtacccgataggtatttttttctgatcctcttcctcctcccaccctccaccctcaagtaggccctggtgtctatttttttttcctttttgtgtccttgtgttcttatcatttagctctcacttataagtgagaacatgcagtatttggttttctgttcctgtgttagtttgcttaagataatggcctccagctccatccatgttgctgcaaagacataatctcattctttgttatggctgcatagtattccatggtatatatgtaccaatttttctttaaccagtcttcagttgatgggatttatgttgattctgtgtctttgctattgtgaatagtgctgcaatgaacacacgtgtgcatgtgtctttatggtagagtgatgaatattcttttgggtatatacccaataatgggattgctgggttgaatagtaattctgcttcaagttcttctgcgactcatcacactgctttccacaatgttggcccatttttgaattaggttgttttcttattcttgagttttaagagttctttgtataatttggataatagtcctttatgaggtatgtcttttgcaaatattttgtaccaggctgtggcttggctttttgttgtttattttaataaagtcctccagtttgtttttttaatgattatatttagtatcttcatttatcactcactattttgctctgcagttgctaaaagtacttagacacattgtatatatacctagttttagaatactttgtgcttctctgataattcaaaattttgagttctatgtataagaaatgactacatggtaataatggtgatctgtaattaatattttttaatgttttattgtttttattttccaagcatacataaaagtgaagaaaataatctaataagccccatttgtccactacccaggtttgacaactgttaatattttgacagttttgtttcattgatcccttcttcttacatgttcatgtgttttgttcttaagattctgaattcccaaagaatatatttttaaatttaaatattgacaacagcaaaatagtatggtttctcaaaatgattccacaaaataatttttatctatttggttgtttatgttcttatatattattttaaaaatgatttctttagaaataactgaaatatttagtattcagaactttttatagatctacatcaagatcttttgaacatgtgcaaagttgccactgaaacataaaatgtatcatctttgataaatagcccttaaaaaaagcacttttctttagcttttttcctaaaaatactgggatttactaggaaagtataaaaactatactgtatgtttctaattttagagtttataaaaattttattctgtttaatataataaaatccagtgcagcttgctgtaattgttgattttggcaagatactctagtgtatgaatgccactgagatattaataatcatagtatctagttaatgcaaaaaagcttgaatttatataaattttttaattttcttttttttttttttttgagatggagtctcgctctgtcgccaggctggaatgcagtggtgcaatctcggctcactgcaacctccgcctcctggattcaagcgattctcctgcctcagcctcccaagtagctgggactacatacaggcatgcgccaccatgcccagctaatttttgtatttttagtagagacggggttttgccacgttggccaggatggtctcaatctccggacctcgtgatctgcccgcctcggcctcccaaagtgctgggattacaggcgtgagcccccgcgcccggccatatttttaaattttctaatgcagattgcttgtcttataggtgttcaaatttttctattccttcgcaactataattcccactttacccctaccttccctgcagtttatccttgggagtttttgcatttaatagcctcactgtagatcaagggaccccaaacattggcagtctatttaacaaaatacttgagctgatttattgataaaactagatgcaatttatttgcataagagtcttttaggaggcaagaggatagatagatagtcaaattaaagacaatagaaggtaaagcacagttttcaaggcctacaatgtggcttattatttctttgttttcttctctaatgcaaaaattggctctgaattgcacatctggaatgactatctgaagtagaatttttttaaatgcctagtgtcattcctcctaaaatgacagcatcttgttcttcatttgggtagttctccgtatgcactctcacttgttctggtcagcacttaatcctggcctggtgaattagtaaatcacacccttccgcctgccagccacatgatccaagctaaccaataagggaaaatttttaccccttatgagactgctaggcaatagaggtactctttccatggaatttgaatttggtaggccatgagcctgaacccagactaccaagtggacagagtctgcctcagtatggatttacactgctggaatcagaatatagagacaatgaaagaaggcatcctaataacatcattccaacctcttgatccagccattattggagtcagtttatttgaatttctgtgtgataaatatatttgttaaactttaaaaaaatttttccctttgccacattgagttgactttccttcacttgcaactgaaaataccctaatattccatttattcagacaagtcacactccatattttctaataattgtacttccaactttgccatttttatgcctcctgtatatagctaaatcatgcgtgcctcattactttaactccaagtactcatcagtgcccttgatctcaaattgtctactagctttcagcaaaagcccatttgatccaagtgggctagcagatgaagaggttaacagtgagaaagtatgatggagagaggctgaataaagaacaaactaatcacatgttgctttaaattttctatgagatataaagccaggtcatcggaatgtaatattatagaatgttagctgaaatttccataaagatgccttcacagaattattagttaatataaatttatttagcagttcatgtagcagccaaattagcttaactttctggcataactacttttgtttcccctcaggctgcaggatagaggaaattttatagacatacttggttggcatccttgttcaaatcctaactctgttatcttaatggaggtctttcatgtctctatgattcaatatctttctctgtaaaatgaaaataataatgttgcctttgcatttgattgtaaggattccataataaacagatgtgaaatatttgggaaaaagtgagataataattgtaagctagtggttctatcttttattatcaagcacttcaaattatttaaaaggaaacctccattaggtattatgcctgtggggcttactcaggtaatatatagtgacatatataaaattcagagctaatctatgatttcagagagtttaatattttttaatcatccgattatactacatactacatttaaactaattaatttagccattcccagttcatacaagaccttcgcatttgatattgcagccattcttttgctcttgtgaggagggtatccatctcaattataattcttttatcacatatttgcatatcttttttttactataactattaatggtgtagtgatgctgatttatcacttagcctcttttacctaacaatgttgccctgaagtaggaaaggatgaagttctaaaattaggatgtaattattaacaattcaccacctgaacattaactaacagaatctgacagtggctttccccacagacaaacctccacattcaagaaagaggattcctttataatgaagttagttctgacaccaatgtacattaagagaacaactcccaaaatattataactctgacttttagagtcttaaaatgtagttatggtttcagtagtaaaatctgagcaatactaagggtggttttattactttacaataagacaaaaatgattaatttcttaattaaatttttgatattaaatataagcccttggttcctttgcctatttctaaacaacaaagaagaatatatcatagtctatgatttgctatgaattatgttttgtgatggcttatcgaatcctcagaactgaactggaacttgcatttcctctgttatcagcaaaagcttttctgaaatgtttgcaaagctccagatatatggggttcctgaataaatattatcccaacactgatcagctgcataggtgaagaccaagttaggaaataggtctacaaggatttcttaatgaaagcaggtggctgttgatattttaaatagattcaataattaattagaacatttttaggactttaggtgcatttcacaagggatttctgtaatattcagaaggtagcccatgtaggaaagcacctggttcaagatcatcattcatgctctcctaataggggggaaatatttttaaaactccacacaggccaaaagttctgttcctagcaaggtagacttaatttttttgatatattcacatgctatagtttaggaatttctggagaatcaaagaactgccttcctaagaaagacatggatttcatgttaaagacagaaaaagatgatagttggccccatgtagctgcagattttgcaatcacagattgaaccaatcacagattgaaaatattcaaaaaaaagtataacaaaaataatataaaaatataacaactatttatgtagcatttatattgtattaggtattataaataatccagaaatgatttaaagtacacaggaggatacgcataggttatatgcaaaaactctgccattttatagaagggacttgagcatctgaagagtttggtatctgtgggttgggaaggacctggaaccaacaaccccatagatacagaggagcaacttatatttgtttaaaaccatttttggcaaacttctaaaacagactctgtgcaataaaattcacttgcttaataagtcacattccataccaagttcacataatggtagattatcctcaacttccatgtgtttgatgtccattcaatattttatgttttctaagtaaggtaaacaaatctgttgactagagctctgaagatactgaaggcttcccttccttctctgttaccatttttgtgatatgaacttctaccaagataaatttaaaatgcatttgttttatactctatgttttacactttgacatcaactaatctttgctcacaaaagaaaagttaggaccctttagcattaatatacatagtaaaaaatgctggaaaagtttttaaattgttactagcacttaggtaagttaaattcgcaagcaatatttttttctgaaatgcattgatcagcagtaaggtacaaaataaactaaatcacatttcatatctcctttctgtggtgtttttgaaattctgagtaatgaccctggttgagccattaatgcaaatcctcaaaacttaagtagtttcttgatactttccattttgaggcatcttttaaagaaacagcagatgcctctccacatgcattcaaaaaatcaataaaattaatcaataacactctccacaggtaatatatgttcagaagcatttctgcctatctatattgatttagagaattgcttcaaatctgttctgatgtgtataaaaatcatttccttattcatcaaagtttctcttccctgatatgttatttcatatatggcacacaatgatttttgtctctattcttgtatatttgtgataaatttcttatgatctgtgtatgagactcatttgaataaaatataaaatgagtattttgtttctttggagaaacctattgctcaaaatttaatcaaagaatgaataatcatgagaaattactgaagttattgtaatgagaaacgtaatgatgtatttcattcacatttttattatttataataagcttaaaaggtttgagtttgcttctatttcttataacaaagctccattcctgcagacacattcctacaatccagaatgacactattactgactatataaataatagaaaaatgcatagttttagccaattgctgactcatagtattgctagaaaatgtaacatgttcaaacctataagtgaattttgtaacctttttgctagtgtatgtgttacgtgtttagacagagtaataagaaaaatagatattctgaattttctgaacataaagaaatttaaagttttgatagatataacatttaataattctcattaaaaatgactgtatttaattaacccaaccaacttatatatccacagttaccttaactaacagtacctgataactggtggctcactggggaaactgtatttgatcaattaaagagtcccccaaggaaacacaactcttaactcttgatatattaactagtgttgtgaattattcctctaacaaaaaatcaaatatttctgtcaacattatttaataaatttcataactaacatagggtgctccattacaaaatgacatcatttggccagttaatacaccaccacagtaagtgtgcctcaaccagtatcttcttcaaacttggatttattaacaagtttcatgcctctcagtggtttttccttggaatttcagggaataggaattttcatattgacaaccgaggtccaatacctctctctaccttagaagattttactttaccaatctatcaaattaattttgtcttttcttaattcttaaattaagttgagatctttcagcaaaacaagaactgttttttttttcaggaacaattagtgtaaagaattggataaaatatattcactgtattcaaaaatattatttgggtgaggctaaggggatgtttgccaacatagaaagcataagcattggaaagaaaatataatctggtttgtttcccctatatcaaaaattaaatgacaatttttaaataacatcttaatataaaatacttacctaaagatgtggaagtgttttttctgcccactaaggcactgggtacattggatggtctccagaagctctaaaagaatagggcagccttcctgagtttgtcacttattcccaggaaactagttgtacaatcagattcttggaatcaatagatgccactagggcgaccatgaatataaaatttttaaaatatttcttttacttatgtaaaaattaatttaaatatattcctagagatgagcatagattcacactggaaactggagtggcacactcaagagagattttgatagacacatctctccatcatgttgtgttttagtaagggcagctgaatcaaagtggaagggatgacatggagccaatccaaaaaaaaaaaaaaaactcatctgggcatatcataaaagataacagcatgagccttggagtcatatagacctcaaatccggatgccatcacttacaagctgtgtggccttggagaagttgcttttctttctaaacttcatttccctcttctgtaaagcagagtatatgctagtattttctaataaaaatatgtgatatgtgatatactatgataatagtatgttgataattttaaattttctagtggacacatttttaaagaacaggtaaaattgatatatttatttatatatttatatttatatatgagatatatatttatacttattaattatatacatataaaatatatgttaaaatctataaaatgtacccaaaatggtatcatatcaacaagtaatcaatatgaaaatgagtaatagcctattttacattctttcttcgtttgaaacctggtgagcattttacaattacagcacattccaatttgtactaaccacatttcacatgctcaatagctacatgtgtgtcatagctgctataatggatattacacgtataacctaccccatagggttattgaagaataaaatgagataatgcaagtaaaggacttagaacagtgcttggcaaataatatgtactacaaatggtagtgtgaaagctgctactattatccactgatattgattatatcttccttgctctgctgggggaatggaaaaatatatggcatggcccctgttcctgagtaatcacgaagttaagaatgtaagacaaatatatagttaactagaatttttgacatcttattatcacatgaatggtatgaatgaaatgcaataagtgctcagaaaaggcagatcttgtactaggaatcccttgtaccaacttggtgaagaaaatcattttgaactaggatttaataggtaggttgatttttgttaggaagtaatggttagggaccatgaggacagctaggaaaaatattccactatagggaattacagaagaaacaatccaaaggtagggaagtgaaaaatacattcaagaaatgagggcaaattgtttgatggagagcacagagttcatgtaagagtgtacttgagttagcaaatgcagatttgtatcagagtgtagagatcttaaaagccatgctaagatacttggacattattcagtgtctgaaagaaatagtaaaaaagagcactgatttaggtgccaaagatctgatttcagccatattctgcaactgccacacgtgcattttcctaccttggccaagtcacttcagctcagctgttttatttgtaacataagatggttggatctaaaacaaaacaaaacctgagaacgtcagagatgaaaagggcctctttgttgttgttgctgctgctactgcgatcattgttctgtttatatttgtggtattttaggatgaggataacattactgaagaaatgcctcaggaattaatataggtagatttaaaagtaaaaatatgaaaatgaaaagatcattttgagaatcatttcagtggtcctagtgtctttaaaaaaaggattttaactaatattgtggacataacagttggaaatattaataaatggctgggttggattatagaaaatttgtttaaaaaaagaaagaatggctaggacttggattgaaggtggagagggaggcaaagtgagaaatgaattttattacagtttggagtctagaaaaaaaaataattagtattcataatagaaatggtagaaccagggagataatttggctggagatatgggaagggatgtaaaatgagtgtttttagttatcgggtacaatttttagtacatattatatatgcattagaatgtatgtatttagagattaatggatatatatagtgacttttgcaagaacatgagtattttagtttcagagtttcacaaagtagtagaatcaacattaaataaaacaattatgagattaacatgagcattaaagttaagaacttatgcaactagagaattcagtgatattcataaagaggccccaaagtgtgacacttatctgagtcttttttgcttattttttgttattattttagagacagggacttgcgctaccacccagaatggagtgtaacggtgggaatagctcactgcagccttgaactcctggactccagcaatcctcttgccttagcctccacagtagctaggactacagatgcatgccaccatacctggctaattttcttttaaattttttgtagagatggagtctcactatgttgtccaagctgctctcaaacttttggcctcaagtgatcctcctgccttggcctctcaaagcattgggattataggcataaacccagttggccctaaatcttaatttatgaaagaaattctaaagccagtaaatgaagcaagactttttgagtaataaagttttcaattcaaatcccaaatcaaggctgggcacagtggctcatgcctgtaatcccaacactttgggaggccaagatgagtggattacctgaggtcaggagttcaagaccagcagggccaacatggtgaagccccatctctactaaaaatacaaaaaattagctggccgtggtggcaggcatctataatcccagctactccggaggctgaggcaggagaatcacttaaacccgggaggcggaggttgcagtgagccgagattgcgccactgcactcaagcctgggcaataagagtgaaactccatctcaaaaataaataaataaagaaaatcccaattcaaccttctgtgagtctccttcttcattttctaggaggaaagaatagctacatcacagtgttgagtgaaaaacatgtgatgtaaaaaagaaagctctagacattcaatgaatgagggctaccatcaactcattccagtaaacctggatgacaaagaaatgggctcaaaccctttctatttaaaaatgtcataaaggtttttgtgctcctacttgtaacacactatgaatcttcaagcaacaagcacatattaagtactgataagtcaagttccatgatcataaaaaaaattgcaataataagcagcatgaatctcaaccttaaggagaacttggctacatgagaaggaaagtaagtattgaaaggtttaaggtaactcctggttattctaggtgtacactgtcaaaatcaaattgacttctcacacgtgtttctaaaattaatttaaaattcaataaaaattaatgaaaattgattgaaaagttttaaaaattgtagctagaaaaagtgtcaatattacacattttattagcatgagagtaagagtttccaaactatgctagtttatataaagtgatttttacatccagataaaattttaccactcaatttgtatggattaattcattctgtaaacttcttcaagggattctattgttaataatgcttaaattagtaagtatattcaaatattcaagtttttataacaaattcaattgaaactgttatgcctaagatattagtgaaactacttattaaaataaatacagcatataaaggaactatattgtattaagaaagttataaatttatttggaactaactttgaaagaccctctaatttataaaattagattgaatcatttaatagcagagcaatactttgaggttaggagaaatttaattcttgtcttcaaagccaaaaggagttggcaaattcatccaacagagtgaaatggacagcaacatatgctcctcattgagtcctattggtcaacagaaaaggtattgatttactaaacatgaaaatattctgaaagtcttggcagataaaaataagtattgattatatattttaagacatatgaaggagtcataatcactcagtgttgatatatactgagttatttgtataaaaaatagcagttacaaaattaaatcaatcttctccctagactgtttattttctttccattctgtgaaaagtatgacatccttataacttgaatgttaacaaaagaaaaaaagcaaggcattttttacataacagatgtttaaacatttatctgtattttaaaatacctttataaatcaattttgaccatttttatttttaacctattggtaaactactctgtttttaatcacaaatttatttcatgtgatttttatggaatgtgtgtattcataaattgttataattattcttgttaaaatactaagctaaataacaacttaataatctgttcagaaattacatgttacaagacaatattttgcttttaatattttaataaaagatttaaagtaaaaataaattatttaatttcacattttttaaagagacatatttacttcaatatgaacattattagttcaggtttcacgtaagttctcatgacgctatttaaaattgtatttctaccatattttcattccattgaccaagttctgatatagttaaatcttttatcctccctaaatttgtcattaagaccctgacattcagatgacaagtgatttgcagtgtggtttgtttttcattgccaatcaccaggagatttaaaaagatacccatgcacttctgtataaacactttctctataaatgctccactttgtggagatgctaccagtaatgagactatggcattttttattttctttctgagagtacctcttctctctcaaaccaattggatactaaagtactaatgtagcaattgacacaccctggtaagtaattttgaacattttctaacttagaaagaggttagcatccctgttcccagcaaaactaatttttaagtcacacattacatgccgtgtaataatccaatatactgtaaatgaagttgaacatgattataaacttatattcattttaggaattagttacgatacgtactcagtcttgcaatcttctgaaaatgaattcaggtaaacttgaaaaaccgcataataaatttgctgaccaaaatctgttcttgaaaaaacaaatttttggaacacctgaggcatggtgctgttgaattaatatgaggttccaatatcattttctgtattttatttaacaaactttcagaaattaccagagccttcataaatatttccaattattatttttagagatgtgaataatgatttaaagctaaatatttttctttttctttatggacttggttctgtttcgttttgtttggtttcacaaatagaaatcagtgtttaccccacttttcagctgttgtataaagactacaagaaaaaaagttatttgggaaagtcacaaacagcaattgcctatagagtgaggttggaagtgaaatccatatgtaatgcctctgtcagcaaagacttagtagaaaatggtttataataaatattcacatctgctgctttggacactctaatccatcctaaggatctttgctgtgtcaggttttgttctagatgaagaagcccagtagttataaaggtttgcaaataggttgtatttatcatggttagctttacttttataacttttctctgttttagaggtattcatgatgtttgggggtaaaatttgtgattaaatatttcactatagcttttatggtgatataattctagaattcttattataaaatggaccaatgctattttcacaatatatcacttacctaaaatctgtcaagaaggcatcattgataacaatgctatgctggctgtggaaagcaatggctaaaagcccaggctctggattcgaagtgctgtgattaaatgctagctccttctatacctagggtgtcattatgagcaagttacttcgcctttccaagcctctatttcttcacctacatagaggaggcattttttacataacagatatttaagcatttttaaatagtactaactatttaaaatacagataaatagtactatttaaaatattaaatagttaatactattaatactaactaatatattaaatagttaatactgttagtactatttaaaatattagttactactattagtactaactatttaaaatattaaatagttaatgctattttctttatcattagattactgtaacgatcattcagaattatccatatcaagcactaaatataaggatcatacggaattatccatatcaagcactaaatatagtatctatcacattaaaagagtttaataaattttaaatgttattactgaaacaataatatgccttctaagtatgattaaataatcccatggatagtactaatgtcatacttatttacactaagtactgagcttatgtaaacatatcctattgttttacttaactccaagtcccatgatagtttgttactggacttccttaataaaaatattaattaaaattggatccctgatttgttttcactttgaggaaatgagccactaaaaaatatatgatacaaaaattatgcaaataccctgtgctgtatttagccatcttatgtaaaaaaaatttaatttatcaaaatttgaattctaagctagagtaaaaactctcaagtcattttgaaatggaagtatttatttccacttcagcttcaaaaaaatttgttgagttcatgagtatcacaatttttaaagcaggaatgtatattgagttgtaagtaatgattagcataattattataaataagtttaaagaagaatacaaatgttttccataaattttgaaagctatgccttttaaaactttctaacatataatttatttgaaaaagaaagttgccttgcatagttgctttcaatctcatctcctcgaaatgctttattaatcacaaatataaaagaatagtaggatgtttgatgaaatctgcatataaaggaggtagaccattaggctctatgtcccaattagaaaattttataacctaattattgatgtgtcttaattttgactcaacttatttcttatacctacaggagctactgcatatttaataactgacccctaacacagaatgataattgaaaaaaatagaatgcttcattgcttataaactgtgaacacttgaaataaaactttgattcattctctctctctctcctctctgtctccctcaggtcgagttttagctcaggcaagtggcaatggtgttatccatttgctagatcttaaatctggggagattcacaaattgatgggccacgaaaacgaggcacacacggttgtgttttctcacgacggggagattctcttttctggaggctctgacggcacagttcgaacgtggtcttgaccgtcagcacatcccgctgcagagggcattccctttaaggcttgaaaatgcctcctgtagtcccaaaccagcaaagaactggttaaatgtgccagcaggtaacatttacagtctgctttaaaacatgctttggacatatattttagtgctcatactgttactaataaaaaaataactttatgctca

SEQ ID NO: 1230 - DNA, 1126124 bp, Homo sapiens; identical to SEQ ID NO: 1229

SEQ ID NO: 1231 - DNA, 1126124 bp, Homo sapiens; identical to SEQ ID NO: 1229

SEQ ID NO: 1232 - DNA, 78 bp, Homo sapiens
gattggtgatgagcaacaatcaccatctttcgtttgagtctcatggccatgagaccaaccccatgcactgctctgaga

SEQ ID NO: 1233 - DNA, 78 bp, Homo sapiens
cccgggacccagttcaagtaattcaggataggttgtgtgctgtccagcctgttctccattacttggctcggggaccgg

SEQ ID NO: 1234 - DNA, 62651 bp, Homo sapiens
gttcgtttgataaagaatatgaatgtttataaaccaatattcaaaatagctgcacacatctgttttcacttgaataaaaaaacacattgtgacaaattttataaccttaacttaaaatacatgaatattaacatttactaatatatttacacattttatttacatcatcaacaaatctgatgaaaaagagcatatgtgattattttaacacagcaggttatgaccagtctttgaatattgatccaggaatgtgcactgcatttaattagaaaacatacttttaactttttctgaactcctagggcatatctattcacacaaaatatcgcaaggcctcagtttaaaaaaaaaaggagcagttgtatttaatcttaagggactacaaaactgccttgtttaaaaatatgaaaattcttatgctatttttaagatacttttattacttttatttttcacatcaaaattacttaattgaacattaagcatctaataaaaagttataaatattctatcacatgtgatactatgcacttcatgatttgaaacagctacaaactcattctcatagaatatgaggtagggccagtagtaaccccattttacaaaggaagaaaatgagatgtgactatttactagtgaaaaggctaaagttaaatttcatttctcaaaaactacaccttcttattagcctaatttcttttacaagtgaagcggtctggccaggtgcggtggctcacacctgtaatcccagcactttgggaggccaaggtgggcagatcacctgaggccaggagttcaaaaccagtctgggcaacatggcaaacccccgtctttactaaaaatacaaaaatacaggtggcgcgtgcctgcagtcccagctactcaggaggttgaggcacgagaatcccttgaacccaggtggcagaagttgcagtgagccaagatcatcccactgcactccagcctgggcaacaggggaagactccacctcaggaaaaaaaaaaaaaaaacacaagtgaagaggtctgtttcaagtgggggtggggaagtgtgtgattgaggtatatctcagagagaaaaaagggaattactttctacattgataatttttttttaatgattagggtttacctgaatatgtctgcctaatcaatggaagttactgacagaggactgcaaaatccttcggcaagacaatattttctacactttaacttttcctcaggttcaaacactgcattttcttactcaaagatcttctcaaagtaagatatgaattataatcctgatgacaaaccaagagctctttaatccagtgggttttattgctctaccttcatttaatttgatacatatttcccccctctgagcattaggtaagttaataaagcattataaaaataaatttaaaacataaaactaaatgagatctctcaggttcttctttgaacaaagatgtttctgtaaacacttttacaccagtatcttaaaattccaaattattcaagtatctctttaaacatatggcttcatatattaataaaaattgaagcaaatatgtgaaatctttaaatcctcatctgtatttccacagaaatcatttacaaaagctacttgcctttttaaaagtcttctcaatactctttcttgagaactagaattccaacttgcattactattacttgcactgcaaatctttgagatttctacttgtgtttttaactcctattatttccttaattctcctttccctttacccttttttcctctcccatctttgcatctttgtcacattctgttacaagctcacagttaaaataaacactagggctacccacagactcatttttataagaaattaaaggcatggcagtcttcacttcaaaagctaaatacaaggccaaattccctttccaataatgagtttcttacatgtgttcccagtggaaaaaaaaaaagctcagctgctacaatagaaacatatcagcaaagtagatccaaagatgtgccaatcagaaacaagcaagcataattctcataaagttctaaactatactcatgttgaattgaattgttttagtgattccaagacaatactttactgttcccattcagtttagagttgttactaatatgcagattcatgttgggtatatgcagcaaacaactttttgttgttttaaattttgttttaaattccactaacactcatatttattatttcaattactgttctttcaatacagtgacagagctgtacatcaggatccatgcttccagtgtccctggatccatttttataagatgaatctttacagatttgagaccatccacttggtttctcctttatttgttgaagacctacaacataagggaaaaaaaacattaaggccaagaaatttggaaaggaatttggcctttttgtttgagatattaagataacccttgaaaataagttaccacttacgtgtaataattggatcaatgtctcttgtctgagtggcaacatcagaggcacaaacttgccctatttggatcagcaaagacataatatcctcatacaatggaggaaatgctcgacaaaaagagaccaaacttggcagagttggcataaaaaaagcataccgcttagcctgtgttaaaactgttggaaaaaaatgaaacaatattttagtttacaaatataaattcaacacagcttacacaacatactaaggggaactatgctctgtgctggagatatgaagttctctaaacacagccaacccgtcttcagaaagctcacaatctagtagtctcagtctttatccaagatacaaattattatgcacaagttttgcaataagtacattacatgcattatttcattgaattcctacaatcttatgaatgaccaaagtactattatgacactcattttatatatgagaaaactcttaaaaaaaggttagagaggttaagaaacttgttaaagatcacaagccagttagtggtggggctgagattgaattcaggcagtgtaaactcttaatcactacaaataattataacaggatataaatacgatgaaaagaaaaacaacagggtattatggaaatattataatgagaaagaatactaagttaactatgccattacattaagggttgcattatagttcatatattttaaagtagtttattttcagaccattttattctacaaaccagaaggtggttaaaatatcagaatatgttttagaacttatgaagacatctaatacatttatctttcatttatacatatgatgatatttttctggaactctgagcatttgtaataaatgaacatttgttatctactgatacaattacattctgaaagtgtatttgttttccatttataaaatacagaaagcttatatttacaaatctatatatactcattcacaaaatgaaaaatacaatttgcctacctattcattcccactacactataaatcacatttgtaaacagaagtttccaaaagaagaattcaaaagacggcataagttaaactagtatttaacacatattgtatcatactgtctcagagtgacagaaaaaacatattgcatcactaaatgcagaaaatataggaactataataatttatgtcagatgtttgttgatgttgattggctacatacctgttaacaaagttcccatgacattgacagctaaacgagccacactaagtgactttggtaatgcatattgtatacacaagtgagaaagcaactggatagcaaatatctgcaatacaaaatccagttattacatgtttctcaagaatatctttaggtattaaaaattataaaatgttttgtataactagtaagactggagagagagatcaattgtcctaaagctccaaaatgctcattacctgtttctcaagttctggctgtgcaataagctcaggtatgaaatctagacagatgtgcatagatggaatacctgcgaccgtcagaggcaaaagttcacatggataaccctatctcaacaagaaacgggaaaaaagtcagaaataaaataactataaaagtacagataaaaatacaaatgaaagatttcatttcctttctgtaaaaattgctcagaaggctatagtgccccatatgtaacctggcatttcacttttctgatgcactagaatagagattaaactatcgaacatttcattaggttaaaaaaaaaaacaactaaaaatctggatttttctccatattgcaaaagcccatggatcatttgtgttttctctggtttctaaatgatccctgttaatatagtattcaaagcccccaagaaaaataaagttcaaacacaaagcatcattctttggaaacagacctgaaagtgaacaagcttagcaatgttgggatctgcaatgtacatttggtgcaagagacaacagataaggcactgaacttctcgaaggttacagagcaaattgtcttctccttcctccattcccttatttggagcgctggtggtaataacactttgaacatttcttaacaagctatctggattgacaccatttgctttctcctcttcagtaggtaggcaaatctctaagagaatctggacagctgcactatcctataagcaaacaaaacatagaaaaagtaagaagtttctaagaagttaaaaaacaaatcagattttattttcacatgaacagatatgataaaataactaatttcttaaacacacatacacaaagaggtacttctaagagcagaactgagcaatctgtagagcagtggttctcacctttttaggattatgaaccccttaagaatctaaagaaaactatgtaccctctcccgataaaaattaacatacataaacaaacatcattacataatgatatcacatatctctaaaatagatccatggactccagtttaagaatatctactagaagagtatcatgaattcagttacatccaaaacaggccctaggcaaaaatgacttctaccagaatgtcctttccttcctcttaatctcctacttttcccagtatgctatcctgatttccctttttttcaacctgtttaaggctctggtttcacaaggaaagagtctaccttaccatccattccacctgcacaactcattgctcagtctacaggcttgagcatcattgcacagagcagtagcttgaggggtaatggcaatatatttgaggcccctatatataaaggagagctaaaatcactctcatctagcagaaagaagtaaaaaataaaaatgaatacatgacatccacctctgatagacagctactgcctaaggtagagaaaacaattacttgagctaagtgattaagaacttattataaagtgaggttagactactttataatcatggttcttggggaaaggagtttttggttattgttattgttattgttttgttttcttttgttgttgttgactcaggagccagagtgcctaggagtgaatcctggttctgacatttactaaatgtgtaaccatgagcaagtcacttaacttctctgggtcacattttcctactctgtaaaaatggagataatactctatacctcataggtaggttataaaaattaaatgagctaatatatttaaagaacttaggctagcacctaccatatggtaagcactacacagatgttagcttttatgatcttcaatcccttatctgaaactcctaggaacagatttattttattgatttattttattgatttttgttgttgttgttgagatggagtctcgctctgtcgcccaggctgtagtgcagaggcacgatctcagctcactgcaacctccgcctcccgggttcaagccattctcctgcctcagcctcccaagtagctgggactacaggtttgggccaccacgcccggctaatttttgtatttttagtagagatggggtttcaccatgttggccaggctggtctcaaaactcctgaactcaggtgatccacccacctcagccacccaaagtgctgggattataggcatgagcaaccatgcctggccaaaaaacttttctaaatataaagttgaactgcttatattgtcatggtatttatcactgcctgacattttattatacatgcagttgtttttctgttgtctgtctccataatttgacatttgatcttaagaaacaaataactaaggattttgtcttcttcaccactctatccccagttcctggaacaatacttggcacacagtaggtgtcccagtaaatattggttgaatgaggccgggtgccgtggctcatgcctgtaatcccagcactttgggaagctgaggtgggtggatcacctcaagttaggagttcaacacaagcctggcaaacacagcaaaaccctgtctctactaaaaatacaaaaattagccaggtgtggtggcatgtgcctgtagtcccagctactcaggaggctgaggcaggagaactgcttgaacccgggaggcggatgttgccatgagccaagattacacctctgcactccagcctgggtgacagggcgaaactctgtctcaaaaaacaaaaaaaacaaaaaaaatgtgccgaatgaataaacatgtaactctaaactcagaataggtaaacacttaaattttattaaaatataaatcttatttaaatggctatttcattcatatcatgaagattattcctgatttcagaaatacaacatatctgatactcagaagcaaaggtaacatcattgtaatagattctataataaaagaaatgcacaatatgtcaccaatgtacatggagcgcacaatgtgccatctattgaactgattatactagtagagaagcccttgctctttttgactaaattttactttagcaaaatttacctgagcggccagtaatgcatttttcaattcttccctggtaacttccggagcatcagtttgtccaactaaaccaattgtattattctgggaaggcctatcttgctctgtttccttcagatgagcactaaggtaggctttagatgcaagaagatatccattcaacatgtgtagggtaatatccatcagtggggggcatctaaacaaggaaagcagaaaagaaaaatatatcagaaagaatataaatttataaattagccagaacatgatcaatttagtttaaatgctgagaaaaacctgagtagtacatactaacttttcccactaaaatattcattctcaaaagtttaatatatgtttcttattctctgtatttcaagcccttatataaatagtattacttgtttcatcttatcagctaaagtcaaatatgtataatgtaaattctaaagaaaagatgaccgggtgcgggcaaaacaatattgcatgaagaaaaactgtaatacacgtacaaaaagctgatatcctttatagataaagagctctttaagtcaataaaaaatataggctaaaatataaagatgaaataaatggccagtaaatactgttaaatgtccagtctaataagaatataaattaaaatgggaatctattttcacctatcaaattggaaaacattatatcaaatagtgcaggaaagtatatactatcaaacactgctatggaatgtaaaccagttcagcctttctacatagtagaatgaaaatctgaattaaaagtcttgaaaatgagcacgacacttttgccccaataattccattttcccatgttctaatgaaatactcagcatggggaaatgcacataatcaccaaagcactattgataaaagcaaaaagtagaaataaaatatcctaggggattgggttaagcatagctctataaaatggaataccatatagccaattaagataagaatataaactaggcacagcagcacacaactgtaatcccagctactcaggaggctgaggcaagaggattgcttaagcccaggagttcaagaccagcctggacaacatagcaagacccccaactcaaaaaataaaaataaatttgaaataagaacattaacatgaaaaaaggttcacaagttgttaagtgaaaaatccgagctacaaaaacattagatacaatttgataacagaatttaacaacttccttaaaaactgaatcacctaaggtgattcaggtgtaagctcacctatttcagtggatttttaacaatgataaatcattttttcaagaaacagctcttttctagaagtgttatttattgtggtttccttttattagatacttaacatcatttacatacacagtttgttctgattcctatttcctatgagatcttaatcttaccaaaccatatttagctaattttgtagattttgtcacttcgagaatgtcatcccttggttgatgacagacaagtttaaatatcaagtgtgtcctatttagtcttccttactagtttctctctcctctaatccacctagcacaaagcatcttttcctaagttataaccccaaccacattagcctaatattcaaggccctcgatagcctgaccccaatttaactttccaactgtaaaatgttctcttttcaaaaataaccctcttcacggcttcctcattcttgcttctaaacttctgctcatactactctttttctcaaagtaccttccttgactccctgacccccatctttatactattagatgaacaaatattcacctaaaccctatgtccactcttctttttttaagtttaaataaagcagtgggagtgaagagggaacaaagaaatctgtacctgattatgatcaatcagttgtaaataccactgcactcgaaccagccctaactccactctttgaaacattacccatgtcccatctcctctgcatctttcctgaacttttaagaacattcatttaccacaccattcatctacatgagcatattacgtaacttatcatgtatctatcttatgtcccatgcaaatgataatcactttaaaggaaagcccctcaacttatatgtttttgatagtacttatcataacaagtgtgactcaaagattaatgataggaattaactaaattctaccttttgagatgaagccacttgaaagcaatgctgaagtttagcaattggtaaggatttagagccaaatgtggaatcaatgaagctaacatcactattgtgcatgccaaaaagatcacagttttaacgcaggtaacggttcacaagaaaccagttttttaaaaacctttttaatgtgagaacagaaatagttattctttactggtctaaattgtgagagagaaaaaccactatttgtggcaccaaaaccaagaatggcatttctctaaagctaggttttattaatcacatactaaatattaaaatgaatatacatttcatgaataaacacaactaaaaaaataagacaaaaaaccgcacaggtcacactgcctacttatctgcaagaaaaattaaaatataagtttaaactgaatttcatcaatttcttttgactctccaaagtacagctctataataaaaatgaaactcaaatgacatgtacctgtgaaccctctgatcacaccttaggacaatgagaggatctatcatcaggtcattctgagtatacttttgttgtcgtacaaactttattgaaggctgaagtgcattaaccgtcattacccatagcctgataagaaaataatcacatgttcaaaacagttttttatatattaaaatctgtagccatccagtcctttctatcttagaaagttatattcagtaaataattagaaaatacatatgaatgaactttgaaaaaatttaagctacagacatctaacctattaaaatatctctttaaaaaacacagagataaaacagtaaacacaaagtagtttcagaaacgttcacagttgtaatggaataatcatggcatataaaattaaaacctgagttaaaaccttagttataccatacttgctatatgactctgtgtaagtcactgaggctctctaaactgtttcctcgtctgtaaaatagaaatgacataatacctgtaaatgaaataagacttgccaaaacattctgtatctagttccataaatataagtcactattctggatttatcatcataaagtctccaagtgagatgccactttgagattagacattaatagattataagtggttactaaaatgactgcacatcataattactaagggttatgcaaatacagaaggtacttgatcttacagtgaagcccaggaatccaccagagaacttccccctcttaaatatgactgtataaacaaggatcatcagacacttaaagaaagcttttactttgaaaaagattaaaatatacaaacagaaaaaaaggaactccaaacagaaaatgtagggataaggagaaaaaaaattttcgaactattaatatcctaaaagaataaagtattttatacatgaaacaagaacaagaggcatttaagaatattcagataacaaagagctcttagaattaagaagaacagggcctgacacagtggctcacacctgtgaaatcccagcactttgggaggctgaggcagaaggttcgcttgagcccaggagttcaagactagcctgggcagcatagtgagacaccatctctacaaaaactaaaaaaaattaggcaggcacgggggtatgcacctgtagtccagctatttgggaggctgaggcagaaggatcgtttgagcccatgagttgaggttacagtgaactatgattgtgccactgcagtccagcctgggtgacaaagcaagaccctgtatctaaaaagtaaaaataaaaaataattttttaaaaaatgaactagaattccacacttaggctaaatatcagtcacatatgagaataattcagcatctcaaaaaagttaagtttaccacactctctttctcaggaagcgagatgagtgtgtgttccattcactaaaacgaggatataaaccaagaaagagaaaaatatggaatccaacaaagaagagtgacaatagcaatttgtcccagatgggaacatgaagacagaaagctctgaaaggaatgtctccaagaaaaaaaaaatagtgtttcttttgtttttttttgagacagggtttcagtggcacgatctcacctcactgaagcctccatctcctgggctcaagcgatcgtcctgcctcagcccaccaagtagctgggaatacaggcatgcatgcaccaccatgccctgctaatttttgtattttttgtagagacggggtttcaccatgttgcccaagctggtcttgaactcctgagctcaggtgatccgtccacctcggcctcccaaagtgctaagattacaggtgtgggccagtgcacccagccaaaaaaatgttaatgatacattatctgatgtgttatgattaagtgtgaagtaaatttcccctcaataatgaagcttggggatgaattagttattggttattgataccaatttaaaaaactgagcaaatagaaaaaaggtattaactaacccaacatatatgttgagtaagggggagggcacttgcataagaatgaaattgtaattaaaggattatcacatagctcaattatgaaaccacttctgtagtcataataatatgcatttgaaatattgctttaacaaaaattttaatatacctgtgttgtgagaaacaggaaaaggggcaatgtgtattagaagaagtgggactcacaggagtggaagcaagtaagagagctaactaaccttcaccttgtagagtagaaagtcaacagataatttctaaattggaaaatcaggaaattacagtcattataagagatatatggggaggatataaataccagaataaaaagataaaagagatgaaaatagtagtctctggggagctaaagtctaaaatacaaaggtgtgaggcagaccttatatactacttaacttgtatactatttatagcccagtattctgttttctagacctgtccaggtgttaaggatccaatctatgaaccagcagagacccaatgactaaagacaaactttgctgcacactgaaatcacctggggaatcttttaaaaagtactgacgcctgactcccacccacaaacagtctgatttaattggcatgggttccaacctggggatcagtagtggtaaaaactctccaggtgattttaatgtgcagcaaaacttggaacaactgcaaagatccaagatataacagtgatctaaatcataattagccacaaataactatacatgataacccaattttcaagaacttcctaaagttagaaatactgtaaggtttctatttcaataaagtttgctttacttaaagatataacaactatttagtagtcttaagaaaggagatatattgtcatatagtcaacaaatactgctatgagtggtgaaaaattttttaaacaattaaatttaggttattgtatattatccctgctatataattatctattacatgtaacaatacactgaatttaccttctaggcatcacagtattaagaaccatccatagtttattgactgtttgcagaattctccgtggaacccctgaattcaatagctggctcatattggatgttaacacttccgcatatggtataagttcactggcagagagtagagtcaagtgttctataatctgcatcacttgtgtgttatttactgggacagctgaaaatgctaaaaagaaaatttagcaatcataacctaaattctgtacagtttatcaagcaggaagtagtagtgttctctcagactatagaccaaacaaatcaagaaaacaatgtggctaaaaagtaactatagttacttgctattgtttcctacagaaacctaggtacaatttcaactaaacttattaaaataagggccagatggatgcggtggctcacacctgtaatcccagcactttgggaggccaaggcgggtggatcacttgaggtcaggagttcgagatcagcctggccaacatggtgaaacccctctctctactaaaaatacaaaaatgagccaggcgtggtggcaggcacctgtaatcccagctacttaggagactgagacaggagaatcacttgaacccggaaggcggagattgcagggagctgagattgcaccagcgcactccagcctgggtgacacagcaagactccatctcaaaaaaataaaaaaataagggccctaagaaaaattcatgcaagtgtagttgttctttcataaagaacaaaaatattttttaaaaatcacattaatgggataggcatggtggctcacacctgtaatctcagcactttgggaggctgaggtaggaggattgcatgagtccagaagttcaagaccagtctgggcaacatggcaagaccacatctctacaaaaagtaaaataattagctggatgtggtggtgtacctgtaataccaggtactcgagaggaagatcccttatgcccaggagacagagtttgcagtgagctgtgttcctgccactgcactccaaccttgagactgggcaacagaccctgtctccaaaaaaaaaaaaaaaaaaaaaaacactttactgacccgaagactaatcttattttcttggtgattcagactgatcttattttttaatttattttttttcattttagagatgggagtcttgctatgttgcccaggctggtctttttttttttttttttttttttttttttccctcttgcctttaccaatcaagagcccaggatggttttgaattcccggcctcaagtgatcctcctgctttggccttccaaggtgctgagataacaggcgtgagtcactgtccagcccagactgattttaaaaacaggactgaaagaggaaaatatgctgaagtattgcttttgatagctaacatttatttgaaaggctcaaacttgaaactttcctccaggtggtccccttataggatgtaagcacccagaagattgctgttactaaaaaatatctagaactatgctctccaataacaactaaccacatctggctattgagcatctgaaataactagtccaaattgaggtgtgttataagtgtaaaatacacaacagattgcaaagactaagtgcaggagtcttagtggggggtaaaatatctcattaaaattttaatattgattacatggtgaaataatattggcaggccaggcacggtggttcatgcttgtaattccagcactttgggaggccaaggcaggcagactgcttgagcccacgagtttgagaccagcctgggcaacatggcaaccctttctctacaaaaaatacaaaaagtagctgggtgtggtggcatgtacctgtagtctcaggtactggggaagctgaggcaggaggattgctagagcatgagaggcaatgagccaagattgcaccactgcagtccagagtaggcaacagaacaaggctctgtctcaaaaaaaataaagaaaagaaaaaatattggccatatttggtcaaataaaatgattatttaaattagtgttgcctgtttctttttcctggaaagtttataggtgttacagctcacattatatataggtgttatagctcacattatatttctatttaacagtgctgatctagaagaacattctccattacatagtcctattccactgcacatatttctttttttgacatggagtctcgctttgtcacccaggctggagtgcagtggtgcaaccttggctcactgcaacctaggcctcccgggttcacaccattctcctgcctcagcctcccgagcagctgggactacaggcgcccacgaccacgcccggctaatttttttttgtatttttagtagagacggggtttcactgtgttaggcaggatggtctcaatctcctgacctcatgatccgcctgcctcggccttccaaagtgctgggattacaggcgtgagccaccacgcccggcctacactgcacttatttctaaccagtttagaacctttctaaaaccacaccacctttttagtgatataatataggacctatgagagaaaagatacaagcacatcagaaagaaatggtaaaaattcctggccaggcacagtggctcacaccttaatcctagcactctgggaggctgaggcaggaggatcactcaaacttacaagttcgagaccagcctgggcaacatggtgaaaccccatctctacaaaaactaaaaaaatcagccaggcctggtggctcacacctgtagtcccagctacttgtgggactcaggtaggaggactgcttgagcccagcaggtggaggctgcagtgagctgagatcacgccactgcactccagcctgggtgacagagagaaagacacacaaacacaaaaggaaaggaaagggaaaagggggaaagggggaaaggagtaaaaggggaaagggggaaaggaggaaaggggggaggggaagggagcataaaattccttaaacgcaaagagtattttatatacttaaaatacattcaccaaaacattgttatatccatgggaaaattctgtatgattataagatttcaattagcctagcatctccttgtactacaaaaggggttaaaggagtatcaataatttactataccttcttggagttgtttgggagaatgatttttagcattattagtcaggagcattcgccgtagcagggcatcagtccctgtgatttcttcttcacaaatccagtcatccacaatacataaatgtgggtagttagtagcaaggagacgtagtaaagctgaatgcaacccttgaaaatttacagaaaatcaattggattcttcatgctcaaacaccagaagcttccccacccctctcatttttatcaagccatcagcccacaaggaaagagggttatgctctaagtcagtgtttctcaaaaaatgattagatggccgggcgcggtggctcatgcctgtaatcccagcactttgggaagccgaggcgggtggatcacctgaggtcaggagttcaagaccagcctggccaacatggcaaaaccccgtatctactaaaaatacaaatattagccgggcgtgttgttgggtgcctgtaatcccagctactcaggaggctaaggcaggagaatcacttgaacctgggaggtagaagttgcagtgagccaggatcgcaacattgcactccagctcaggcaacgagcaaaactcccgttcaaaaataaaaaaagaatgattagagcaccaccagcaccataagcttgggaagcttgtttcatgtgcagaataatgaataccatcccaggtactagatcagaagctctagaatggaggcctaggaatgtgcacttcttgtgcatgcaaactacagtttaagaacttcctgacagtcatttgatcaagggaaactgcttaaatgaagatcctgaagtaatgtgataaacagtgaggtgggaactactacttataaagaaagctttcaactttcttccaccccacccaacataacagtctcctaaagttgtttgacatagcaatggttcaagagttcagggtagaggaaagaaaaggaggagaaaagaatgtccatttggggactatcatatatggtttggaaaaggtcctattcagaaatactgataggcttctgtagagaacatgccctttcctccaaccctgttgagaatcatcactatagatatggtaaaattaaagttgcccactttgaatacctgaaaggtctcaggtactttatgtacgttttctcatctctccctaacattcatacaaagtaagcaatgcctccattctactgtaaggaacaaacaatgctgaaagacatttattaacattaacaaccctaaagtcacacagtcacatatgtcagccaagagaagcagtactgatgatacccacaatggggggcattttttcttggttcaagaagtattaaagaagaccaaaagaaatgggaaaacttgttaccaaatcaaagccttatttataacattttacctataccacagtttgactattcatgactattatgtataatgttaataatgagaggctgtgtgcggtggctcatgcctgtaatcccagcaccttgggagactgagggagatggatcacttgaggccaggagttggagaccagcctggccaacatggggaaatcctgtctctactaaaaatacaaaaattagccaggcgtggtggcacacgcctgtaatcctggctacttgggaggctgaggcacaagaattgcttgaacctgggacgtggaggttgcagtgagccaagatcatgccattgcactccagcctgggtgacagagcaagatgctgtctcaaaaaaaattatgacaccataaaaatgcctatttagttaatgaattaacgaagtactactatgctaagtgcttcacacataagtacctaataaatattgttgctaccatactattatcatcataacagtaagactacgcagtagtagtaggaatcaaagtactttagatctaattatccttttattatgcaaatcaaatgataccactgctttatcccagtagaaacaatacgcaattccgttctcatagaaacagcttaaaattgatgtttctgtgtttgaaaagacatcgtaacaatcaaaaatggcattactttaacatttaaacttctaaatgcatacaggagtatatatacagttaaaactatacccaaccatcacaaaaaagactgcttacaaaagtgtaaactaatcaacatttcatactcttttcaataaagtatatcaattgccaaatgctgttaaaaataacattattttctggaaacagattatacaaagaagccaggcacggtggctcacgcctgtaatactaacactttgggaggctgagtagggctcttcacttgaggtcaggagttcgagactagcctaaccaacatgatgaaaccacatctctacttaaaaaaaaaaaaagattatacaaagacataagtaaatacatgctgcagacatccggttaacgatgagcaatgaaggctcatgtttctccttgaaaccaaccataataaagaaaaaattccggccaggcacagtggctcacgcctgtaatcctagcactttgggaggctgacgtgggtggatcacctgaggtcagttcaagaccagcctggccaacatggcgaaatgaggtctccactaaaaatacaaaaatttagctgggcatggtagcaggagcctgtagtcccagctactcgggaggctgaggcaggagaatcacttgaatctgggagaagaaagttgaagtgagccaagatcgcaccacagtactccagcctgtgagacaagagcgaaactccgtctcaaaaaaaaaaaaaagaaaagaaaaagaaaattccaacttaacagaaagaaaaacacccacactcaaacattaaagaggtatttaattaagaaaaaatctctagaaaattagctgggcgtggtggcataggcctgtagtccccgctactagagagactgaggtaggaggatgtttgagcccaggagtttgaggctgcagttacccactgcactccagcttggataacgtagtgagaccctttccctaaagaaaaaaaaaaagaaagaaagaaaaatatctaatttcaaaaaacactacaatatttctacttaacaggatttatagtaaaaatattacaatatatccatactatggatcataaaacaatcagaaacagtaaggcagatctacctgtactgatatgtaaagatgttcaagactccaagaaaaaaaacaagccttagatgaggcaggggaggccgggcatggtggctcactcctgtaattccagcactttgggaggccgaggtgggcagatcacttgagaccaggagttcaagaccagcctgggcaacatagtgaaaccctgtctctactaaaaatacataaattagacaggcatggtggcgcacatgcctgtaatcccagctatttgagtggctgaggcatgagaatcacttgaacccaggaggtgggggttacagtgagccaagatcatgccactgcactccagcctggatgacagagtgagccactgtctcaaaaacaaaaacaaacaaacaaacaaaagaggtagtgtacaatactattcagagttaaaaaaatttttttttttttacctctgttaagtgtctgttaggttcaaccacaagaacctgctgtttctgtagctctaaattagctgaatatctgcaatttcatacagttcaacctacaggagaaaaaagcctgaaaatacatatcaactgaaaatagctagggttgcgttttagggggcaggctggtttgcaataactgaaataatagatttagtgagggaggcaaagaggaatttcactcttgaactgtttgaatttttaacattaagcacctattacacttcataacattataaacagaaaggttttttaacaataaactttagcagtaaaaagcaaaataaaacatacctcccaactcctgctgcagcccttgagcctgtcgaataaggaatttgataggaatctgatccattaaagaagaagaatatgatttgggctttctttgcatggcagctatcaaagataaaaagtgtaaaataaataaaatgtccagaaacaacagaaatcttaaccttcaacccaaatggaaacaaaaacaaagtcaaattacttttaatgcaattaacctgcgaatatagcatataaaagatgaagaatcattacgaaaacaagtggctacacaggaagaacaagaacatacctggagcaagatctggaaaatgtcctgaaatttaaaactagacagaagaaaattcataacaggttgagagaagccatgtgcaaaagtgccctacactaaaagaaccaacaagtgagtcaagattttccaaaacctaatgacaagatcaaatgtgatcatgaacatatggcctagagcttcatgattccaatgcatcttataaaaagaaactgtaattttatctttttttttttttttttgagacggagtctcactctttttgcccaggctagagtgcagtggcacgatctcagctcactgcaacctccgcttcccgggttcaagcgattctcccgcctcagcctctcaagtagattggctgggataacaggcatccaccaccatgcctggctaatttttgtatttttagtagagacagcattttgcaatgttggccaggctggtctctaattcctgaactcagggggatctagcctgcctcggcctcccaaattgctgggattacaggcgtgagtcactgggcccggccaattttttttttttttttttttttttgagacagagtctcgctctgtcaccaggctggagtgcagtggcgcgatcttggctcactgcaaactctgcctcccaggttcaagtgattctcctgcctcagcctcctgagtagctgggattacaagcgcccaccaccacgcccatctaattttttgtattattagtaaagatggggtttcactgtgttagccaggatggtctcgatctcctgacctcatgatccacccgccttggcctcccaaactgctgggattacaggcatgagccacagtgaattttatcatattatatacaatagtggtgactaaatctttttttttccctgagatgagtcactctgtcacccaggctggtatgcagtggttcaatcttggctcactgcaacctctgcctcctggattcaaacaattcttgtgcctcagcctcccaagtagctgagactacaggtgcccgccaccacgcctagctaatgtttgcatttttagtagagacggggtttcgccatattggccaggctggtctcaaactcctgacctcaggtgatccaccagccccagcattccaaagtacaggcgtgagccatcatatctggcctctttttaaattaagtcaggcaatacgaatttgacttccttctctcacaactcctaccctcaaccagccatgtccaacctttttttcttctaagtccattttaatttctgtacttttgctgctatcctaattcagtgcctactcaccttttgtttaaatatcttctatggcccactttccctgcctccaatttaatccatccttcaacctgcggccatagtcatcttatttaaatagagatttggccaccttcagtgaatcctcagatcacacagagtaaaggtccttgccagtcaatagtatctttctctgtctcatctctactgcattctatatgcctggcacccaaagctcattccaaggtactttcctttacaccacaggaatatatgagaatctcaatcagggtgtttgtaatttcacaaaggatgtacaatgtgtttattctcttacaaactacaaacagtaaagctcaaccatttttcttttattaaggacaagaagtatgtaagtgcaagtgttagaataaaggttgagaatcactgtctatatagaccacatatataccatatactctcatttagatataatctcccttttaagttaataaattagcatagttttccataccaatcttttatgaattaagaaaaaatcagaaggcagttaaaacaatagttataggttccagaaagagataaatcctggttccaatacttattacaatacttaatactaacttagggaagttacttaacttccttgtgcctcagtgttctcccctgtaaaataaacgtaaccacacctatctcagaattgttatgagggtttacatgagttaactataagactaaagtaaggccaggcaaagtggctcacacctgtaatcccagcactttgggaggccaaggtgggtggatgacttgaggtcagaaggtcgagaccagcctcaccaacatggtaaaacccattctctactaaaaatacaaaattcagtggggcgtgttagtgggcacctgtaatcccagctactcaggagtccgaggcaggagaatcactggaacccgggaggtggaggttgcagtgagctgagatcgtgccactgcactctagcctgggcaacacaacaagactctgtctcaaaaaaaaaaaaaaaaaaagactatatgtgcacgattaaaaagcaaaaaattatttcaggttcctagataggaagacttagtactgcaaagacgtaaattctctccaaattaatctataagtttaacataattcttatcaaaatcccaacataattttcatttgtgaaatttaacaaaattattataaagttcatggaaaagattaaatatgtgagaatatacagaaattccaaacaagaactgtatcaaagacacagaaaatgtcaaaacataaaaaagaaaatccaggccgggtgtgatggctcacacctgtaatcccagcactttgagaggctgaggtgtgtggatcacttgaggtcaggagttcgagaccagcctggccagtatgatgaaactccatctctactacaaatacaaaaattagccaggaatgtggtacgcacctgtaatcccagctattcaggaggctgaagcagaagaatcgtttgaacctgagaggcggaggttgcagtgagccaagatcgcaccactgcattccagcctgggtgacagagtgagattttgtctcaaaaaaaaaagaaaaacaaattaaaaactacacacaaaggtcaggaggatcactcacacctgtaatcccagcactttgggaggccaagccaggaggactgctcgagcccaggagtttgagatcagcctggcaacatggcaaatcccatctctacaaaaaataaaaaaaatcagccaggcatggtggtgtccacctgtggtcccagctacactggaggctgaggcagggatcccttgagcccaagagatcaaggctacactgagccatgttcatgccactgcactccagcctgggtgacagagtgagaccctgtctcaaaaaataaatagatgaaatgaactatacacatgtaggaagtataaacacaggtaaaccttctttttcaaatacaggaaaagataccactttataatgatatcatgcatgctaaatctgaccttctgatattatgtgaagtaactaagtttcaaagcccatttcagtgacattctctgtgtgcgtgtgtgtgcgtgcgtgtgtgtgtgtgtgtgtgtgtgtgtggagatgggcatcttgctgttttccaggctggtgtcaaactctgagcacaagtgaccatcccatctcagcctcccaaagtaccaaagtactgagattacagggaatgagctaccatacccagcccaatgttaacggcaaaacgaaactcttcggccaggcgcagtggctcacgcctgtaatcccagcactttgggaggccgaggcaggcggatcacgaggttaggagatgaagaccatcctggctaacatggtgaaaccccatctttactaaaaatacaaaaaaattagccgggcgtcgtagcaggcgcctgtagtcccagctacgccggaggctgaggcaggagaatggcatgaactcaggaagtggagcttgcagtgagccaagatcatgccactgcactctaggctgggcaacagagcaagactgtcaaaaacaaaaaacaaaaaacaaaaaacaaaaaacaaaccaaaacaaaacaaaaaaaaagaaactcttctacttttttttttttttgagacacagtctcactctgtccaccaggctggagtgcagtggcgcaatctcagctcactgcaacttccgcctctgggttcaagggattctcctgcctcaacctcctgagtagctgggattacaggcatgagccaccacacctggctaatttttgtatttttagtagagacggggtttcgccatgttgaccaggctggtctcgaactcctgacctcaggtgatccgcccacctcggcctcccgaagtgctaggattacaggcgtaagccacctcgactggccttttctattgtttttgattaggttgttactctttacactaatggaaggaagaccggtcaaagactcaactcaaatcaagagaaaaaaattcagttacagctccatcaggtgttaaatttatatttagtgaacaagacctatacaattgttaaaatacaggcaattctgttatctattaatttagcctctgataaggaggactgggccataaatcgtggttacataccccaacatacatgatttatgtatcaagtatacaatgcccacattgcaaagattataaaatgatactagagtttattaaaatattgcccttatcaaagaacagtttggaaagtaacaaaatacaagctaataaaataaactaccactagaaccactcctctacgtacaacttacctaaagtcttcgtgtttgctagaagagcctcttcataagacagtatatagtagagcaccaaaagctgtgctgtgatactgaaacgctgattaaggcggatgttgtcaccctggaggtaatattacaaatactctgaaatactctgaatttcacgagtgcttttttttttcttgatagtaaaagaatcaaaatagactattcagcattgctgctcctaactcaggtaaaacaggagaaatgttgctgtgtgtgtattaaactcaaaaaaacaacatgaaatctgagatggcatgagagatgaaaggcaacatgcttaagtggtctttaagataagacaaagaaaagacttcagctactactcaatagcaaacccatcaggctgcttctgaaagacaggagtcccaagtattatatgaaattaccatgaaaaaagtaactcctaaataagacattgtatacttaaatatatttgtgaaaaatgcaactgtttttcccttctaacaaactggggaaaaaatactttcatcaaattttccctgaatgagccaggagcagtggctcatacctgtaatcccagcactttgggaggctgaggcaggcagatcacctgaggtcacgagttggagaccagctggccaacatagtaaaaccctgtctctactaaaaatataaaaattagccaggcgtggtggcaggtgcctgtaatccctgctactcgagaggctgaggcatgagaatcacttgaacccaggaggcagagtttgcagtaagctgagatcgtgtcactgcactccggtcggggcaacagagtgagactctgtctcaaaaaaaaaaaaaaaaatccccctaaatgaatgtaggtgtatcttagattcccaggatgctaaacaaacctatgctgaatatcttgatatcccacacagtacttgatcaaatacacaatctccagggaacccattagactttaaagtgaagcttaaaaaaaaaaaaattactggccaggcgcagtggctcacacctgtaatcccagcactttgggaggccaaggcaggaggatcacttgaggtcaggagtttgagaccagcctactcaggaggctgaagcaggagaatcgcttgaacccaggaagcggaggttgtagtgagccgagactgcccattgcactccagcctgggtgtcacagcaagactccagtctcaaaaaaaaaaaaaaaaaaaaaaaaaaaaggccaggcacagtgactcacacctgtaatcccagcactttgggaggctgaggcaggtagatcacctgaggtcaggagttcgagatcagcctggccaacatggtgaaaccctgtctctactaaaaatacaaaacattagccaggcgttgtggcaggcgcctgcaatcctagctactcgagagactgaggcaggagaatcacttgaacccggcagacagaggttgcagggaggaggaggttgcagtgagctgagatcgcgccactgcactccagcctaggcaacaagagtaaaactccatctcaaaaaaaaaagtgcctgtttagcaaactacttggaactaataccattcttttaatttttagaggtgatctaaggaaatttaatctaattttaaattcagaactacctagaagtcctctgataggaaaataaaaatatgggttaagtaagaagaactaaaagaaaaataagttaatagatataaaagaaccactattttaccccaatgactccttggaaaatattgagtatctcctgttctgtgactggctgatttgtggcttctggattagatttcgacgcaggagtaagtatagaatttatgtacacatcaatcaaaggaagtaattgaggatgaagtggagtagaggtttcacacagctgtctataaatccaatcctaagaaagaatgttatagacactgaattaattgtggcaaaaagaaaaaccaagcaaaattataaaagtacatacagttttacatgaattatgaatcagtaaaactcactattaacttttggcagttccaaatatattatctagtatcataactgcctttgattttaaaatatgaactaccattatatctgtatcatcttaggtgcaccctccactagaagcttgcctttcggtttaatctattagtttttaagtagtgggaaaaacattttaagtccctaccatatctgtatttagagcaccatgtgtgtcgtcatgggagagctcacgttagataggaatttggagagagagagataggtccttcacagcaaaccctcagatagactaagaaaatgtctctgaaaagcacttacaggagacttatcacttaactatcattggatggaggacatgtaaaatgttgggggtgcatgtgaactcttaattcttagctattttacttgctaaaaatataaagcagatgatgcaatctggctggaaaataatctcactaaatcacaaaaaacaagcaacaattaaaaagtgatatatcatgcatatattattcactgttctttgtaaatatctgaaaaagtttcagtctactttacctcctgggtcttaataccttctctttagagggccttttaacttgttagatatagccaactaagacaaatcaaaacatgtcaaaattctaagttaggtgtgaggtgtccttatgacaaatcaacaaatactagtcatggcagcttccccaatttgtaaaacaaaaccaggcccactgcagtggctcatgcctgtaatcccaacacttcgggaggccgaagtaggagaattgcttgagaccaggagttcaagaccagaccagcctgggcaaaatagcgagaccctgtctctacaaaaaaacactttttaaagccaggtatgaggccaggcacggtggttcatgcctgtaatcccagcactttgggaggccgaggtgggtggatcacgtgaggtcaggagtttgagaccagcctggccaacatggtgaaaccctgtctctactaaaaattaaaaaaaaaaaaaaattagccaggcatggtggcaggagcctgtaataccagctactcaggaggcggaagcaggggaatcacttgaacccaggaggcggaggttgcagtgagctgagatagcaccactgcactccagcttgggcaacaaagtgagactccatctcaaaaaaaaaaaaaaaaaaaaaaagccaggagtggtggctcgcacctgtagttccagctacttaggaggctgtggcaggaggactgcttgagcccaggagtttgaggttacagtgagctatgacagcctgggcgacagagtgagaccctgtctttaaaattaaaaaaaaaaattagaaaatggcagtttctaagttttaataaaatagccatgtgccactattgagaatttaaatggagtattatgcattttgaaaatcttacattgttttaaaaatctgaaattactgtataattatataattataattactatccctaattactatacttatataaatgactagtaacttagcttaataccacacatttcctacacaaaacccacaataaatgcctacaaactgaaatacaactggggagaaagcattaatttaggttgttctttgaaatataaatgtaggccaggcacagtggctcacgcctgtaatcccagcactttggtcggttgagacaggcatatcacttgaggtcaggagttcgacaccagccagccaacacggtgaaaccctgtctctactaaaaatacaaaaattagccgggcatggtggcacacacctgtagtcccagctacctgggaggttgaggcaggagaatcactttaacccaggaggcagaggttacagtgagccaagactgcaccactgcactccaacctgggtgactgagcaagactccatctcaaaagaaaaaaaatatatatataaaaatgtaggggcatgcttttattttgttttatttgtaggggcatacttttattgacactttgtgcttggtaaaggaacggctcctgagaagctggtaaatacaatgaataggcaaaaatccagtaatgttggcactcaggttgctggtgacagggacccgaactgcatgagctgtgacaacctaaaagggaaaaatagcattagtaatataatagaactaaatataaaattattttgaaagagagattagtaagtagactgtcaacacctaatacaagtgtggtccctagaaatgaatgatgaaaataaattattacatgttttaattgtctttgaatgctgaggaaatgtacatttagggatttatataattccctaattttttgtttataaacatagatacatacacagtggtgtgataaggtaaaaaaataaaataaaattttgaagcatacaatctgggctcaatgactttgaagaagtcatttatcttctgaatctttttcacatctacaaaacaggacactgccatacctgcctcaaagcattgttatggggggaaaatattctttttggaaaaacatcatatgaactataaagcaccacataaatataaacagaaatatttattctcaatatgtcatgcataggctctaatcgtcttttaaagaccctcttcaaagttgtcttccaattggttcaaatttaaagacaaaaaataacttatgattctcccacatgctgtgtgactacttgtaattcaggagtatatgtgcatatgcgtgttgagggtgggagggatagtaaaatatagaaataaagatattaatagccacaaaaaagcaacaactggccgggtgcagtggctcatgcctgtaaccccagcactctgggaggctgaggtgggtggatcacctgaggtcaggagttcaagaccagcctggtcaacgtggtaaaaccccatctctactaaaaatacaaaaattaggcgtggtggtgtgcacctctaatcctagctacttgggaggctgaggcaggagaattgctccaacccaggaggcagaggttgcagtaagctatgaccataccactgtatactagcctgggtgacaaagtgagataaaaaaaaaaaagaaatgaaaaaaatccttatgcttatccatggacaaaagtgctaaggctaaagaagaacatgttaagtataagaaatttagactctagcctgtaatctagttagaaatgaattttacagcctaaaggtttaaataggacttcattttatctttctccagacacattaaaacaattaccccttgagatgccctaccagcaacatctaagagtattctcctaagtatctactcaaagtctccaaaaatacataaattcaaaagatgccttggtatgttatgactagttttaaaagtgtattttaaatggattattctttaagaaagtttcaaagatgaaataaatcatcatgagtttaaaaagaaaaaagaccatattattttcttaaggtaagacacacaagttttctcccaaagaatattgtaaaagaaagttaaataagtacctaagaataaaaagaaatacctgctcagtaaaaatttcctgtgtgaagattgtcttcatcctgctcaaggagcttggcttaattacaatctaaaattaccaaaagaattccaacagcatgtaaaaatatatgaaacacaatttattctagggaacttatctaaaatggctatgatacacataaatgttcaaatgttcaagtactctactctgttttagaagtgctttcccaaacccaacattaaagtgttaatactcaaaaacagaaccaatataaaaagcacttaataaatactattattggcattttcagtcggttgggggaaacagattatttactacatggagctaggatagctgcccctctgtgaggccaagagaaatatgtgtgtgtgtgtatgtgtgtgtctgtgtctgtatatacgcacatatacacacacaaatatatgtatatatgtatatgtacagatagacacacatacactttttgcacatatcacaccatacaccaaaagaaactccaagtagattaaaatgttcaaatgtaaaacatgaaaccaccaaaaaaaactagaagaaaatataagtgaccacttatataaacccaagaaaggaaaacatttctaagcataagagcaaaatagaaaacacaaaaagaacatttacagccaggtgcagtggttcacgcctgtaatcccagcactttgggaggccgaggagggcagatcacaaggtcaggagatcgacaccatcctggctaacacagtgaaaccccatctctactaaaaatacaaaaattagccgggcgtggcggtatgtgcctgtagtcccagctgctggggaggctgaggcaggagaatggcatgaacctgggagacggagcttgcagtgagccgagatcgcaccactgcactctagcctgggcgacagagcaagactccatctcaaaaaaaaaaaacaaaaaaaaaacatttaatatactacataaaaataataatgataataatttccacatggcgaagttaaatggcaaaaaatactggaaaaagtcaattataacatattgaactctccacttttaaagatactataagatatgtcactgatttaatattacagtagcttttcaagaaaaaagtaggagttggaacactaccactttcatattacatgtcaactgtaaaatgaatcccaatttcaatactgggtaaaatatacgtcttgaaatatatgaagtaagatgtataaggcataatgacatatctttccttttgaatcagtgaaagaaaaaaataaatcaaagtccctacaggaaaattaggatactgatcagcttttcacaaaagaaataaacaagccaaaacacataaattttaaatactaagtttcactagtaatcaaagaaattcaaactaagtgataccactgttcatcaaccaaatttgcaaagattaaaaaaaaatagtaatgctcagtcatgttgaaagtttagaaaaacagtagttcttactaacggtaagagttaaactgatacaatctttcgaaaagataatctgacagtactcatgaaacaccttaacatagtcatacacttttccttagcaattaccttctagaaatttatcctaagaaaataatccaacaggtgtatgaagagatacatgtgggtgcctatgtgtgtatttacataaacaaggacattcctctaagcattatacagaaactagaaaatctacatgggaaataataagggacctattaagaagatcaaacaatggactataagacaatgcagtcattaaaaattatactgtattataatatttattgatatgagtaaatgctcatcatatattaatttttttaaatcatcaaatatgtacgtcactttaaagaaagaacagacatcagaatattaatagtagtatactaggtatctctgaatcatggaattataagatatctttcccttttctgtgctttccaaggtttttgcatgagtatctattattttagtaaatacaggtttcaaaatgcatttttctaagcgctcttgataaaacttctattaaacaattaaaattacttaaatgaaaacaatctatttacactacaacaaaatgtccagcttagaaacacctttttttttttagaaagaagttaaaagaaaattaccttcatccccaaagtggaacagaccaagtcaatgatagcactaagctggttgctgtgaaagtacatagccaccaataataacatctccccaaaagaagcagagacgcctgaagtactgtcaaaacaaaataggaaatatgaattttccaaagagagaagaagaaaagctttctcaactaactaaatcaaattatcttacctctcaaaatacgcttcttcttttatcatccaacttagccacaccaccatcagctgctcctgttcaggtgtactatataaaatataccagaatgtcactggtttaaattagatatactagcatatgaataaaaagcattctgaagttatttttggtagaaattatttttcctgccctattttcaagtatcaagtcaaattaaaggcttgctgaattgggccattaattgtcattgaggtatgaagtaattctagagctcaagaatgaggacctttgctttttttcatggatcccctctcaaagtcttagttactgccttcacaggttggaaagagtaagattcttcacattccttagaaaacaaaggccccttgggattaacttgttaaaacaactacacaacagctgatatttatttcatatagaaaaaaatctagtgttaacacttaagcatcaaaatatcacaaactgagtgccaaacagtaatgagcagtccatcttctggaaaaatgaaatttaatttatagaaaccttatgagtagatctcaaagttacagagaaataaatgatcactaatcatgggaaaaaaggcagtcacaggcttaccagatatgaaaaatggctataaaaatacgacttttctttgagacaatgtcttgctctgtcgcccaggctggagtgcagtggcgcaatcatagctcactatagcctcgaccacccaagctcaagtgatcctcccacctcagcctcccaagtagttgggactacaggcatgcgctactgcatccagctaatattttttatttttagtagaggggaggtctcactatgttgcccagtctggtcttgaactctcgagctcaagtgatacgcctgcctaagcctcccaaagtgctggaattacagaggtgagccaccatgcctagcctaacaatgactttttaaagggaattcctaaattctgagatggagtttcactctcgttgctcaggctggagtgcagcagcgcaatctcagctcactgcaacctccgcctcccgggttcaagcgattctcctacctcagcctcccgaatagctgggattacaggtgtctgccaccacacctggctaatttttctatttttagtagagatggggtttcaccctgttggccaggttggtcttgaactcctgatttcaggtgactgacccgcctcagcctcccaaagtgctgggaatacaggcctgagccaccacacccggtctaaattttaattgaaaagtacaagctgacgttgacttgtgaaaattttttcaccaatctctttccacttcagtgcagtaaaaatagatgcaacaaaaagcaaatgaaaagtataattcttctattaccaaaagctaagaaaataaaaaaggtcattctcaactatacctaaaccatataacaaataataaagtgttatgtagtagaaagattacagcctttacagcctaccacatctgagtgagaatcccatctctgctaattactggtagtgtgatcttgaagaagaaacacaaataatctttcttttcctttttcactgtagctctcaaatgttaagaactttttttttgtttttgagaagtttcgctcttgttgcccaggctggagtgcaatgacacaatcttggctcactgcaacctccacctcccggattcaagagattctcctgcctcagcctcccgagcagctgggattacaggtgcccaccaacacacccagctaattttttatatttttagtagagacggggtttcaccatgttggccaggctggtctcgaactcctgacctttaggtgatccacccaccttggcctcccaaagtgctgggattacaggcatgagccactgtgcctggcctatcttaaggacttttaagtatctttctaaacattagtttttctatctataagatatagacaaaaataccttataaggctgggcacagtggctcttgcctgtaatcccagcaatttgggaggacaagacaggaggatagcttgagcccagcagttcaagaccagcctgagcaacaaagtgagatcccatctctacaaaaaaatttaaaaattagacaggcatggtggcgcatgtttgtagtcccagctacacgggaggctaagatgggaggatctcttgagcccaagaggccaaggctgcagcgagccctgatcgtgccactggactccagcctgcgaaacaaagcaagatcctatctaaaaaaaaaaaaaaaataccttataagagtaatgaggatttgagataatgtttagaaagtacttcaagtaaaaagaaaagaaagaattcatgtacctaattttacaccatcctgaaactccattaaagctacattaaagggattttcttaaaaggcataaacgcataagatattgaggagggacaacaccacaaaatactggaagctagagaatatatagataaatggaaacggactcagcagacctgaggaagcaaaatgctaaactggtagaagagaaaacccatccattttataccacggaattcccaaagggctcaggctactccaggcagttccaggactgagagtgaagacagactaaaattaagaggttgacattctatataagtagtagacctccaaatcacctcctgcattctgcacaactagaagaatacccttccctcagcagagagaagactggagatttattgtctggaggtggtaaaatcatgcatctgaattaagggacaaccaggtatatctggagcaccattctgaaagtaggagaattaagtaaacgattatactgcaggctgatatctaccagcccttaaccctcactctttaactttgtttatgggtttctgtataggtcttccctctccaggccagacaataatctttagaactctgatcagcccaagagtttcccaaagacccacttatgcattagaggttctaatatgctttttcatttcctagtcttaaatatgaacaatcggccagacgtggtggctcacacctgtaatcccagcactttgggaggccaaggcaggcagatcacctgaggtcaggagttcgagaccagcctgaccaacatggagaaaccccatctccactaaaaatacaaaacttagctgagggtggtggcacatgcctataatcccagctactcgggaggctaacacaggacaatcacttgaacccgggaggcagaggttgcggtgagccgagatcacaccattgcaccatgggcaacaagagcaaaactctgtctcaaaaattatatttatatatgtatatgaacaattaatattggctgggtgtggtggctcacacctgtagttacagcactctgggaggcaaaggcaggaggatcaccttaggccaggagttcaaaatcagcctgggcaacaaaagtgagaccccatccctacaaaaaacttttaaaaataagccaggtgtggtggcccacactggccacttgggaggctgaggtggaaggatctgttgaccccagaagttcaaagctgcaatgagttatgactgtaccactgagtttgccccgagcaacagagagagcccccatctctaaataaataaataaatagaaatttaaaaataataataaatattaagtatctgagaaaagcttctaactttaaaaatagagacccaaaaaaggcagggaaaaaaagcagcttagagaaaagaagcaatacaaataataaaatctcttcaaaatcagtatgactaatatcaaagaaattatgctataatgaaccaatagacactacaaagaagaaacattcagagagccaaaaaagcactcttagaaattaaagactgaataggaattgaagataaagttaaagacaaatcctaaaaggcagaatgatttcttttttttttttttttttttttttttttttttttttttctgagatgcagtcccgctctgtagcccaggctggagtgcagtggcgcaatctcggctcactgcaagctctgcctcccaggttcacgccattctcctgcctcagcctacaggactgcaggcgcccgccaccatgaccggctaatatttttttgtattttttttagtagagacggggtttcaccgtgttagccaggatggtctcgatctcctgacctcaggtgatccacctgcctcagcctcccaaagtgctgggattacaggcgtgagccagtgtgcctggccattttgctccttcagaatgggtatgtgtgaagtaaattctttttgagactgggtatttctgaaaatatctttgtcctactttgacatctgattgatagtttgatggggtatggaattctaagttggaaataatttcctttcaggactttgaaggtgttgcttcattgtcttctaacttccagtgttgtcaggaagtctgacattctgattcctggtcctttgtgtggcctatttgtttttaatatagaaactcgtaggattagttttttatccctagggttttgaaatttctggatgatatgccttagcctgagtctctttttgactattgtcctaggcattcagtaagccctttgaacctggaaactcatgtctctcagttctaggaaattttcctgaataaatttgttggtaatgttttcttcttgggtgttctgtctaaaacctccttttatttggaattggactttttgaaatgattgtcgtattttcttatcctttcctcttttccttcccctcaatcttgttctactttttagaaaacagctttattgagatgtaatatacataccataagatttacccaaagtgtacaattgagtggtttttagtgtatatacagagttatgcaaccaccaacacaacagaattttagaacctgttcagcactctaaaaataacttgctcattctaagaccaggtacagtggctcacccctgtaaacccagtggtttgagagactgaggtgggaggactgtttcaggccatgagtttcagactagcctgggcaacacagcgaaacactgtctcttaaaaaaaaaaaattctccaggggtagtggaacgtgccttagtcccagctatttgggaggttcaaggagaaggatcacttcaacccaggagttcaagattacagtgagctatgattgtgccatagcactacagcctgggtgaaagagcttaaaaaaaaaaaaaaaaaaaaaacagaggctgggcacggtggctcacgcctgtaatcccagcactttgggaggccgaggcgggtggatcgcgaggtcaggagatcgagaccatcgtggctaacatggtgaaaccccgtctctactaaaaatacaaaaattagccgggcgtggtggcaggctcctgtagtcccagctactcgggaggctgaggcaggagaatggcgtgaacctgggaggtggagcttgcagtgagccaagatatcgcaccactgcactccagcctgggcgacaaagctagactccgtctcaaaaaaggaaaaaaaaaaaaaaaaaaagaaagaaaggataggttttctttttaatttttttttttttaaacaaagacaggagtcgcactatgttgccccagctggcctcgaactcatagcctcaagcaaccctcccgcctcagcctcctgagtagctgggactacaggtgtgagccaccacgcctgggtaatatgatgatatgagatataagaaacagaagatccaacaaaggagagatgaagcaagtctccaaaatgatggtgaaggtcaatcccaggatgagagctttatactaccaggtatacctggtaaccattccagaccaaaatgctcctgaagaaatctcctcaagaagatgaaactcacagactgtctaatgagtcaaaacatctggagagaagatttaggctggcagagagtttgaggttacatgaatggtacatataacaccaagaaagttaaaagcaaaaaacaaaaacacaggataaatattaatccaaaaaaaaaaaaacaagttttacaaggaagtaaaaaataatcatatactgcatggttgagttctcagtagtgcttacataatcataacaactatatattgatctaatctaaattataaccatactaggagaatgagaggataggaaggacatgtatggatgtgtttaggacagggagaaaaaagacagagaactaatttctcatctttcatactgggaactcaataaaaaatacctaaaagcaaaaatcaagaggtatcaaatacaaacatattattacagatgtagcagtaaaacacaaaataaacagctaaaagaattgaaagacactgcttctaagaaagataaaataggaaggagagaaggaaggactgctatttgccttaacaaatcctgaagaactatttcgacttatttaaacaatgtacatatataagataaataaaatgaatcagatgctactgatatccttattttaaaaaaatacaaataagctgggccagtggcatacacctgcagtcccagctacttgggaggctgagtcaggaggattatttgaggccaggagttcaaggctgcactgtgctatgatcatacccatgaacagccactgtactccagcctgggcaacaaagctagaccccttctcttaaaaattggaaaaaacaaaacaaaactacgactgtccatacctagaccagcttttgtagaaaactcttatctaatgctatacaattttattgagtaaataaaagtaaaccttgagaaaatggagcaacttatatagttaggtacctgacaagtgtagaaaaggccagtagcatacaaaaggaaagtgaaacaaagcgaaccccagctggcgtagcaggaggacggctcgtcatcaactgcagtaattgctcagcttcttcttcagttggtctaaaaaggaatacatcattaggctttacatttttagttgggatgaagaagaaaaagtgaatttttaaccttttagttacaaattttaaactttataatggtatcttgctatttataaaatctttaacatctcaagttgccaaatgcaaaactgttgagaaattacaactacagtgttttactgtggacacaaatacaggcaggtcctccctttgccctgtagtgtgagaccataaaaatgaccatgcaagctgaaatcatgcaacacaatcttaataatcaatggtgaaaagtatggttgtactgtagcctttaaaatttttgtcaaaacattaaaaactctgttgattataatgcataattttttttttttttttttgagacaaggtcttgctccatcgcccaggctggagtgtagtggcaggatcagagctcacttcagctttgaccttccaggctcaggtaatcctcccacgtcagtcctcatgtagctaggaccacaggtatgcgccaccatgcccagcttattttttttagtagagacagggttttgccacgttccccaggctggtctcagactcctgggctcaaaaaatccacctcccttggtctcctaaaatgctgggattacaggtgtaagtcactgtacccagccaggaatttttttttttaaatggtaaaactaatatttttatagtactctaattgaaaatattagaaacattgggaattaaactgttttctttgtttcttttttttgagacagagtctcaccctgtcgcccaggcgggagcgcagtggcacaatctcggctcactgcaaactctacctcctaagttcaagcaattctcctgcctcagactcctgagtagctgggactacaggcacacgccatcattcccagctaatttttgtatttttagtagagagagggtttcaccatcttgaataggttgtcctcgaactcctgacctcactgatccacaagccttggcctcccagagcgctcggattatgggcgtgagccactgtgcccggtcttaaagtttttttatttcttcgtaaagactttatcaagagtagtttaaacagcctttgcctccttttttttatgttttttgtttttgtagagatggagtttcactcttattgcccaggccggactgcaatggtgcaatcttagctcaccgcaacctccacctcctgggttccagtgattctcctgcctcagcctcccaagtagctgggattacaggcatgtgccaccacacccagctaattttgtatttttagtagagacagggtttctccatgttggtcaggctggtctcgaactcccaacctcaggtgatctgtccaccttggccccccaaagtgctgggattacaggcgtgagccaccgcgcctggcctatgctttcatctttattggccaactgtctcttccaattatctgtttttggaatataatgttccaaaaactgtttccatgttttggaacatgagttcattatggagagaaaggaagcaatacaggttgagtaaccccaatccaaaaaacctaaaatctgaaatgcccccaaactccaaaacattctgagtgccaatatgaggtaatgagctcaaaggaaatgctcattggagcattaaggattttgaatttctgttagggatgctaaatcggtaaatataaacattccaaaatccgaaaagttctaaaatcccaaacgcttctggtctcaagcatttcagataagggatattcaacctttacaactacctcctctgctatatgtacatgaatcaaataacaggtgtgcagtaaccagctaccgacagactttgaaagaagtgaggccattggtcactaaccatgatgtacatctgttatttacttagtgatctgtgtcctgaggagctcacaaactctatacaattaactggttaatgtatcatggcaactgaaatggcaactgtgttgagagaccagcattatttaaataaactggcgtaactgaaactcatgcatattggagacatgcaaatgaggactgtatgtacaattattaagaacactattcaaaaggattttgtatggtgactaagaaacattgtactggccaggcacagtggctcatgcctgtaatcccagcactttgggaggctgaggcaggcagaacacctgaggtaaggagttcaagacaagcctggccaacatggtgaaaccccgtctctactaaaaatacaaaaaaaaaaaaaaaaaaattagccgggtgtggtgaggcaggagaatcgcttgaatccgggaggcagaggttacagtgagccgagatcacaccactgcactccagcctgggcgacagacggagattccatctcaaaaaaaaaaaaaaaaaaaaacattgtacttattaatcacatcatattaattttaaacaattatgatatcagctgtaaaaggaaacaaaggagagatttacttcaactagtcaatggtaaaagatcactcacagatcattcactatagttttgtcaagctgtgttgaaatcacaggtttctttaaactgtgattggaaattgataaactgctctggctcctcccatatttatatagttctgtttacaatcagaacaaaatagatgaatacatctctgctagaaattcttggccttaggatttcattcttcttacaggccagcccactacctgagtccaacagaaaactttaatcctctgaataaaaggcctttggctcactttcttgagaatagaaacaagaaggtaaaatgacaaaaaggtaaaatatcaaactattgaatacttgagtccagcgatccccatcaaagcacagtacagacgtaagagtgcactggctttcacaacatgctcttctttcagccccgaatacacagacacattgggctccatatccacatcagcttcttccacaattcgggtgcttcttactgtgggaagaatgcccatcaactccagaagaagctgccttctcatctgccaaaggacagaactgctggtctctctttttctctgaaagaaatatggatcacaaaaggaagaaagcatgaagcatttactaaactaaaagggagctaaaacatagcaccccacttaaacactttcaaattggcctatttgaagagattgtcgtgactacagaatctcattttaaccaatcaagcaaactcaaaatccactagtttgtctgaagaatgaatattcaccataatttggattggttgcagaggaaagactaaattagtgacaatttgaattgtggaatattatttcaatggtactttcaaatacataaagactaacaaagtgatatgtggtataggagaaaatgctcagattttgaagacgtaagttcttggggtttaaatgccagctctactattagacgattatatacctttaggcacattggttagcctctctgaaccccaatttccttaatgacaaggaaatattttatcaacaatatttaccttatagaactcctataattaagagtttacaattcttggcctgatgcagtggttcacgcctgtaatcccagcactttgggaggccaaggcggacggatcacttgaggtcaggagttcgagaccagcctggccaacatggtgaaaccccatctctactaaaaatataaaaattagctgggtgtggtggtgcatgcctgtaatcccagctacttgggaggctgaagcacaagaatcgcttgaacccaggaggcggaggttacaatgagtcaagatggcgccactgcactccagcctgggcaacagagtgatactctcgtctcaaaaaaaacaaaagagtttacaattctataaccactacagttcttcaggcagggacaatgccttagtcttctctcactctgcacagtcgaacattgtgcctaacatacagcaagcactcaaagtctgttaagtagatgaatgaacagagataatacatgtatgaaagcagttctaaactatacagggctagacaaatgttaattattatcttttgagtgtctctaagtaaaatatgatagacctgctttaataataacagtaagttcaaagaataaaggtttattgaatacaaaagacaactacaaacaagatgagcatgccaagtgcttaaggcagtacctgacatatatgaagcatccaataaataaatgttaactttgttttaaaaagcagagcttaaaatcagttttcaaatgggctataaaatagaacttgaatattttaaaaaactatgattcagtagcttaaaaatagactacaggatctaagcagtatacatgttgtctagctaagtgacctcaacgagttaaatcgcaatctgcattagctccttcataggaactctattcacatagttaatataaattagtttttgaaaaattaaaacattttgcaagttaaaaactgttgcaaaatacatatgcataagcaggtgaacgtataaaataaaatgtggtatatacacacaatggaatattatttttctttttttttgagaccgagtcctgctctgtcaccaggctggagtgcagtggcgtgatctcggctcactgcaacctctgcctcccatgttcaagcgattctcctgcctcagcctcccgagtagctgggactacaggcacgcacatcacgctcagctaatttttgtatttttagtagagacagggtttcaccatgttggccaggatggtctccctctcttgaccttgtgatccgcccgcctcagcctcccaaagtgctgggattacaggcgtaagccaccccacccagcccttacttcttatttttatagatttagggggtacaagtgcagttttgttacatgaatctattgcatagaagtctgggctgttggtgtagtcatcaccctgatagtataccctgtacccaatataggtaacttctcaaccctcacccccttcccaccctcccaacatttggagtctatgatgtgtattatcccactcgcttatgtccatgtgtacacatgattagcacccactcataattgagaatatgcaatatttgactttgtttatgcgttatttcacttaatataatggcctccagttccatccatgttactgtcagacatgattttattcttttttatggttgagttgtattccatggtgtgtgtgtttgtgtgtgtgtatacatatatacgtgtgtgtgtacatgtgtgtatgtgtgtgtgtgtgtgtgtgtgtgtgtgtgtgtgtgtgcatatatcacattttctttaagcaaccatccgttgatagatgcttaggttgattccataacattgctactgtgaatagtgctgaaataaacatacaagtgtaggtacattttttatataatgatttctctacccagcagtaggattgctggacagaatggcagttctactctaagttcacaatggaatattattcagcctttaaaaaggaaatcctgacacatgttacaacatagatgaaccttgaaaacattatgctaagtgaaataagcaacatacaaaaggagaaatattgtataattccatttacttcaggtagccagaaagggtaaattcatacagacagaaagttgaatagaggttaccagaggatgggatgatagggggaatggggagttatttaatggatacagagtttctgtttgggatgatgaaaaagttctggaaatgggccaggcccagtggtggctcacgcctgtaatcccagtactctgggaggcccaggtgggtggatcacctgatgtcaagagttctagaccagcctgaccaacatggcgaaacccagcctctactcaaaataaaagtagccaagtgtggtggtgggcacctgtaatcccaactactcaggaggctgaggcaggagaatcctcgaacccaggaggtagagcttgcagtgagccgagattgcgccattgtactccagcctgggtgacagagtgagacgccgtctcaaaaaaaaaaaaaaaaaatagttctggaaacgaagagtgataatggttgcacactgtaaatatacttaatgccactgaattatatacttaaaaatgattaaatggcaaaattttatgttatgtatattttaccataataaaaacatatatacacatatgtattaaaatttaaaaatataataacttatttcagtgatctaatgcaccagttctcatgagtctggcccagaaccctggagatatatgctttcagggggtctggaaaggtgttaataatactcaagacattatctgtctttttctttctcattcactcacaagggtacggtgcagtttccaaaggcttctaccaagccagacattgaagatatttgaaaaaaatacaataaaataaaactatcattcttctcattaaattttgtttgggaaaacacagttagttttcatttaaaatatgttatgttcacatttaatagggttattgttgtttggttttggtttttttttaagagatgaggtctcgctatgttgcccaggctaaagtacagtcgctattcacaggcacaattatcacacactataccctagaaccccctggcttaagcaatcttcctgcttcagcctcctaagtagctaggactataggcacataccaacacaccagctgttcctatttttaaaagaactaaataaatatttcaaatatttaagtgttaatttctaatatggtaaatatcaacagaaaaaaagccacataaacaaaagctctttggtatccttagtgattttttaaaatataaggaggtccctgaaactagaaagtgtgagaaccacttgtctaatgacatcattcaaaaaatgtttctttctcttttagcagctgctaaagtattctgatccttagcctatacagatatttaaccctcacctgctgtccatttcggataaaagttccaaaccaagtccggactttcgcatttgttccaagaagcaaaccacttacaaaacaaaccaagtcactcactccatcctcacaagcttcatttttagtatgatccaatgtcaaagccacaccaaggcctggcaagtgacattcttccacctagcacagaaaagaaaacaaactgaattcagtatcataagcaaaaaggccagtgatgcttccaaatctaaagtatctaaagtttagaggaagaactcctacaaaacataaaaacccagagaggaaggtaacatatccagtatataaataaaattccccacctctacaggactctaaaaccatcttgagaagagttcttggacctaatataaaggcctttgtctaataaaacacaggatcacttaccaccatgcctcggaccttgagggcctgagaaggattcattttacacaagaagcgtaaggcatctgtcctgcgccttcctccaagactttcttcatcttgtcgttctccattttttatcaggcccctacaaactaacatgatagaaaccatcttcttcagccttcagaattaattgttcatgaagatttcacatgacagaagaaaaggatcagggtatttgaaagcacaacaacagaaattggccaaaatgaagcaaaaaatgaaaagagacttaaaaaagaatagtaaactctgggacaatattacacattcaaacacacttgcaattacggtcccagagagacaaagaaagtacgagacaaaaatacatttgagggccacggacagtggctcacacctgtaatcccagaactctgggaggccaaggtgggggcggggggggggggggtgcggggcatggatcacctgaggtcaggagttcgagactagcctggccaacatggtgaaaccccatctctactaaaaatacaaaaattagctgggcgtggtggcaggcacctgtaatccgagctactcaggacgctgaggcaggagaatcgcttgaactgggaggtggaggttgcagtgagccaagatcgcatcattacactccagcctggggcgacaaaagcgaaactccttctcaaataaattaattaattaattaatttgaagaaattttcccaagttgaatgaaaactctaaacccagttcaatgagccctaagtggaacaaatgcaaagaaaatcataccaagaaacatcatacgtcaactttctgaaaccagtaataaaaagaaaatcttaaaagtaaccagggccgggtgcagtggctcacacctgcaatcccagcactttgggaggccgaggtgagtggatcactaggttaagagctcgagaccagcctggccaatatggtgaaaccctgtctctactaaaaatacaaaaattagctgggtgtggtaatgcgcacctatagtcccagctgctcaggaggctgaggcagcagaatcacttgaacccgggaggtggaagttgcagtgagccgagatcacaccactgcacttcagcctgggtgacacagcaagactccatctccaaaaaagagaaaaagtaactagagcagaggataggcgcatcacctgaggccaggagttcaagatcagcctagccaacatagtgaaaccccatctctattaaaaatacaaaaattagccaggcatgggggcacatgactatagtcccagctacccgggaggctgaggcaggagaactgctttaaccccaggggaggcggaggttgccgtgagccgagctcatgccactgcactccagcctgggtgacagagcaagactccgtctcccaaaaaaaaaacaaaaaaaaaggagccagaagaaattaaagaaaaaaaaaaaaagtagccagagggaaaaagaaactttacagaggaacaaagataaaatttactgcagaaaagagaatgacatctttgttctttgttttcttttttcctagagatgggatcttgctttcttgctttgccaccatactagtctcaaactcctggcttcaaacaatcctcccgttttggcctcccaaagtgctgggattacaggtgtgagccacatacccagccagaatgacatctttaaatagctaaaagatgacgtcaacctaaaattttataccctttgaaaatatatttttccagaccaaaaaagccagtaaaatttgttgccaacaaacccaccctacaaaaaataaggaaaattcttcaagttaaggggaaattatgccagatggaaatatggaactacagaaaggaattaagagcaccaaaaatggtaaatgtgtggataaatagtattttcctctatatttttagtctttaaaatataattaactgtttaaaacaaaagtaataacaatttgctctaaggtttataattcatgtaaaagtaaaatccatgacaacaatggcacaaagtacaagaggaaaaagaaaataaatagaaaacaaataacaagaagattcaaacctaaccactataataatcacatttaaatggtctatgtatacagtctaaacactccaattaaaagacagagactgccactagattaaaaaaaatgaagaccgaactatacctgtccacaagaaatcgaccttaagatatggacagattaaagagatgaagaaatatatacaccatggaaaaactaattataagaaagatgacatggctgtattattcagacaaagtagacttgaaaagaaggaatattatcagcaataaagaagtctattttgtcacgcctgtaaatcccagcactttgggagattgaggcaagcggaccactttagcccaggagtctgagacagcacgggtaacatggtgaaaccccatatccacaaaaatacaaaaaattagctgggcgcgccaggtgcagtggctcacgcctataatcccagcactttgggaggccacagagggcgcatcacgaggtcaggagatccagaccatcctggctaacacggtgaaaccgtgttactactaaaaatacaaaaaaattagccgggcgtggtggtggcgggcgcctgtagtcccagctactcgggaggctgaggcgggagaatggcgtgaacacaggaggcggagcttgcagtgagccgagattgcgccactgcattccagcctgggcgacagagtgagactccgtctcaaaaaaaaaaaaaaaaaaaaaattatctgggcccagtggtatcggctggtagcctcactcactcaagaggctgaggcagaaggatcactcgagcctgggagatcaatgctgcagtgaatcatgaccacaccactgcactccagcatgcgtgacagagcgagacactatctcaaaaaaaaaaaaaaagcgtattttggaggttaaaaatctctacaaagaggccaaggacagtggctcatgtctgtaatcccagcactttggaaggccgaggaggacagatcacttgaggtcaggagttcaagaccagcctggccaacatggtgaaactccgtctctactaaaaatacaaaaattagccgggcgcggtggctcacgcctataatcccagcactttgggaggccaaggcaggcgattcacaaggtcaggagatcaagaccatcctggttaacacagtgaaaccccgtctctactaaaaacacaaaaaattagccgggcatggtggcaggcgcctgtagtcccagctactcgggaggctgagacaggagaatcgcttgaactggggaggcagaggttgcagtgagccgagatcactccactgcactccagcctgggtgacagagcaagactccgtctcaaaaaaataaataaataaataaataaataaataaataaataagccaggtgtggtggcccatgcctgtaatcccatgaacttgggaggctgatgcaggagaatcgcttaaacccaggaggtagaggttgcagtgcgccgagattgcgccactgcactccagcctgtgaaacagagtgaaactctgtttcaaaaaaaaaaagtccgggcgcggtggctcacgcctgcaatcccagcactttgggaggccgagaagggtggataactaggtcaggagatcaagaccatcctggctaacacggtgaaaccctgtctctaattaaaaaaaaaaaaaaaaatacaaaaaattagccgggcgtggtggcgggtgcctgtagtcccagctactcgggaggctgaggcaggagaatggctgaacccaggaggcagagcttgcagtgagccgagattgtgccactgggcgacagagcaagactctgtctaaaaaaaaaaaaaaaaaaaaaaaatcatataagacacaaacaaatggaaaaacattccaagctcatggattggaagaatcattatctttaaaatggccatattgcccaaagcaatctacagattcaacactcttcatatcaaactaccaacatgattttccacaaaattagaaactttaggatactaaagttcacacagcaaaaaagagcctgaatagccaaagcaatcctaacaaaaagaacaaagccagaagcatcacattatctaacttcaaactatactacatggctacagtaaccaaaataacatggcactggtataaaaacagacacacaggccaggcacggtggctcacacctgtaatcccagcactttggtaggctgaggcgggcagaccacgaggtcaggagatcgagaccatcctggctaacacagtgaaaccccatctctactaaaaatacaaaaaattagccaggcatggtagtgggtgcctgtagtcccagctactcaggaggctgaggcaggagaatggcgtgaacccagcaggcagagctgcagtgagccaaggtcgcacccctggactccagtctgggtaacagagtaacaaaaaattaataaataaaaataaacagacacacggaccaatgcaacagaatagaaaacccagaaataaagccacacacctacaatcatctgatcttcaacaaagttgacaaaaataaatgacagggaaaggactccctatttaacaaatggtgttgggatagctggctagccatatgcagaagaatgaaactagaccctatcttttatcatatacaaaaattaactcaagttagattaaagatttagatgtaaaacctcaaactataaaaatcctagaagaaacactaggaaatactattctggacactggccttggcaaagaatttatagccaagtcctcaaaagcaattgcaatgaaaacaaaaattgacaagtgtgacctatttaaattaaagatattctgcacacaaaagaaactatcaacagagcaaacaatctacagaatgggagaaaatattgacaaaaatgtatctgacaaaggcctaatgtgcagaatctataaggacataaacaattcaacaagcaaaaaaccaccccattaaaagtgaggaaagaacacgaacagatacttctcaaaagaagacatataagcaaccaaaaaacatgaaaaaaaatgctccatatcactaatcatcagagaaacacaaatcaaaacaatcatgaaatgccatctcacaccagtgagaatggctattaaaaagtcaaaaaataataggtgctagcgaggctgtggagaaaagagaacacttacacattgttggtgggaatgtaaattagttcagccactgtggaaagcagtttggagatttctcaaagaacttaaaacagaactaccattcgacccagcagtctcactgctggatatatactcaaaggacaacaaattgttctaccaaagacacatgcgcttgtatgttcatcccaatactattcacaatagcaaagacatggaatcaaccttggtgcccatcaacagtggattaaataaaatgtacatatataccatgaaatactatgcagccattaaaaagaatgaaatcatgtcctttgccgcaacaaggataaagctggaagccatcccatcctaggcaaattaacacagaaacagaaaaccaaataccacatgttctcactataagtgggagttaaacattgggtacacatggacataaagatgggaacaatggacactgggactaccagtggggaggaagaaaggggacaagggctgagaaactacctattgggtactatgctcataacctgggtgacgggatcattcaaactccaaacctcagtgtcatacaatatacccatgtaacaaacctgcacatgtacccccctgaatctaaaataaaacttcgaatttttttaaaaagaaaaattaaaacaaaggtgacaacaaattgaataatatgtaaataatgtttagaaagggggatataactataaatgtgaaaactaagaataaagaaatcaaatttgacttggggaaaaaagtatattttataatgaaaaaaaggctcaattcatcataaagatataatcatcctaaatgcatataaacccaacaaaagagctttgaaatacatgaagcaaaaactgacagaacaaaaagaagaaataggcaaatccacaattatgtctggagacatcaaaactcctctctcagtaattgacagaacaagttgacaaaaaatcggcaaggacacagtttacaaagagtttttacatatcatctgatattcaataaatctcttaaaaaagtcagggaactattacactatcaatatctccattttacagatgagaagtattttggtttgtttgtttgtttaagacagagtctcactctgttgcccaggctggagtgcagtggcacatatcggctcgctgcaacctccacctcacagattgaagcaattctcctgtctcagcctcctgagtagctgagattacaggcatccaccaccaagcccagctaatttttgtatttttagtagagacggggtttcactatgttggccaggctggtctcaaactcctggcctgaaatgatgcacccacctcggcctccccaagtgctgggattacaggcatgagccaccgtgcccagccagatgagaagtattttgatagagctcacacaataagtgaatgacaaaatcaggaattataactccagtactttttcctcccaggctcctaattcacaaactaccttgctcaacaaaatgtttttatttttatatcactcatacccaaacaacaaccttcaatcactgtaagttttaaatagaggtgaaaaaatgtagtcgatttttctcaatttctactttatacttctctgtaaactgacagcagtagggctaaaaaacaaaggtctgattcctagcatttctcattatacatatcccgtattgctctcttgatatttcactgatacatgtatcttctttgatccctgattatagatattacatcttctagttccttggggtttttttttttttttttttgagacggagtctcgccctgtcgcccaggccggagtgcagtggtgcgatctcgactcactgcaacctccacctcccaggttcaagcgattcttctgcctcagcctccccagtagctgggactacaggcacccaccaccacatccagctaatttttgtatttttagtagagatggggtttcaccatagtggccaggctggtctcaaacttctgaccttgtgatctgcccgcctcggcctcccaaagtgctgggattacaggtgtgagccactgcgcccagcctgatctttaaactcaatacaatttgtgaactcaatatttctttatacatactaacaaactttcaaaagataaaatctcaaataaaatcccattaatgtttcttcttaggtcaaaaagataggtcctgtacatgtccaagcaagtcttttcaatataccatattagaatcatatttaccttcattaaaactatcaggaacattggccaccaagagacacaagaaccaggcaccatttctaacatgtagcaaagcttcagctacatcaactatagggagcaaggaagggagctctacaagaaaacaaagtcagtgttagtctttgttaacaggtgcactccaccacacccagctaattttttttattttctgtggagactgaatctcactgtgttgcccaggtgggtctcaaactttggcctcaagtgatcctccagcctcagcctcccaaagtgctaagattacaggcataagccaccatgcctggacccagtgttaaagagtgatatttctttttttcttctttaagacagggtcttgctttgttgcccaggctacagtgcagtggtgtgattatagctcactgcagcctcaacctcctgggctcaagcaatcctcctgcctcagcctcctaaactcctagaattacaggcatgagccaccatgcccaaccaaaaatgacatttcattgtattattaaatatcttttgacatttcacaaatgtcatctaaaataaagtactttcttttcatagtctagaaccaagctgtccagtaggatacccactagcaacataaggatacttatattaaaaacagttcagttcctcaatcacactagccacatttcaagtaatccacagccacaaagaacactggacagcatagcatagaacagtacaggaaattttattttatagaactggtctaaagagttattttcacgaaaatcttatttgcttttttttttttttttttgcgacgaagtctcgcttttgtcccccaggctggaatgcaatggcgcaatctcagctcaccgcaacctccgcctccagagttcaagcgattctcctgcctcagccgcccgaatacctgggattacagaagcctgccaccacaccaggctaatttttgtatttttagtagagacagggtttcaccatgttgacctggctggtctccaactcctgacctcaggtgatccacccacctcggcctcccaaaatgctgggattacaggcgtgagccaccgtgcctggcctatactttttttttttttttttttttttaagaaaaggtctgcagccaggcacagtggcttatgcctataatcccagcattttgggaagctgaggcaggcagatcacaaggttaagaattcgagaccagcctggccaacatggtgaaacctcgtcgccactaaaaatacaaaattagctgggcatggtgccgcatgcctgtaatcccagctactcaggaggctaaggaaggagaatcacttgaaccccggaggcggaggttgcagtgagccgagatcacaccactgcactccagcctgggtgacagagtgagactccatctcaaaaaaaaaagacaaggtctcactctggacagagtgcaatggcacaatcatggctcactacagcctcaatctcccaggctcaagccatcctcctgcctcagcttcccatgcagctgggactacaggtatacaccaccacactaggctaatttttttcattttggtagagacaaggtctcactatgttgcccagactggtcttgaactcttgagctcaagtgatcctcctgcctcggcctcccaaagtgctgggattacaggcatgagcgacagccttctttacatttttctgtcctcttttatttctatcattcacacctattatatacaatctggaaaatacaaaaaggtacgaagaagaaaattaaaatctgccctaatcccagaattcaaagttaataaaaaatgttttcacaggcctgtagtcccagctactcagaaggctgaagtgggaggatcccttgagtccaggaattcaagccagtgggctatgatcctgccactgtactccagcctgagcaacagagcaagactctgtctctaaaaaaaaataagtattttattttaattcatcaagggtattgttcttgaacttttaacaaaactgggattatagtctacttaacactttgccctttgcttttttcacttaacatattgtaaacattttccaaaatcattaacgagcattaaagtcattaaatcaaagataccatgttaatgtctgcataatatgtcacactatgaaaataatataatttacttaatcattgtccaactattagtcacttttgacttaaaatcacataacatgtttgttatatgatccctaaaataacacagcataccaggctaagaagttacacagtatcatttaacaagaaactatatatgaaatccatcttagcactcagtacagtacctgcttgtaaaatacaaagtacatctgcagcttcctccaaatatactggactctcaaaaagttcagaagacttgaaaaaaaattctccgttggactcagacaccttaaaaaagaaaaaaaaaagatataaactctattaatttcagataattaaatccctatttttataattatttcttgagctcacagattatgtctcttaatgtatcactaatataccacagcagaatatgcagtattcaatcaatttcaaccaatttaaccacacacagcagtcatgttaattattattcagatatagcagtatcaatctcaagaactgatttctatctaaatatttggagacaactggaattaaaggataaggcaagccaaagaaatgaactacaaatgcagcctacataaactgctttaaaaaagccaagaacagtcaacctaaagcagtttaacaaatataaattcatggccaggtgcagtggctgacgcctgtaatcccagcactttggaaggccaagatgggtggatcaactgaggtcaggagttcgagaccagcctggccaacatggtgaaaccctgtctctactaaaaatataaaaattagccaagcatggtggccatctgtaatcttagctactcaggaggctgaggcaggagaatcgcttgaacccgggaggtggaggctgcagtgagccgagatagcaccactgcactccacactgggagacagaatgagactccgtctcaaaaaaaaaaaaaaaaagaaaaagaaaaaagaaaacaaacaaacatatatatatatatatatatatatatatatatatacgtgttcaattctgaataaactgttggaaaaacaaagaattaaagtttagataacaaaatctactaagctttttggaaattctgcacaatagtttcataaccatatttcctatataatgaagagtgccaaactaaaaaattggaaatctcccagaggagaaaggtcacttatttattagagtcaccaagtgaggtattacggaaaagatgaaggaaaactcttggctgaaatttaaaagtatcaaaataggctgggcatggtggctcatgcctgtaatctcagaactttgggaggccgaggtgggaggatcacctgaggtcaggagttcgagaccagcctggctaacatggtgaaaccccgtctctactaaaaatacaaaaattagcaggcatggtggcgggtgcctgtaattctagctactcaggaggctgaggcaggagaatcgctttaacccaggaggcaaaggttgcagtgagcaagatcacaccattgcactccaacctgggcaacaagagcgaaactctgtctcaaaaaaacaaacaaaaataaataaaagtatcaaaatagtaaaaaagagaaggaaattataattggtgatggaaattttagaaaaattttttaacataccttaaaaactgtctaaaactcggccgggcgcagtggctcgtgcctgtaatcccagcactttgggaggccaaggagggcggatcacgagatcaggagatcgagaccatcctggctaacacggtgaaaccccgtctctactaaaaatacaaaagattagccaggcatggtggcgggcacctgtagtcccagctactcgggaggctgagacaggagaatggtgtgaacccgggaggcggagcttgcagtgagccgagattgtgccactgcactccagcctgggcgacagagtgagactctgtctccaaaaaaaaaaaaaaaaaaaaaaaaactatctaaaactcaccaaaatcctctctaccagtattttctatgaaaacagaatttagtcctttctctttttgtccacaatttataaaactaaactttatttactataaattaactgactccccaaaattataacagtaaataaacataaagatctaatttagtgggtttttgtggtggtggtggttgttgtttttgaggcagttttactcttgttgcctaggctggagtgcaatggcacaatctcggctcaccacaacctccacctcccaggttcaagcaattcttttacaggcatgcaccaccactcctggctaattttgtattttttagtagaaacggggtttctccatgttggtcaggctggtcttgaactcccaacctcaggtgatccgcccacctcggcctcccaaagtgctgggattacaggcgtgcaccaccacgcccagctaatttagttatttatatgatagaactttgacattcaaaaattttaaattcagagtttcaattaactatattacccaaaggtctatgacctaagtaatctataattttacaaagaagataacttgaatagctttcattagtgtaaagaagcactttggtcatttagtgattgagactagccaatcatcctacattcaattcagcattgatactcccctctgctgtcatatatgaggctgttactgctcatccagtgtctaaatgaatcacatacatttttcagttattcacattcagttattgaaaatgttacttcattacactttatgggagaaattgtatcccataaaggtattatctgctaataaatttgataatctgtacaagccttgagataaatccctttctaaatgtcaagaagccactgtgtatggattccatacggaaaaaaatccctctcatagaaaatgcagaacaagtataaatgagagaaaatgataattaagagaaggactttaaggcagacttataatatcctttcaggctttgaaaggaaaacaaatatatagaaataaaagtagagaaggccgggcacggtgacccatgcctgtaatcccaacactttgggaggctgaggcgggtggatcacctgagttcaggagttcgagaccagcctggccagcctggtcaacatggtgaaaccccatttctactaaaaatacaaaaaattagctgggcgtggtggcgggcacctgtaatcccagctactcatgaagctgaggcaggagaaccgtttgaatctgggagacagagattacagtgagctgagatcacaccactgcattccagcttgggcaataagaatgaaactccgtctccaaaaaaaaagaacaaaataagagtagaggagaattcaacctgcctgacttcttgtctctttttctgtctacctccctatacatagacatcaaatcatgcatactttgagctgtggttaaaagaaatgcaccttgttcataattgccaacagttcactaagcacaagacgcaatcgacgaggtgaatcactgtgttcaaactctaacgtcagtccatgctgaagctgtgataccaggatgctctctccactgcctcctccaagtttatgcctaatgaagtacaaaacatgtaacaattatgaaaacactgatatggaaataattgcataaaaattatcttttattgaaataagctataaaaggatgtataaagtgttctaaaatgttctgttacttctgaaatgctatttagtttgcctgtgtatttcagggattcacatcctacgtataataaatactccaccacataggccaggcacagtggctcacgccggtaatcccagtactttgggaggctgaggcaggtggatcacaaggttgggagttcgagaccagcctggccaatatggtgaaacctcgtctctactaataatacaaaaaagccgggcatggtggcgcgtgcctgtagtcccatctactcgggagactgaggcagaagaatcacttgaacccaggaggtggaggttgcagtgagccgagatcacgccaccgcactccagcctgggcaacagggcaagactcggtctaaaaaaaaataaaaataaaaataaataaataaatactctaccacaactgacaattaacactcacttccactgatggtggcttgctactagattcacaatgggcagggaaggacatagcacctgcccagaatctttgggaatatctaagctttaaaagcctcccaagaggctgggcccagtggctcacacttgtaatcccagcactttgggaggccaaggcaggtggatcacctgaggccaggagttggagaccagcctggccaacatgatgaaaccccatctctactaaaaatacaaaaaattagccgggcatggtggcaggtgcctgtaatcccagctactcgggaggctgaggcaggaggatcgcttgaacctgggaggctgaggttgcagtgagccaagatcacgccattgcactccagcctgggcaacaagagcgaaactctgtctcaaaaaagaaaaaaaaaagcctcccaagtgattccaataaatccctctaatctaggggaagttaccctacctacttcccactgaaagtaattggcctaatgagtttagcccacatacaacagcacattgccatatttctctagataacattttataacatggaagtcaaaagattctggaactgtaactatatacagaaaagacctaagtaaaatgctctccagaatttagattctcattctctcttttctggagagctctaaaaaatatctgattccctgttctttgtcaaatccaaatccacatataatataacataacattacctaagctgctgttctttgctggcatcttgttctaaagcatgaaagtccacggacaacaatgcaacaatggagttgacagcttccactccagaaagaaggcgaaggatgagtttcttatcctgagcccagctttggctctggtcagcaggtgcacaaagtgccatccgtaccaaacagggcagaagaagtcttaattctggatcacttaaagatgccaggcaaacaacatccaccttctgcattgcctcaaaagcaaaagggctgacaaactgaagacttgtacattcagtcattattactgtttgttgatcctaatggtaaaaatacaaatgaaagtaggagtttaactttcacatgtatgaacacccaactttctaaaaaccctgaaaaatgtggtgtatctttaataggtccctatgttggcaatgttcctggcacaatcaagacaaggcttctctgtctccctaggtttatactgtcacctgggaaatgggaaagaaaacagagtatattaatgtctcttccagcctcaggaatcttctgctctaatactcatattttacaaagaaggaatatgaagcccagagagatgaagtaacacgcccaaaatagtattactagttagaggcacaatccaaggctgaatcctcatctactaaaatcccagtccaagactttctccactatatcagtcacatgagctccacaaaatgtaaacaaaagtgaatggtcatagttaagtgctttctttcataccccgatagtttcacatgcctaccccgatatacatcaagaactattgggcttctctttctcaccctccatgagtcggtggaaaaactagcaaatcactgggcagaaccaatgccagattcaaggctctggaggccacaacactatcctatgtcccctgtgttaccgggtaaaaagcagatgtgtgggtgctatgtgagaaagacgcgtctcattagcgcacttctctgtctccaggaatcatccaaggcacaaaaagtaaacaaaaaggcagtgagctggcagccaaagcagtcccctctcaaggccgaccgactagcagcagcgtgggtaaaagtcgtgggtaaaaactgctttgctttcagggaggggctgctcttttaacagaggggcgggctgactggagcagaggagccaagacctgcgtgctcctccgtctcgccccgggcgcaactagaaccaataagtccctcaggctgagcaaagtctggccaggctccgacacggacctaggaacgcgctgaggccagagaagcggacgcttcataccttaagatctaccctccagcctcacggaaccgcacacggactccgcgtcctagaggcgggacgcggcagaaatcgagagcgcggtccgatgttgggcctaggcgatatccggaaccccaaaccctagttgtgcctcgagtcgactcggacaccaagaactcagacgccgggaccaaccgggttgtcgatacaaagtgggaaggatgggggcaccacacaaaggcagaaccgggactgtaggaacggaaaagcgggagactttttcaacctgcacccagcaccttcattcatccccagcgtctgactcccgtcggccaccgtactggtctgagaggaagggtggctgcgagaggaaaggcagag

SEQ ID NO: 1235 - DNA, 62651 bp, Homo sapiens; identical to SEQ ID NO: 1234

SEQ ID NO: 1236 - DNA, 9965 bp, Homo sapiens
cagtcaccgatgctggaagggtttctttggccctgagtgaagagagacccagagggaacactgaggtgcctgcccaaccactctgtcccggtttccttcagcaggaccaggtgagagaaggtgagggggctcctctcccaccctacaacacgcacacctctgcacacacgcccaggcggagagcagggatttgggacgtggacctgtgtgccctcgtgggtccctggtgccctctgggaggcacccccaactcaggacctccaggagaggagggtccctccctcggcagccaggacccccctccccagccagccgccctccttagctccctccccacttccttccaggtggatctgtttctagagctccaaccaccagctccctccccttctccaccccgggccaccaggtccttccttgtctccttcccctcagcagtttctatgaaccaccctggcagtaatggtgcagatggctcgcgcacagctggtggtgacccgactttcctgcctccaccctggggctcctcagaggcttcatggaacccaaactgctggtctcacctccgagccctgccgtcgcccagggagggcggctccgtccctcctgcactccctaatcccgctctgaatcaccgcttctgttctgggtcggagaataaaggtggggtttccaagtgatggccctacgttattgtctgaagctcccttctcctccccagggtggaagtgataatgccgggaatccgggaatcccggggaggtgcaggaagacagcgagctcgaggcagtggggtgcgactgagccggatgtgctgagctgcccggggcacggggcggttggggtagagaaaggctttcagagctgggggacaggacggggccccgggtgagcggagagctgggttatttcacgggaacagctggtgacaaagccggaggggtgtgcggggccggcgagagactgggattgtgtcttaagaggcatagggagccctgaaggggctgcgagctgggaaggggcagggccggcgctgggtgtaggggacagaggggagaggaggaagccgggccgcaatagaaagacgtggacggggctggacgtggtggctgacgcctgtaatcccagcactttgggaggccgagacaggcggatcacttgaggtcaggagttcgagaccagtctggccaacatggagaaaccccgtctctactaaaaatacaaaattagccaggcgtggtggtgcatgcctgtaatcccagctactcgggaggctgaggcaggagaatcgtttgaacccgggaggcggaggttgtggtgagccgagattgtgccattgcactccagcctggggaacaagagcaaaactccgtctcaaaaaaaaaaaaaaaaaaaaaaatctcagtaagatagaccaggtgtggtgtctcatgcctgtaatcccagcactttgggaggctgaggaaggagaacagaggacctcctgaggccaggagtttgagatcagtgtgggccacatagcaagaccccctccccaccatccctacaaaaaaagcaattcaaaaaaaataatgccttcaggcagaatgggagtggtgcttggttcaagcctgacataagtgtgagtttggggcacaaattctgctctgaataccagggacagcccatgtaatacagcatttccctttgtgcccacgcagccctaagggaggtgtggtttgttgttgttgttgtatctttttgagatggatttttgctcttgttgcccaggctggcatgcaatggtacaatctcggctcactgcaacctccgcctcccaggttcaagcgattctccttcctcagcctcccaagtagctgagattacagtcatgagccaccatgcctggctaattttttgtatttagtagaaatggggtttcaccatattagtcaggctggtctcgaactcctgacctcaggtgatccacccgcctcagcctaccaaagtgctgggattacaggcatgagccactgcactggctcttttttttttttttttttttttttgagacggagtctcactgtgttgtgcaggctggagtgcaatggtgtgatctcagctcactgaaacctctggggaggtgttgtttttatccctccccacaaccccctgttgatggacagacaaggacaatgaaacacagagaggtaaaagccctgggttaaagtcacacagcacataaaaggttcctgatcatgccgtgcagggcatctcgccaaacctcaaaaattcacaatctcatagcgcagcttgctctgtgaggcctccccacctcttccttctctccttccaggctccagtcaaggtcagtgcccagcttcctgctctgggccactcagcagccaccttcctccttcctgggtaaggaggtagggagctaccaaggaggcagggacatccgtgtagaacattctgcttttcttttttctttttttttaagatagagcctgactctgtcgcccaggctggagtgcagctgtagtgtaatggcacaatcgcagctcaccacaacctccatctcccaggttcaagtggttctcctgcctcagcctcctgagtagctgtgattacaggcatgtgccaccacgcctggctaatttttgtatttttagtagcgacggggtttctccatgttggtcaggctgctttcaaactcctgacctcaggtgatccgcccccgcttggcctcccaaagtgctggaattacaggcgtgagccactgcgcctggcctaattttctctaaaatagagacaagttctcactatgtggtccaggctgatctcgaactcctgaactcaagcaatcctcccagctcagcctcccaaagtgctagcattacatgtgtgagccatcatgcctggtccctgtctgtttcattctccctgtctctctagtcctgcctctctctgtgtcttctggtctttttctctatttgtctcttcctctgtcccttttatcatctctgtcccttccctccctccctccctcccttccttccttccttccttccataggtgagaaaaagtagcatcttttcctcacctatcacaaagtttgcagctggggcacctacagtaaaaggttaacagacacaagcataacaaatgtatttaaggcaagtgttgacatgggagccttcagaaatgaaggcctaaagaaacagggaaacctgggtgggttttttgttttgttttgtttttagatggagttttactctgtcgcccaggctggagtgcagtggcgcgatcttagcttactgactgcaatctctgccttccatgatcaagtgattctcctgcctcaacctccccagtagctgggattacaggtgcgcgccaccatgcccagctaatttttgtatttttagtagagaaggggtttcactatgttggccagactggtctcgaactgctgacctcaggtgatccacccactttggcttctggaagttctggcattacaggcgtgagccactgtgcccggctacctcccgttctatgatctatggtttaaacgctacatttgaccactatcaatactcccagtatcaaaactgggaaacctgggttcttcacccagagcctaaaacgaacagcattctttgccttgtgggtgacaatagcaaacatttaccgcctgtgtatatgtgccagacactgttttaatcctcagagaggtgatgtcacttgcccaaaatcacacagctcgtgactgtgagtctgaaattggccagagcttgtgcacctagccactggtggtgatgtgtctttgagtcatcgagtccagcattctgtgttggacttagtgaaaggatatacttttgtagtgatgagaaaggagctttatctagaatttgtgaggccaggcatggtggctcacgcctgtaatcccagcactttgggaggctgaggtgggtggatcacttgaggtcaggagtttgagaccagcctggtcaacatggtaaaaccccgtccgactaaaaatacaaaaattagccaggtgtggtggtgcacacctgtaatcccagctactcaggaggctgaggcaagagaattgcttgaacccaggaggcggaggttgcagtaagccaagatggcgccactgcactccagcctgggtgacagagcaagactccatctcaaaaaaaaaaaaaaaaaaaaaagaaaaggaaaagaagtgaactggttcaaagaccataatcatacatatcacacaagactgcaagcggaccagggtcagttaatttagcggctccacaaagtcatcagtcacctgagctccatccatcttcacatgctgtgctaccatttattttattttatttttttttttgagacggagtctcgctctgtctcccaggctggagtgcagtggcgcgatctcggctcaccgcaagttgcgcctcccaggttcatgccattctcctgcctcaacctcctgagtagctgggactataggcgcccaccaccacacccggctaatttttttatatatatttttagtagagacggggtttcaccgtgttagccaggatggtctcgatctcctgacctcatgatccgcccgccttggcctcccaaagtgctgggattacaggcgtgagccaccgcgcccagccagctaccatttcttagctgtatcatctcacggtcccaaaagggctgctacacatccagccatcacatgcagataatttctttcaaaaacagcagaaagaggctcgttcttgtcttggtcccttttgaagaatgaatgaaaccttcctaagccttccagcaactccccccacaactccgatgggtaggaattgtcacataaccatgtggcccgataggaggcaaaagaaatgagacttctgggattagtttagcctcagattctgcagctgagaagttgatcagccacctctgaaggacaagcagcttgcagaaaattagggtggtgttaccaaggagaaaaggggaaatggctttagagtagacaacagggatgccctgaggggttgtgtaggttgttcactgcacgaagtcccctggtcaagaaggtaagcggggtttaaacagacccacagtctactcatcaaaccaggtgtccttggcattgtgtccacccagagagctcactattttcttttcttttcttttctttttttgaaatggagtcttgctgtgtcccccaggctggagtgcagtggcatgatcttggctcactgcagcctccgcctcccgggttcaagcaattctcctgcctcagcctcccgagttcaagcaattctcctgcctcagcctcccgagtagctgggattacgggcgtccgccaccacacctggctaatttttgtatttttagtagagacagggccttgtcatgttggccaggttggtctccagctcctgacctcagctaatctgcccacctcggcctcccaaagtgctgggattacaggcgtgagccaccgcgcccggccacaactcatcttttagagccagcctacacttgtcataggccatggccgatgaatgggaagtccacggtggagctgggtgttcctctcaagttcaactggctgcggccaggagggcaggcaggccaggtggacaatttcccttcaaagtggatacaggcaggacatgcaaagatgaatatctctggcactggactctggcaagtaggaaaataaaaacaaaagatgaacatcttgggccgggcgcggtggctcacatctgtaatcccagcactttgcgaggctgaggcagaaagatcacgaggtcaggagttcgagactagcctgaccaacatggtgaaaccccgtctctactaaaaatacaaaagttagccaggcgtggtggcgggcgcctgtaatcccagctactcaggaggctgagacaggagtatagcttgaacctgggaggcagaggttgcagtgagcagagatcgtgccattgcactccagcctgggtgacagagattccatttcaaaaaaaaagaacatctctacaaactggatcaccagtaaataatagctacatatacttgtactcaccatatgtggacacccacatatgtacactcagtcgataaacacccacatttaaacataccatgtgggccaggtgcagtggctcacgcctataatctgagcactttgggaggccaaggtgggaagatcacttgggcctaggagtttgagaccagcctgaccaacatactgagaccttatctctacaaaagagaatttgtttttagttagctgggcgtggtgatgtgcacctgtagtcccaactactcgggaggctaaggcaggaggattgcttgagcctaggaggtcaaggctacagtgagccacgttctcaccactgcactccagcccaggtggcagagcaagatcctgtctcaaaaaataaataaaaaattaataaacaaaaaatgcatacaatgtatagatacacaaagtgtatatatatacatatatatgtatacacattcacatatacacacatgctgtgttcacaatcacctagatgacatatgtatgtgtatacatacttacacatatacccttacatgtacacgatatatctctacccatacactaccatgtacacatgtccatttgtacacagctgtatatgtacacacacaattttgcacacacctgtatatgtatacaatgtatggatccccatatccacattacacacaatgtgtacgcatctacctgtgtacacacacccacctatgaacacaatgtagacacatctgtataaacacacttgagatacatgcctgtgcacataggcaagtatgtgccaagtatttacacacctgaagtagaagcacacacacacccacactatgcctgcacaccaccgcatggccacgttcaccagcgccccgggcctccatctcccagctaacgtgtcccgttttcctcccctgacagccatgctggtcgttcagatgcctttctcctttcccatggcccacttcatcctctttgtctttacggtttccactatatttcacgttcagcagcggctagcgaagattcaagccatgtgggagttaccggtgcagataccagtgctagcctcaacatcaaaggcactgggacccagccagctcagggggatgtggacgatcaatgcaataggccgcctggggaaccagatgggcgagtacgccacactgtacgccctggccaagatgaacgggcggcccgccttcatcccggcccagatgcacagcaccctggcccccatcttcagaatcaccctgccggtgctgcacagcgccacggccagcaggatcccctggcagaactaccacctgaacgactggatggaggaggaataccgccacatcccgggggagtacgtccgcttcaccggctacccctgctcctggaccttctaccaccacctccgccaggagatcctccaggagttcaccctgcacgaccacgtgcgggaggaggcccagaagttcctgcggggcctgcaggtgaacgggagccggccgggcacctttgtaggggtccatgttcgccgaggggactatgtccatgtcatgccaaaagtgtggaagggggtggtggccgaccggcgatacctacagcaggccctggactggttccgagctcgctacagctccctcatcttcgtggtcaccagtaatggcatggcctggtgtcgggagaacattgacacctcccacggtgatgtggtgtttgctggcgatggcattgagggctcacctgccaaagattttgctctactcacacagtgtaaccacaccatcatgaccattgggacgttcgggatctgggccgcatacctcacgggcggagacaccatctacctggccaattacaccctccccgactcccctttcctcaaaatctttaagccagaggcagccttcctgccggagtggacagggattgccgcagacctgtcccccttactcaagcactaatgctggcccattctttgagaccttttctccttctctgcctccctcaagatgagtgcccgggcatgagaagcacatggttccatgagcaggacccatctctcttctgtgaagatgcgttgggctgcaagtaacagaaatctcagtgaacagtggcctggcgtggtggctcatgcctgtaatgctcgcactttgtgaggccagggtgggtggatcacttgaggtcaggagttcaagactagcctggccaacatggtgaaaccccatctcgactaaaaatacaaaaattagccaggcgtggtggtgcacacctgtaatcccagctactcgggaggctgaggcaagagaatcacttgaacccaggaggcggaggttgcagtgagccaagatggtgccgctgcactccagtctgggtgacacagcaagactccatctcaaaaaaaaaaaaaaaaaaaagaaaagaaaaagaaatgaatgggttcaaagaccataatcatgcatatcacataagaccagaagtggcccaggtccagggtcagttaatttagcggctccacaaagtcatcagtcacctgagctccatccatcttcacatgctgtgctaccatttcttagctgtatcatcccatggtcccaaaagggctgctacacatccagccatcacatgcagataattcctttcaaaaacagcagaaagaggctcgttcttgtcttggtcccttttgaagaatgaatgaaaccttcctaagccttccagcaatttccccccaactccgatgggtaggaattgtcacatacccatgtgacccgataggaggcaaaagaaatgagacttctgggattagtttagcctcagattctgcagctgagaagttgatcagccacctctgaaggacatgcagcttgcagaaaattagggtggtgttaccaaggtgaaaaggggaaatggctttagagtagacaacagagatgccctgaggggttgtgtaggttgttcactgcaggaagtcccctggttaagaaggcaagtggggtttaaacagacccacagtctactcatcaaaccaggtgtccttggcattgtgtccacccagagagctcactgttttcttttctttttcttttctttttttttttttttttgagatggagtcttgctgcatcccccaggctggagtgcagtggcatgatcttggctcactgcagcctccgcctcccaggttcaagcgattctcctgcctcagcctcccgagtagctaggattacaggtgcgtgccaccacgcccagctaatttttatatgtttagtggaaatggagtttcaccatgttggtcaggctggtctcaaactcctgacctcatgatccgccttcctcggcctcccaaagtgctgggattacaggtgttagccactgcgcccggccctagagctcactgttttctagttagtccatctggaagtggagcctttttccagtttgcacaaatgtgccatattggcttgtagctggcatgcatccaagtccataggtcctgcctcttcaatcctggctttctagggcctgggatgatcattgctagaactgagagaccagcctggctcagtgaacttcagggcgttccgttcattctttcagtaaatgtttgcagcacatgtgttacatgtcaggcagtgaaaccccccacagcagccttccctctcagaggatacatttgtaaccattacacagtcatcaaaggaataattttttttaatcaccagtgtgcatacagtcatggagttgggtattcccagctaccagggaggctgaggtgggaggattgcttgatgccaggagttagggaatatagtgcaccgtgattggacttgcgaatagccactgcactgcggcctggacgacgtagtgataccctgactcttataaataaataaatgaataaacacaatta

SEQ ID NO: 1237 - DNA, 9965 bp, Homo sapiens; identical to SEQ ID NO: 1236

SEQ ID NO: 1238 - DNA, 2557 bp, Homo sapiens
agagtagttctcctgggtccgctctgcgggcttctgggagatgtagtttctggtctgtaggcaggacggaaggagcgggggaggccccttacgcaaactacaattcccggcggggagcgcggtgaagcgggggtgggatctgaacatggcggcggtggtagctgctacggcgctgaagggccggggggcgagaaatgcccgcgtcctccggggtaaggagagggaccccggggagggcaggactgcagaagatcccttttctttcacgtccagcccgacgatagcaggaggtcagggctcttggttcctccccacacttttctgcaagatcttagagtctgggggtgcagagatgctctttagaggtcacccagtgcatccccccgccttcgggttgctcgacacctccggggtcttgctgcaagagggagctcctaggaagcctgttggactcccgcgctccaggtgtttcacactcaccgcagtgcagaggaaagagccccgggcttctggaggtttgagttccagccccggataattagcagtttgaccttgggcaaagcagtttttctctcagggcttcagtttcctcttccgtacagtgcaagggatggagtagactatctttaaggtcccttccagtgctaacatttgcagtttcaaaaccttttcccggatttccttcatacgtcttatgtgagtcccactgcagtccttcccatgctgtcgtctgaggaagaacagcgaagcttttcgtcctggcaccagggtgatgagcccgcagtgacgtggaagtggcttccaaaggtgccacctcggtggcgattttcccatttccctttggattctccttggcacttcttacttcagactgcagtcactccccttccccagatctcagccgctcctcccaagcccttactgccccccacctccccgcttgctttcttctcatctcttcttactgaccttccttacctccatccacagggattctcgcaggagccacagctaacaaggcttctcataacaggacccgggccctgcaaagccacagctccccagagggcaaggaggaacctgaacccctatccccggagctggaatacattcccagaaagaggggcaagaaccccatgaaagctgtgggactggcctggtgagttttaaccacccctttgcccaccaacggggcgtggcttgtaggggagggcaggacttagaaacttctccaagtttcaggtggcgagctgaatccaaagttgtgggaacagaattgttgggttcgattggaatctcagaggggtggggcagtggaggtgggaaagtatgtggaattgagaagacagtgggtttactgtggagtaagctgagttgatctgattcagacttgggtccctggcctcatcctcccttttgggagcttggagtgagacccaagtttaagtaagtagttcgttgagatcatgtgagcttgtactagttgtatagtagtactcagaaggcgttatgaacattgtgattgggctctgactctgaccttaatacatattattgaccaatattaaagagaaaggaggaagaaatcaacatttttttctgcatgtgaggtgtgccagtactttgccatgtaatgttttagtgtttgagataagtattacatccccatttcacagaggaaggaactgagactgagctaggattctcacctagtctgtgactccatgctctttcccccataccaaagtgcctcccaagcagtggttacttagcttaagaggggaaaactgggagggtaccttggccaagtctcagagagggaaagcgtcagggctgcctggaaaatcctgcacaggtgctgttgcaggaatgcagggctcgtgctgaggatcaggctctaggcgggaggaggaaagaggcaggcagagacccagccacactgggccttttgtgccatgtttggacttggccaggaagtgatggagttacggggttttaagcagggaagtgacaggatctgatttgtgtgggtccctccagcagccagcacagaggatgaatagactataagaggtattgcagcattcatgcaactgatgaagctagaatgactccccccagctcctctggctcaggcttggcccctccccaaaccccgtgcacatctccccacccgtagggccatcggcttcccttgtggtatcctcctcttcatcctcaccaagcgggaagtggacaaggaccgtgtgaagcagatgaaggctcggcagaacatgcggttgtccaacacgggcgagtatgagagccagaggttcagggcttcctcccagagtgccccgtcccctgatgttgggtctggggtgcagacctgaggagcgctgcgaccctcctaggctattgactgttaagtcctcaggtttggcccagattccagttcgtgcctctgaggtccaccagagggcgcatgaagcccaggctgttgccaaaccctaccctgccccacaccaaggagccagccaaaggcaaataaagttattgagtgtttagtagaaaggaa

SEQ ID NO: 1239 - DNA, 30755 bp, Homo sapiens
catggctgcccctgcttccgtcatgggcccactcgggccctctgccctgggccttctgctgctgctcctggtggtggcccctccccgggtcgcagcattggtccacagacagccagagaaccagggaatctccctaactggcagcgtgggtaggccctgccccaggggcggatgggcggctggagacagtgcccttggggcgtctgtcggtgctgggcctcctcccccatgtcgcctgcccatcccttcccctcccccatgtcccctgccttcccttcctcctgtgtcccctgcccctcccccacgtcccctgcctgccctacctctcccgtggccccagcatggctccaccgtcagctccgttctccctgcagcctgtggtcggcccagcatggaggggaaaatcctgggcggcgtccctgcgcccgagaggaagtggccgtggcaggtcagcgtgcactacgcaggcctccacgtctgcggcggctccatcctcaatgagtactgggtgctgtcagctgcgcactgctttcacaggtaagcgggcgccggcctgggatggtgtgggtagctgggcctgcacggagtgcccacagcggcttggatggaccccacgcaagcctcccccatcaccattgtcgactcccttcaccactgtcgacccgcgcaaggccaggtccccaccagtgaggctggtccccaaacacacagctgggtccccattcttgaggctggtcccccaagtgcacagccaggtcctcaagagtgatgctggtccccaagatcacagccaggtcctcatatgcaaggctgatcccctaagtgtacagttaggttcccatgagctaggttggtcctcaaatgcacagcctggtccccatgtgcaaggctggtcccctaagtgcacgaccaggtccccacgagtgaggctggtcctcaagggcacagccagattcccacaagtgaggctggtcctcaagggcacagccagattcccacaagtgaggctggtcctcaagtgcacagccaggtcccacaaaagtgaggctgctcctcaagtgcacagccaggtcctcataagcaaggctggtctctaagcacctggccttcccgattgctcctccaacagccccattcaccacagctgccccgcacagcaggcacgcctctcctgtggccatctggcctccagagggatgtgtgcaaccaggttgtcagtaagagtcagagcaggtctcacatgcatgggctgctggcctgtacagctggtggtcgtgtacagacttgggtccccagagcctccatgggccaagtcgactctttagggggcaactcttccagacagccagataggtccctactatgctgcaggaagaaactggcttttcaatcccaccgagtgagtgccagccccttgcgcttggcctccccaggcctgtgggctgaccacacaggaagctgcgggcattgtacctctgttctcacccccacagggacaagaatatcaaaatctatgacatgtacgtaggcctcgtaaacctcagggtggccggcaaccacacccagtggtatgaggtgaacagggtgatcctgcaccccacatatgagatgtaccaccccatcggaggtgacgtggccctggtgcagctgaagacccgcattgtgttttctgagtccgtgctcccggtttgccttgcaactccagaagtgaaccttaccagtgccaattgctgggctacgggatggggactagtctcaaaacaaggtaggaatacagtgcagggctttgtgggcaggatgaaggcttctcttccaccacagggaagaaaatgctctgccagctaagggggtccaggtgtttggggactggaatccccacctgtcaatcaacatttatttgtttgtcagtgtggatattttgttgttttgttttatttctgactggctttgttgtatgcagaaaaatacagctactttgatgtgaagttggtatgcagtatatcaagaacacaaatttaaaagcagttttccttaagattgtaaacggaatttagaaatctcttttagcttatctaaaaaccgtttgttattaaacttttctccagaaaggcctgtgcattctttctagatttatacctgggcactttacaatatttaggtctattcaaaagagatttttaaaattgcatttgctaattagtcacagctaattagctgtgactatgtgtgatttttgcacattgatcttatatccagtcatcttatagaatttatttttagtagtttatcaactgattattttgacagttctagacaaaagataatattttcttctagtaaagactattttatcactctcttcccatattttatcttttatttatttttcttgtcttcttacaatggttggaacctccagtagaaatgatgccagatcttgtcttggttttggtttgattggaaatgcttataatggttcactatagcatttgtggccaggcctggagatttcaggttgatatattacaccagattaagaaagttaccttttatagctgatttacttaatttttaaaaaattatagaaaattattgattttattgaaatgtttgcggcaactcttgagaggatcatatagttctgctcttttaatctattgatgccaagaataggcatttaagctgggtgcagtggctcacacctgtaaatcccagcactttgggaggctgaggtgggaggatcgcttgagcccaggagtttgagaccagcctgggcaacatagtgagatcctgtctctacaaaaaatgctgacttagctgggcttgacggcatgtgcctgtagtcccagctactcaggaggctaacgtggaaagatctcttgatcccagaaggtcaaggctgcagtgagccaaaactgcatatctgcaccaaagcctgggcaacagtgagaccttctctcaaaaaaaaaaaaaaaaaaaaaaaacgtatttaatgtgagatgggtctagaattttttttcttagctgattttatctttggcatgagtgtactgctgactttgtagaatgaatcaaaactttcccatctatttgtattctctgcaatagtttctattaaagtaaagattagctatttcttgaaggtttgatgtggccataaaacactctgatcctagtaccttttgcgggtataaatgattactctgtcttactctctgttatggctactggttcattccaattttaaaatttattcttaggccaattttgatggattatatttttctagaaagttgttcattttattccagattttgaatataatgatattgtgtaagactgtaattcatgtgctcttattattacttttctgacttctcttaattccttatcatagttgccaaaattgtctattctattgccttttttatataaaactacctgctacagattttgcattggtgtatgtggggagatggtggtgcatgggactttatatgttgggtgctttgctattcactcctatagccatctattcattcgttaaactttttatactctaagtttgcttaaccaaacttttctaattttttgagctgaaaatacaaaagattcaacatttcatactttttctatgaataaattgaagattatagctttcaaagtctcctttggtcatgttacaggctttgaattcttacatatttgttattcgtttctcaaaagtatgtgcaccctattttgattttgtctatatccaaaagtataggacaaaatttttcatatctacaaaaaaggccattggaattttataggaattgcattgaatattcagaccatgttgagtaatgttgacattttaacaatattaaacctgcctatccataaacatggaatgtatttccatttatttgagtctttaatttctttcagcaatgatttatagattcgagtatgcaagtttttcacctccttcattaaatttatttccaaggtatgttattattttagatgctattgtaaatgaaattgctttcataactatcttttttggattgttctttgggggtgtataggaacacaactgatttttggccgggtgcagtggctcacgcctgtaatcccagcactttgggaggccaaggcgggcggttcacaaggtcaagagattgagactatcctggccaacatggtgaaaccccgtctctactaaaaatataaaaattagctgggtgtggtggcacttgcctgtaatcccagctacttgggaggctgaggtaagagaatcacttgaacccaggaggtggaggttgcagtgagctgagatcacgccattgcactccagcctgggcaacaagagtgaaactccatctcaaaaaaaaaaaaaaaaaaaaaaaagcaacacaactgatttttttatgtgttggccttataccctgcaactttactgaatttgtttattatatgtagtagttttgttttttttttaaagattaattgggattttctatgtataggatcatgtcatctatgaatagagattgttttacttctttgtttccaatttgaatggctgttatttcttttccttgtctaaattatttgtctagaatttctagtacaaattaaatagcagtgatcaaagtggaaatccttgttttgtttctgatctcatgggaaatgctttcagtctttaaccattgaatatgatgttagctgtcagtttttaaaaaaatgccttaatgttgatgaagtttttctacatcaattgagatgatcctatgttgtcttttttcgtttattctattaatgtatattacattgattgatgttcttatgttgaattacacttgtatttcttggataaatctcgctttgtcatggttttatatgctgttggttacagtttgctaatattttgctgagggtttttacatctatattcttaaaggtatgatctgtagttatattttcttatggtgtctttggctttggcatcaggataattcttgtctcatagaatgaattatgaagtgttgcttcctcttctatttttttggtggagtgtgataaagattgattaattcttctttaaatatttggtagaatttaccagtgaagccatctggtcctgtacttttctttgttgggagattcttattgttgaatcaatctctttacttgttatagatcttttcagatttcctatttcttctgtgtaagtttagataattcatacgtttgtagaaatttgtctatttcatccaagttatctcatttgcaagataagttatttcacaaatttataatcatttttgtgcatttgttttttgaatcctgttgcagataaaaagtggaattaaaaaccaaataaaaagtggaattaaaaaccaaactcacttatgagtgagaacatgtggtgttttggttttctgttcctgtactagtttgctgaggataatggcttccaactccatccatgtccctgcaaaggacatgatctcatttttttttttgcacaatattccatggtatacatgtatcacatttttttaatccagtctatcattgatgggcatttaggttgattccatgtctttgccattgtgaatagtgctgcaataaatatatgcatgcatgtatctttataatagaatgatttatatcatggtttaatggtttttatatttgcccgtgcatttacctttaccaaagtcctttaatttgtcatatggctttgacttactgttttgtgtcctttcttttcaatgtgaagcactccagttagcatttcctctatggaagatctagtggtgcagacttccatggctcttgtttatccgtgaacgacttaatttctccctcatttctgaaggacgatgttgtcagatataggattcttggttgaaaggttttttcttttagcactttaagtacatcataacactgtcttctgatctccttagttttttatgagaaattggctattaatctgattgaggatccttgtacatgactagacacttctctcttgctcatttcaagattcattgcctttagtttttgacagtttgattataatgtgtcttgttgggggttatttgagtttataatacttgaagtttgttcagtctgaatttgtagatttaaatatttcagcagattgcaaaattttggaccattatttcttcaaatattctttctacctcattctgtctctcttctccttctgaaaataccataacacatatgtggttcatttgatggtgtcccaggagtctcttaggctctctttactttccttcctcttttttcctttctaatccttagattttataatctgaattgtcccatcttcaagttcacctatgctctcttgtgcttgctcaaattgtctgctttgcccctttagtgaagttttcatttccattatttgccattttaatgccaaatattctgtttggttcctttgataatttctgtttactaatagtatctttttgttcatatattattttcctgattttctttaattctttgtctatgttttcccttagctctttgagcatatttaatacacttgtttaaagtctttgtctagacttctttagggacagtttctatccacttattttgttttcttaagtgggccatagtttttttctgatttttgttgttattattactattattgaaaacaggagtgttgagttttatacttttgaatatataatgaatgttatatgtggctgaatattgattataataatgtgttaactctggaaataagattctctccaaccccagggttttctgtggtgttttgattgttgaaagctatagtagtctgtttaatgattttcccaaactattttgcaaagactgtatcctttctcatgtgtggtcactgaagtcgctattccttagcttctgttagctactgttttgacagtattttcttgaatgccaggagctaaaaaccaacaaaaccaaaaatctcttcttatgatctttgcaggttggtctgtgccaaggcactttttcaatacttagccatgcttgcaccaagcctagggatcagcctgaggtgaaagttttggtcttctcaggtttacttatgagcatgtgtcttaccctgggcatgttcatggccttctaaattccctcaagtacagaggtgctttttctaaaaatcttttccaatttatttactttttaaattatgtattttttatttttatagatttaggaggtacaagtgcaggtttgctacatggatatattgcataggggtgaagtctgggattttagagtaaccatcacccaaatagtgaacattttacccaataggtaatttctcatcccccatcaccttcccatcctcctaccttgctgagtctccaatgcatattattccactctctgtgttgtgaactttatttagctcccactcataagtgagaagaagcattatttgactttctgaattatttcacttaagataatggcctccagttccatccacattgctgcaaaagacatgattttattcctttttatggctgagtagtattccatggtgtgtatgatatatattatttatttatacatataatataaaataatatatatacacaaacacaccacattttctttatccaatcatttgttgatgggcacttggtttggttctattttttttcttttttgttcatgctgtccctgggtgggctcgaaggttggttctatattgacatagtttggatgtttgtttcctccaaatctcatgttaaaatgtgctccccagtgtttgaggtggggccagtaggaggtgtttggatcataggggtggattcctcatgaatggcttggtgccatctttgcagtaatgagtgaattcttgctccatttggtttgtgcaaaagctggactaatgtttaagagcctaacatctctcttacttcctcttgcatcatatgacatgcctgcttccctttcaccttcttccctgattgtaagcttcctgaggtcctcaccagaggcagatgctggcactatacttcttgtacagtctgcagaactgtgagccaaaataaacctcttttccttataatttccccagcctcagttatcctttatagctatgcaaaacagactaatagccgtatttttgttattgcaaatagtgctgcaataaacatgtgagtgcaggtattttttgtacagtgacttattttcctttggataaatacccagtggtgggactgctggattgaatggtagctctatttttagttctttgagagatctctatatagttttcaatagaggttgtactaattttcttttttttcttcaacttttaagttcaggggtacatatgcaagaggtgcagttttgttatgtaggtaaacatgtgccatggtggtttgctgcacaaattatcccatcacctaggtattaagcccagcatccattagctgttcttcctaatgctttccctccctctatccccccaaacaggccccagtgtgtgttgtttccccactccctgtgtccatgtgttctcataattcagctcccacttatgagtgagaacatgtgatgtttgcttttctgttcctgcgttagtttgctgaggataatggcttccaactccatccatgaccctgaaaaggacatgatctcattttttcatggctgcatagtattccatggtatacatgtaccacatttttttatccagtctatcattgatgggtatctagcttgattccatgtctttgctattgtgaatagtgctgcaatggacgtttgcatgcatatatctttataataggatgatttatattactttgggaatatacccagtaatgagattgctgggtcagatagtatttctgcctctgggtttttgaggactcgccacactgtcttctgcaatggttgaactaatttacactcccaccaacaatgtaaaaaatgttcctttgttcttacaacctcaccagcatctgttgtttcttgactttttagtaatagccattctgactgacatgagatggtatctcattgtggttttgacttgcatttctctaatgatcagtgatgttgagctttttttcatgtttgttggctgtatgtatgtcttcttttgagaagtgtctgttcatgacctttgctactttttaatggggctgtttgttttttttcttgtaaatttgcttaagttccttgtagactctggatattagacctttgtcagatggatagattgcaaaatttttctcccattctgtaggttgtctgttcactctgatgatagtttattttgctgtgcagaagctctttagtttaattagatcccatttgtcaatttttgcttttgttgcaattgcttttggcatttttgtcatgaaacctttgcctgtgcctatgtcctgaatggtattgcctagattttcttctaggttttttatttttttgttttttgagagagtctcagtctgtcaccaggctgggctggagtgcagtagagtgatttcagctcactgcaacctccaactccctggttcaagcaattgtcctgcctcagcctctggagtagctgggattacaggcacatgccaccacgcccagctagtttttgtatttttagtagaggcagggtttcaccatgttggctgggatggtctcgatctcctgatcttgtgatctgcccgcctcagcctcccaaagtgctgtgattacaggcgtaagccaccgcgtctggcctctaggttttttaaagttgtgggttttacatttaagcctttaatccatcttgagttaatttttgtatgtggtgtaaggaaggggtctaatttcatctttctgcatatggctagctaattctcccagcaccatttattaaatagagaatccttttcccattgcttgtttttgccgggtttgttgaagatcagatgattgtaggtgtgcagtcttatttctgagttttctatcctgttctattggtctatgtgtctgttcttgtaccagtaccatgctgttttggttactgtagccttatagtatcatttgaaattgggtagcatggtgcctccaacttcgttctttttgcttaggattgtcttggctattcaggcttttttttgtgtgccatatgaattttaaaatagttttcttctaattctgtggagaatgtcaatggtagtttaatgggaatagtattgaatctataaattactttaggcaatatggtcattttcacaatattgattcttcctgtctgtgagcatggaatgtttctccgtttgtttgtgtcccctctgatttctttgagcagtggtttgtagttctttttgaagaggtccttcacttcccttgttagctgtattcctaggtattttattctttctgtagcaattatgaatgggaattcattcatgatttggctctctgcttgcctgttgtcagtgtataggaatgctagcaagttttgcatattgattttatatcatgagactttgctgaagttgcttaccagcttaagaagcttttgggctgagatgatggggttttctagatacaggatcgtgtcatctgcaaagataatttgactacttctcttcctatttgaacaccgttgatttctttctcttgcctaattgccctggacagaacgtccaatattacgtttaatagaagtggtgaggccaagtgcggtggctaacgcctgtaatcccaacactttgggaggttgaggcgggtggatcacctgaggttaggagttcgagagcagcctggcccaacacggtgaaaccccatctctactgaaaatataaaaaagtagctgtgcatggtggcatacatctgtagtcccagctactcgggatgctaaggcaggagaatcacttgaacccgggaggcagaggttgcagtgagccgagatagtgccactgcactctagcctgagtgacagagtgaacctccatctcaagaaaaaaaaaaaagtggtgagagagggcattctcttgtgacggttttcaagggcaatgactgcctccagcttttgcccattcagtatgatattggctgtgggtttgtcatatatggctcttattttgaggtctgttccttcaacacctagtttagagtttttaacatgaaagaatgtttaattttaccaaaggccttttctgcatttattgagataatcatatggtttttgtcattggttctgcttatgtgatggattacgtttattgacttgcgtatgtcgaatcacccttgcatcccagggatgaagccaacttgattgtagtggataagctttttgatgtgctgctggattcggtttgccagtatattgttgaggatttttgcattgatgttcatcaagtatattgacctgaagttttgttgtggtcattgtagtatctctgccaggttttggtatcaggatgatgctggcctcatagaacaaattaggaagaagttcctcctttcaattttttgtaatggtttcagtagaaatggaactggctcttctttgtacctctggtagaattcaactgcaaatccatcaggtcctgggctttttttggtcggtaggctatttattactgcttcaatttcagaacttgttattggtctgttcagggtttcaatttcttcttggttcagtcttgggagggtgtatgtgttcaggaatttattttctagtttcttttctagatttttttagtttatctgcatagaagtgtttatagtgttctctgatggttgtttgtatttctgtggggtcagtggcaatatccctcttatcatttctgattgtgtttatttgattcttctctcttttcttctttattagtctagctagtgatctatcttattaattttttttttttttagaaaaccagcttctgaattcattgattttttgaagggttttccatgtctctctctcattcagttcagctctgatcttggttatttcttgtcttctgctagctttggggttttttgctcttggttctctagttcttttagttgaggtgttaggttgttaacttcagatctttctagctttttgatgtgggcatttagtgctataaatttctctgttaccactgctttagctgtatcccagagattctgatatgttatctctttgttctcattagtttgaaagaacttcttgatttctgccttaatttcattatttacctaaaatcattcaagagcaggttgttcaatttccatgtagttgtgtggttttgagtgagtttcttaatcttgagatctaatttgattccactgtggtctaagggactgtttattatgttttcagttcttctgcattcgctaaggagtgttttacttttgctatatgatcaattctagagtaagtgccatgtggtgatgagaagaatgtatattctgttgttttggagtggagagttctgtaagtatctattaggtccacttgatccagatctgagttcagatcctgaatatctttgttaattttctgtctcaatgatctgttaatattatcagtggagtgttaaagtatcccactattactgtgtgggagtctaagtctctttgtaggtctctaataacttgcgttatgaatctgggtgctcctgtattgggtgcatatatatttaggatagttagcttttcttgttgaaccctttactattacttgggtccagggagccaagcagcatcattctgtgagcctcacctccatggcaccccacaagttaagactactggcttggaattccagcctgccagtcgcgataggctggaatctgcttaagaaggaccaattccccagggagaggagcagtgccatctctgcagttgagtcaactcagctgttccagcctgccggctctggagagtccagacaatctggatgaagaagggtcctcaacaaaggagcacagctgcactaccaagaagcagccaggctgcttctgtaagtgggtccctgattctgttccttctcacaagggaccaccccccagggttatgtagggacaggtttcccaccttgctgggaatcctggggccagagtatacaaaactcctgggtctccgtgtgtgcctgagtggctactctgtcaggactccacacagctctgtgtagagagacccaaggacctggtgatactggcttatgagaggatcacctgatctgctggttgcaatgattcatgggagaagtgtggtttcccagggtggaatcacacaatcacttcaccacttcccttgacttgagggcagggattcctttgggtccatgtggctcctgggcaggccatcaccccaccctgcctttcttcattctctatgggtggacctgtttgcctagtcagtcccagcgcgagaacctggatatttcagttgaaaatgctgaattcacttaccactttcattcctctctgtgagtgccacagaccgcagctgcttccaattggccattttagtcttgtactaattttcatttccaccagcagtgtataagccttcccttttctcttcatcctcaccaatttctgttgttttttgactttttaataataatcattctgactagtgtgagacggtatctcactgtggttttgaatttctctgacgattagtgatattgagcattttttcatatgcttattggtcatttgtatgtcttcttttgaaaaatgtctattcctttgtccaaaaagtgcttttgagcactcccaaagaaattcccactagctcttgctcatgggccttaggcagtatattgtatatacttatacttttattgtacatatgtttactatatacagtatattgtatatagtttatgatttttgaatctattgtgaatgcagttttctcaatttcattttaattgttcattgttagcatattgaagtacacttgatttttattcatttcattctgagaaatgtagtttaaattctttgtaattcactgtgagttttttcatatattatgttgtttgtgagcaaagacagtcttcttactttccagtgtgggtaggctttctctctcttgcctcattacactggctacaacctctaatataatgttcaatacaactgggaatagtggatatccttgccttgttcttcatcttagtgggggaaatgtttcgtctttcaccatcaagaatgatgtgagctgtggggtttttttgtagatatcttttaacagattgaggaagacttctttggttcctagtttgttgagtatctttgttatgaataggagtaagaaatgctttttctacatctatcgatatgttcctgtggctcctgatttttatgttattgatatattatattcaattttggatattaaactcaccttgcattcctgtgattaatccctcttggtcattgtgtataatagtctttctaggttgctggaatcaatttgttaatactttgttaaagatttttgcaactacatttatgagacatattggctgaatttttcttgtgatgtttttgtctggttttggtataagaaaaatattcatgtttatagtattggtattgtttccctcttaaagatttgatagaattcatgagcaaagccacctgggcctgggcttttctttatggaaagatatttttattattagtttgttatatactttatgtatttattattgtcctattacttttactttttcttatacaggtgtattcagattcccatttcttcttgaattagtttaaggtgtctactttttttttttttttttttgagatggagttttgctcttgtcactcaggcaagtgcaatagcgcgatctcagctaactacaacctccgcctctgggttcaagcgattctcctgcctgagtagctgggattacaggcgcccaccaccaagccctgctaatttttattattattattattatttttagtagggacagggtttcaccatgttggccaggctggtctcgaactcgtggcctcaggtgatctgcccacctcggccccccaaagtgctgggattacaggcttgagccaccgtgcccggccttaaggtatctaatttgatagcacacagttgttcataatagtctcatcatttattttaatttctaaaaggatagtagtaatatttcatcttttctgattttggtaattggcatcttctctatttttatcttggtcattataactaaaggtttatcaattttggttgtcttctagaactgatttttggtcactgattttccatattacttttctgttttctatttcattgatttccactctcatttttcttattttcttccttctgattgctttgaatttaattgttctttttctagtttcctaaggtagaagcttagagtggtttgtgacctttcttcttcttctaatataagcatttaaagctataaatttccctctatgcactgttttaaatgcttcccacaaattttggtatactgtgtttttgttttcatttagttgaggatattatctaatttccctcataattttttcttcaaagtttcttaattttaagtatttggtgaattccaaataaaatttcttcccattgttaattttaactttaatgcccttgtgcttagaaaaaaatacttgctataattttacactttttgaacttatggagacatgtactatggcctagcctatggtctgtcctggtaaatgatccatgtgtgtttggaaagaatatgtgtcttgctgtcattggtgtggaaatttttataagtcacaggtcaagttggctgataatgtttttaagtcttctatatccttattggttttctgtcttttaaaagcagttattgggccaggcgcgatggctcacacctgtaatcccaacactccacaaggtcaggagattgagaccaccctggctaacatggtgaaacctcatctctactaaaaatataaaaaattagctgggtgtggtggcatgcacctgtagtcccagctacttgggaggctgagacaggagaatcatttgaagctgggtggcagaggttgcagtgagccaagattacaccactgcactccagtctgagtgacagagcgagactccatctcaaaaaaaagaaagaaagaaaaagaaaaaagcagttatttagagtagagtactaaaatctctatgactgctgaattgtttatttctcctttcaattatgccaggttttgcttcatgtcttttcaggctctgattgggtgcatacatatttataatcatgtctacttggtgtgttgattatcttatcatttaatcaactgtctttctttgtccctagttacatttgttttaaagtctgttttgtctgatattgatctagccatttaggctgtcttacaattactatttgcacggatatcttttttcatcttttcactttcaatctatatatgcctctgaatccaaagtgtatcttttggtagaaagcatatagttgggtcttccttttttatctagtctggaaatctctgccttttggctgaagtatttagtccatcttcacgtttaatgtaattattgattttgtggatttaaatttgccattttgctaaatgttttctatatacctatatactctctttcctctattcatttttccatgccttcttttatgttaacaaagtgccttttggtatgccattttcattcttcccttgattttttagactatatttcaaaagatgttttctaaacagtggttgtagggcttgctttgtttatcacaatccagtcagattaatactgacttaattctggtgaaatataacaatggttaaataccgaaagccttccctccaagatcaggaacaaaattaagatgcctgctttcaccactggtattccatattataccagaagctctagacagacaaattaggtgagaaaaataaacaaaagaaattcactttggaaatgcagaagtaaaactatctctacttgcagatgacatgatcctatatatatagaaaatcccaatgaatcctaaaaacaaatacacagtaacaacaaaatcaaactacggataatttttaaaatccagccaagtggcaggatgcaaaatcaacacacacaaaaaaagttgtgcttctatacaacctcaatgaacaattcaaaaaggaaattaagaaaattgttccatctgcaatagcacccaaaccaaaatatacctataataatgtatccaaggagatgaaaactacaaaactacattgaaaactatagaatgttacagaaagaaatttttgaaaacctaaataaatgcaaagacagctgatgttcatggattgggagacttaatattgttacgatgacaatattacccaaagtgatctacaaacacagtccttatcaagataccaatgcccctttttgcagaaataagaaagctaatcttcaaatttatatgtaattagaagaggccacaaatagctaaaacaatcttaaaaaagaacaacatggccgagtgcagtagctcacacctgtaatcccagcactttgggaggccgaggtgggcagatcacctgaggtcaggagtttgaaaccagcctggccaacatggtgaaaccccatctctactaaaaatacaaaattagccgggcgtggtcatgggtgcctgtaatcccagctacttgggaggttgaggcgggagaatcacttgaaccaaggaggcagaggttgcagtgagccaagatcgtggcactgcactctagcctgggcaacaagagcgagactccatctcaaaaaaaaaaagcaacgttgaaggactcatacttcctgatttcaaaatataccatgaagctgcaatagtcaaaatcgtgggttatggcataaggagagatatatagaccaatggaatggaattgagagttcagaatcactggcccattcattttcaatgaaggtgccaagtccattccatggggaaggaacagtctgttcaacaaattgtactagacattcacatacaaaagaatgaagttggacccttacttcataccatatacaaaatttaccacggaaattattgaagactaagtatatcaactcgaagtataaaattttagaataaaactgttgttggttgaattatgtcccccaaaagatatgttgaagttgacacccccagtagtcataaatgggacattttagaaataggctatttgcagatgtaatcaagttaagatgaggatgttagggtggggccttgtccaatatgactgaaggacatataggaaggggagaagggacacagacatggagtgtgcatgtgatgacagaggcagagactggagccatgcacctgccagccacagaaagccaaggatttctggcaaccacaagaagctaggaagaggaaaagaaggatcctccctgagacccctgagagggagcctggcccttctgacaccttaacgtcagacttcaggtgtgcagagctgtgagagaaaaactttttgtcgtttgaaactgcccagtttggggtactttgtgacagcagccctaggaaacaaatacagaaacataggtcaagaaatcacaaccttggacttggcaatgggttcttagatacaacaaaaacatgagcatcaaaataaattggccaggtgtagtggctcgtgtgtataatcccaacagtttgggaggccaaggcgggcagattacttgagcctaggagttcgagaccagccagggcaacatggtgaaactcagtctctacaaaaaatacaaaaattagccgggcgtggtggtgtgcacctgtaatcccaggtactcaggtggctgaggcaggaggatcgtttgaacccgggaggcagaggttgcagtgagccgagattgcaccactgcactccagcctgggcaacagagcaagactctgtttcaaaaaaaaaaaattagctgggcgtggtggcgagtgcctgtagtgccagctactggggaggctgtggtgggaggattacctgagctcagcgggtcgaggctgcagtgagccaagattgcaccactgcactccagcctaggtaggtaacagacctaaattgtctcaaaaaaaattgataaattgggcttcattgaaattaaaaacttttgtatatcaaagacaataccaagaaagtgataagaatggaagaaaatattttcaaattatgaattgataaaagcctagtatccagaatatataaagaactcctacaactcaacaaaaagcaagcaacccaatttaaaaatgggcagaagacttgaactgacatttctccaaagataacatgtaaatggtccacaagcacatgcaaggatgctccacgtcattagtcattaggaaacacaagacagaaccccagcatccattcatccctcgccaaaatggctgtaatcaaacaaatggaaaataggtactggcaagggcgtggagaaagcagagccctcgttcattgctggtgggaatttaaaatgacatactccctgcagaaacagtttagaagttcctcaaaaagttaaacaggccaagtgcactgctcatctttaatcccggcacttcgggaggccaaggcaggaggattgcttgagcccaggagtttgagatcagcctgggcaacatagcaagaccccaactctaaaaaacaatgttaaacatagaattaccctatggcccaattaccacacataacaactccactcctaggtatgtactcaagggattgaaagctagtgttcaaacaagtacatgtacatgtgtgttcatagcagcactattcacgtagccaaaaggtggaaacagcccacatgtcccacagtggaaaaatgaaacaaactggggcataaacataggatggaaaagtatttcaaccataaaatggaatacgtgctacaacactgtcgagcctcaaaaacacaatgctaagtgaaaaagccagacactaaaagtcctatattgtgtgattcgatgtataagaaatatctggaacaggcaaatcatacagatggaatacagattggtggctaccaaggacagggtctggggtgacttttggcttgatgaaaatgttttggaattagaaggtgataatgattatatggcattgtgaatgtactaaatgccactgatttgtctgctttaaaatgcttaatttaatgtaacgtaaattttgccttgatttttaaaaagtgctgtccaggtgtggtggctcatgcttgcaatcccagcactttgggagtccgtggcaggacgatagcttaaggccaggagtttgagaaaagcctgggcaacatagcaagactttggttataaaagagagattttgtttgtttgttttttacttttttttttttcgagacaaggtcttgctctgttgcccagactggagtgcagtaatatgaacacagcttattgcagcctcaacctcctaggctccagcgatccttcttcctcagcctcctgagtagctgggaccacaggcatgcaccatcatatccaggtaattttctttattttttgtagagatgggggtctcattttactgcccaggctggcctcaagggatcctcccgcttctcaaagtgctgggattacaggtgtgagccaccacaccaagccaaaaaagtttttaataaaagcttccggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaataaaataaaagcttccataacagaattttcattggaaactctcatctttcatgtgagaatgcctttattttatactctacatttttatttgagacattgtttacaaactctaaaatccacaaatattgtgtacagctgaattatgttaacatattcttttttcattttttaaaatgttatttcttgtaacattggagttacaatgaatttttaaagcaaattccagatactatatttcatccataaatatttcagtgtagacaaacattttatttatatatttatttaatcttattttattcttttagtggcagggtcttgctctgtcacccaggctggagtgcagcggcacagtcatagttcactgccgcctctaactcttgggctcaaatgatcctcctgcctcagccttcagaggagctgggactacaggcgtgcgccaccatgcctggatagtttttactcatgaatagtcctgttgcactaccatcaccaccctccaagataaaggacatttcctcaccagagaaaacttccagtctccccaggtgacaaatccgccttgccaaggtaaacactattctgaattttgtcatcatttagtagtttttccttttcttaaacttcgttaatgaaatcacacaccatggattcctctgtgcccagcttttttcgctgactactgtttttgagattcattcatgttgtttccatatcagctgctcatccttcttttcctgttgtgagttctttcagtgtttgcacgcagcaaagtgtcttctctccatagtcctgctaatagacgtctgggttgccatcagtgtttaggtcatgtgaacaaatctgcaacagatacttactgtgcaagtcttttggggaatataggtacttgtttatcttgggtctatgcttggtagaatctgttggctgtggtgtagggataaattcaactttattggaaactgccaaacacgtttctaaagtggtcatgccatttttcaatcccgtgagcaatgtaggagagtgctagttgctgcacctctttgccgatacttggtagtgccatctttttcatttcagttatgctactcatgtcatggcctcttcttgaggtttgctgacttgtaggagtttctttatatattctggatacatgtacttcaacgtgtattgcaaatattttctaccgcactggcttggtttgtaattttctttttttgttttctttttcttttttagagatggggtcttgctctatttcccaggctggtttcaaacttctggcctcaagcgttcctcccacctcagcctcccaaggtgttgggatgacagtcgtgagccattgcacctggccagcttttaatttccttagtagtgtcttttgatgggaaaaagttttggattttgatgaagtccaatttatttttatattaatattttggtttcacacatagggtcttttatattctgtttataaagatttgcctattgtaagtttacaaagataattttcaacatctattctagaagcgttttgaatttaatttttatatttaggcataagatccatctgaaattaatttttgcatatggtgtgaggaaaaggccaagtttgagccagctggtggtggcgtcatgcctgctgtgattccatgtgtggcccccgctgggcctgtggtgctgtccatggccctctcctgagcaccgccctgcagatgagcgttgtagtctagtggtcagagccagcatgggcgctctggagcctttgcatttccacttgtgtttggagtcagcctactcatttctacaaaatgcctgctaaggtttcgaatgatccattgttttccatggctcttggtcctgttccctgagacatcctttcttctgcattcgtctccttggctacttcttaagcaggctttgaaaaatgttcattctgtctatttgtcatggtgccaggatgtcttaagctacaggacttacatactcagctttaagttttgtttgctttgagcaagttagatggatgttttggccattataatgtgaaaactcctatttctttgtagtatttcaccaatttgtgtgtctatgataattgtaaatacatgcaatatctgtatttctcttttcaaataaaattctttattttattttaaaaaattcagctagggccttactatgttgcccaggcccaggtctcgagctcctgggctcaagtgatccacctgccttggcctcccaaagtgctgggattacaggcatgagccaccacgcccggctctactgctccattttaatgccaaggaataagtgttctggcagcacaaattggtccatgcgaggtaacgtggatacattcaggttcagccaaaaatgttttgcatttttatgcttctttcctgccagccctaaggaagtcagtgttgcctgaatgctttaataaaacacatccctgtttaaatgtatgcaactgagccaggtgcagtggttcaagcctgtaatcccagcaatttgtgaggctgaggtaggaggattgcttgaagctgggagtttgagaccagtctggacaacatagtgagaccccatccctacaaaaaaggaaataaaataaaataattagccagacatggaggtgcatacctgtagtcccagctacttgggaggctgaggcaggaggatggtttgagctcaggaggtccaggctgcagtgagccataatcacaccactgcactccagcctgtaacagggcaagagcctgtctcaaagaaaaaaaaggtatgtaaccagagcaggaccctgtctcaaggaaaaaaaaaaaaggtgtgtaactgaaaaacaaatttttaaaaggtcttttatatgtattgcatttgagcaactttctcagactttcttgagggcttggtggtcttttgagactgtgaacatcttgtggctcagactggcgacagttttacaagtgcggacctcagattcctatgtcttctcctgacatcctcgatgtgccaccactctttttgaggtaacacttcctaaatgtcatcgccgcctttttgggtgtgttagactgttgagggacagcaccccgagggtacttagagtcaccgtcatccagcagaggatgtctaccgggcactttcttaattcttccgaggacttagcacaggtgccaacagccacaccctcagcggatctttattctgagccatgtcttgcttgattttctctttgcccctcggctttatcttgagaatattttgctagctagaaagacttgcgaacagaaacagtttaattttccaacccagaaaaccgcagcccctgtcttacaggggtcagtaaactacagatgaggagtcagatccactccattgcttggttctgtgttgtctgtgagcttaggatggtttctacacttttgtttttaaaatcttattttatattttgagacacagtcttaggctagagtgcagtgcggtgatcatagctcactgaggcctcaaactcccaggctcaagcagtcctcccacttcagcctcctgagtagctgggactataggcgtgtgccaccacacccagctaatttttgtattttttgtagagatgggggtctcactatgttgcccaggctggtctcgaactcctgggctcaagcgatcctcctgcctcagtctcccaaaatgctggggttacaggtgagccagtgtacccagcctacacttttaaatggttggggcggaaaagaacccaaaagaggaatatttcataaaacatgaaaattatttaaaactcaaaattcagtgtccctacatttttcttcaagcatatacatgcccatttatttacatattgtctctggctatttccattccacaacaggagagtggagcagtggctgcagagctgagatggcctgcagagcctacggtgtctactctttggccctttacagagtttgctcaccccttcttcactgtgtgtcctctacagttgtttgaaaattggcatcttctctttcgagtttctctcttttctgtagtgccttatcctcagctagaaccagccacttggctttcgtcattcagcctggaagtcaccttgcaaagtctctcaagttcattaaacatattttataccttccatgtctccatcagcaacagtttgtgccacttcatcccccaagccaccatcttcccgacctcctatatcagttttcccttcatttttccagattctactgtgagtgctgctagccaccagcttccaaaaccaagacgacgtttttggtattttagagaagcctctaattcctagataccatttctgtatcattttatctattgccacaagaatgctgcattataaagagtgagcaggcctggttcacccagcaacgggcctttactgagctcaggcagttgtgggtcggtgatgtaacctgtgggttcttctggtttggctgagcttctcccatcaggctgctggctggcctgggatagcctgagctggggggctggactctgccccatgcaactgtctccatccagcaggctggcctagctgcacccctcagcagtggtgaagattcaagacaatgagaaacaagcacttttccaagcccctgcttaaatcccgttgaccaaaccacgtccgtggcaaaattcagatccaaggactggtgaaatgtgacaccgcacctcgatgagaggaaccgcaagacatatggcagagggcacccatgtgggaaaggcggggaaggggacccactagtgcagttcatttcccctgaacttgtattttactactcagcagtacaaacactttaaatagcgtaactccattttcttctttaaccccttatacttttgttctgcatttttcttctatacattatattggcatgaatgctgctttaaatccagtaatccttgaccacatttttcactagtctttcatttttaaccacaaccaggaaagggttgacccaatgcccaaattcagttcacccaaaaccaggaccacccacctcccagtaacagccctcaatctccagctccatctcacaaatgtgtgcatcctcctcctctctgccagggcatgtaagcaggcagttgtcttagtccatttgtgttgctgtaaaggaatacctgaggctgggtagtttctagaaaagaggtttgtttggctcagggttctgtaagaagcatggtgctggcatctgcttcagggcctcaggctgcttccactcatggggaaggggaagggaccacatggccagaggggaggggagttcccaggctccttttaacaaccagctctctctgttggaagccagtagaatgagaactcactccccccacctccacagcactgatctattcatgagggatgcaccccccaggacccaaatgcctcccattaggcccacctcgaacatttggagttgaattttaacatgggatttggaggggacaaacatcccaactatagcagcagggcaggcgaatagtgcctgcaggtctatctgtgatctataggcccaagtcatatccatgcttcaaggtactctcattccaggaaagctttcccaaattcagctctgccctctctcccttcttagacactgaatgccatttcatatgtctggtgtctgtccatctctgtttgtttggggcacagaattggattcattctaattctcagatcaaaaaaaaatttactctacatttgttcctgcatggtgctctttcagtgtttgcttgcttataataatatggacaccaatccaacagggaaactagagcattgacaataacgtatctgcttttgtggccctgccccatctggccttccacctctccttctctgagggaacttctttttttttttttgagatggagtttcactcttgttgctcaggctggagtgcaatggcgtgatctctggctcaccgcaacctccgccttctgggttctagcgattctcctgcctcagcctcctgagtagctgggattacaggcatgtgctaccacacctaattttgtattcttagtagaatacggggtttctccatgttggtcagggtggtctcgaactcccagcctcaggtgatccacctgcctcggcctcccaaagtgctgggactacaggtgtgagccaccatgcccggcctctgagggaacttcttaccatgcatctttgacagacaagtcgtggtaagtatatccatggattcccaggcctttacagagaatccgttgccctcaggaacaacagcccacagattggaaagctccaaccttgatcaaaggagcagtagacttcaccgtctctaatgaggaccggcctttatattctcctaacaccctgagacggacactaggaatagccttgccctttctatgagacatgtgtagccttctcttggcagaattagtaaaaaagccatccatacataatgtagcacagggctccaggatgcataaatgagctgcaggccgcaagacttggtttacgatgctccagtcaaggccagaaaaccaaacgtaactgaaaagtagccctcatatttatttgggtcacttagatgatattacatgatatccagttccacaacaacacatatttcctctttcattttccctcttctcccattctcccacacccaacaaatctttgaacacacataaacacacaaaaacaaaaaacaaaaaccagccgggcgtggtggctcacgcctgtaatcccagcactttgggaggctgagatgggtgaatcacctgaggtcaggagttcgagaccagcctgaccaacatggagaaaccccgtctctactaaaaatacaaaattagccaggtgtggtggcgcatgcctgtaatcccagctacttgggagtctgaagcaggagaatcgcttgaacctgggaggcagaggttgcagtgagccaagatcacaccattgcattgcactccagcctgggcaataagagtgaaactccatcttaaaaaaaaaatgtcaaacaaacaaaaaaccaaccaagcacagtggctcaggcctgtaatcccagcattttgggaggccgaggcaggtggatcacctgaggtcaggagttcaagaccagcctggccaacaaggtgaaaccctatctctactaaaaatataaaagttagccgggtgtggtggtgcgcacctgtaatcccagctactcgggaggtggaggttgcagtgagccaagattgtaccaatgcactccagcctgggtgacagagtgagaccctgtctcaaaacaacagtaacaacaacaacaaaacaaacaaaaaaccctctgtgttactttcaactccccagactgttctgtcctgatttgactcttcatggaacactcttttactctgtctgacatcttttgttttaacttttataatcgtttcttttttgatataaatattcaggaaaccaaacacaggattggggttagggctaggggttaggcttaaggttagtgttccttcaatatgtggtggggatcctccccagtgagacctgggctcctccccatctgtggtcgggacttcattcatgggtcatcggggttactccctgtctgatcaaggcttcctcccctaccccccatgagtggtgaggtttcctccctgtgagtgggcaaagcttctccctacgtgtggtggggctccttcctctgagtggtcagggttcctctctatgtgcggtgagactcctccctatgtgtagtcaggactcctacctgtgtggtgggactcctccctatgtgtggtcagtgctccttccggtttgtggtggagctcctccctacatgtggtggggctcctccctatgtgtggtcaaaactcctccctatgtgtagtggggctcttccctatgtgtggtggggctcctccctatgtgtggtggggctcctccttatgtgtggtggggtcctccctatgtgtggtcagggcttttccctatgtgtggtcaggactcctcactgtgtgatggagctcctccctatgtgtggtgagggctcctcctcatttggtggggatcctccctctgagtgttcagggttcctccctgtgtatggtgggactcctcaccatgggcagtggggctcctccctatgtgtggtcaggactcctccctatgtggggtggggctcctccctatgtacggtcagggctcctccctatgtgtggtgggactcctccctatgtgtggtgggactcctccctatgtgtggtcaggactcctccctgtgtagtggggctcctccctatgtgtggtggggctgctctctatgtgtggtggggctcttccctatgtgtggtggagctcctccctatgtttagtggggtgcctccctatgtgtggtcaggactcctccctatgtgtggtggggctcctccctatgcgtggtggggctcctccctgtgtgtggtgaggctcctccctaatgtgtggtggggctcctccctatgtgtggtggggctcctccctatgtgtggtggagctcctccctatgtatagtggagctcctatgtgtggtcaggactcctccctatgtgtggtcaggactcctccctatgtgtggtgggactcatccctatgtgtcatcagggctccttcctacgtatagtggggctcctctccatgggctatccccttggtgtccactgtggggcagggatccccccaccccacacgaagcaggtgctgccccctcacgggagccctcctcccacaggtgagacctcagacgagctgcaggagatgcagctcccgctgatcctggagccctggtgccacctgctctacggacacatgtcctacatcatgcccgacatgctgtgtgctggggacatcctgaatgctaagaccgtgtgtgaggtgtgcccctcctggtccatgagacagaggtcatgggtgccctgtgcctgtggaccccacaggaccccactctggcctcccactgactagcaggagccctgcagccatgccccaagctgagcagggcgatgtatgacaatgtgtgaacgccgcatgcctgcagcaggcctcccctgcaactctgggctgtgttgcagccagtagggaggctgggtgagaggggggcactggccccttccagcagggtctgcacagccacccccttgcaccctgggggacaggtgcaggaggcggcaggcctgggactcccagttcacaaaaaactccctcttcctttctagggcgactccgggggcccacttgtctgtgaattcaaccgcagctggttgcagattggaattgtgagctggggccgaggctgctccaaccctctgtaccctggagtgtatgccagtgtttcctatttctcaaaatggatatgtgataacatagaaatcacgcccactcctgctcagccagcccctgctctctctccagctctggggcccactctcagcgtcctaatggccatgctggctggctggtcagtgctgtgaggtcaggatacccactctaggattctcatggctgcacaccctgccccagcccagctgcctccagacccctaagcatctcctgtcctggcctctctgaagcagacaagggccacctatcccgggggtggatgctgagtccaggaggtgatgagcaagtgtacaaaagaaaaaagggaagggggagaggggctggtcagggagaacccagcttgggcagagtgcacctgagatttgataagatcattaaatatttacaaagcaa

SEQ ID NO: 1240 - DNA, 203314 bp, Homo sapiens
gtctggtttaaggatactttattattgaaccagtatgtacaaactctaacatgaaaataatgagtcacagaatatcaagactatttacaatacttttttgttttttacaaaacatttttacaagattacttctctctaaataatgtgacagacatacacaaaaatccaactttttttattacatacataaataaatattgactttaaatgaccactgtaagggacatgaattctacagaccacttggatgagaaggtagcagttttgttatctgcacactacaatataattaagtaaaggggaaaagtaactttatatagacctctgttaatcactccgtaaatcatataactcactagaatattcagtagaggtaagacagtcatgagaatcctctccgtacctgacaccgagtctgaccatgcaaaatcacaggtaagagtcaacatctttatatatctgtttatattttataataaactttaaagtacatgcaacagatatttagccattgtgttctgcctataatatgaaagtttatataataagttttagagttatttgcaaccatagaaatgagtaaacttgaaaacccacggcataagaaagggcattaaataaataagtcaaaatcacaaatgacatttacggatacatagggcaaaattagtatttgtacttgtatgatacagacacgagtcaaaattccgtcttttaatcaagttgtttagtggacataaaaaacacagtttaggcctttgaagtcaaccataataacttcttagctgtcccttagtttttgggacttgctctagaaattcactgggtttcttataaagggcaaattcagtaaagatcattctctagcaatggttctcaaccagaggtaccatccctcaaggggtagctggcaatatctggagacatttttggttgtctcaacttgggggagggtgcaactggcatctggtgaggagaaagtgtggatgctactaaaaacctacagtgcacaagacaaacccccacaacagagaactatccagccccaaaagtcaatagtgttgaggttgagatgaacctctgtatacagtcggctatgtatctaaggttttcaggacacagatgtatttctaatctttgaacttcgtttaatacacattacaaaaaattacctgccataaaccttatcttctctaccatgtcatattaaaacagtgaatgactgaaaagagcacatgttggtttgcaaacatcattctatggagttccaggtagaaaaacagggtaacacagataaattcatcattaaggagcaaatgttgtaaataaaaataatgcatgtaactgcaatgtatgtcagattaaccacctgtatttgatgacaatatttttgatgagctcaattttttaaacagtcaatactattactggatatatttttctcacattagagaaatgaatctaatttcaataaaacatattacagaattaggcaccaaaactatgtttgttaaaaagcatagattttattctttattagagcaatcacatttttaaaattcaaaaaattataactatatttttgatcatttgaataatactggagcttattaaaatccataagagaaacacatgttttttattagcccattaatagcatttttcttccaataacaccaataaaatttaaattatttatttatattaaaattagaagcccataagagctgctttagatttttttaagggagatgtaagcttcagaatcaccatctgaactaaaaatatctgtccaatgtctattacccagacaaaagaagcatgattaaattttataaaattaaatttatgtaataatttaataatattttgtatctatgcagagactcccagcatttttaactatgcaacagtacaaaaatttgctggcataaacatttgaatttgttcatgacaagttcatgtaaaagataaatggatagctaataatgaaaaattttaatttttgaaattttaagaacttgaaattcagatgctggtaatgacaccagaataaaaaagagaagctatctatggtatccatttattcaagcttagggatgttttcaaatgaagattgttttctatttttgccactcaaaaattcttagaaccaggtaatttcataactcaatgtgataaatccatcccagcttgtgacaggagctgcagtgaaccattcagaaccaacatgaactttcattctgaggtgtccaatttatgttacttgtacaaagctgcaaaacattcctggaatatccactttttaaatattttaacacacaggaaatgggtttcaatatctattatcaggtatccatgtttataaatgtgtttcccaaagacatgcatcaacatcagaaaagttattttccctgcattttaatttgcatctacctttagacactgcagtgaggctctgtggagtacagtgacttctgagttatccactcttcccaggaatggccaggcatctgcatgaattcaggaaacaataaaacaacaagaagcaagtaccattgtcaaaacctaaggataatgttactgattttcttcctgttttacttaggtaggtaaagacatatggacacctttcttttacagtgtttaattttgataaattgctcttttctcagaatcagcattgatggggaaaatatattatccttatgacctttaaaagagctgtatctttactcaccattggtgagctacgaaaacgatttctccagggattcatgctcaaggtatattcatgtatatgcatgtgtctgtgtgtatatacatgtatatgtacatatatttgcatatatatacacatgcatttataattatatagacatgcatatctatgcacatttcaaaccatgtatgtgagtattccttcaagaaaaaaaacagtattaaattaaacttctctgcgttttaggttgttacaatatacactgcaacactctatattgataacacgttttgacttaagttcatgctacaaggcactaatttgtagcataaaacatttccaaaaagtaagatatactagatttgaaagcatatgggtgaattaaatgcaaataactgtccttctctatcaatcaaaggaatttttaaaacattaccaataatattctagcacacaaagacctttctttgattaagaaaaggcaaatctctgcaaagatttaaacatgctcaatagttgggattttttcatttgaagcaagaagttttgtgaattttcagatggtgaaacaaaagtgcaccaaaagctattatctgcattgaggaaaataagggaaaatataaataagataacatatcaggaaaatctctcacataataggatcaaatattaaaaggcatccccaagaaataattttcatttctccaaggtaaaatctgattagcagcttatttcattgagttcctctggcttgggtgtcttttgtaaatcataatttatagagggaactttgatttacctttgcataaagagcagcacaaggtacttaaagtaggagcatttttagatttaaattcgctggtatattttagattacacattttcatttaaaaatcacctaggataaaaatgatcttaggaaagattcaaaaaaacaaagctgtgtaatcttagttgatttttcatatcgaatcaataatttagtcaaaaatatattttattgattagatttacgcttagtgttatgtgtgaattgtgtatttgttactctcctttttggggcggagtttggtgctccaaattcagggaaaactgagttctgttgtaattcaatagaaatgagcgacaccatacatgaaaacaaaatttagcattaaacaggcctattcttcattttctccatgcttgtagggaactggtgtctgtcttcaccaatctactgtttctcacttgtctccagatgcgtccatgattgacagaagttcttcctgcactaaagtcacataggagagtccgggcctctgagcagttcccactgcctctggaagtgtgcatgtctcgtggccgaagttcaacaagcttacacatctgtgcaatttcacaaaatctttttgaacagtttagtatctttctggagaaggcttgtaatgatgtggatgacgatgcttaagatgagatcctaaaaagtgacaaaatatgtcagtcacatccatttgtatgtatcaaataaatgatagaattacctttatttgtagaaaaagcacgagaccctggcaaatgttccttcctatgaccatgtctttcctattctgaatctgaatgtacaaccacactctttctctccttttcctgtttttctcttcctctttgatgtcttcccaaactataaaataacaagaaaaagaagacaagctcctttccttaagctcacacttatccaatcaaaccataatccttttttatttgctcaaagaagtttaaaaattatcaaatacttctgttaaaaggaatttctatgaaggaatatcagaaaagcatttatctgacaaaaattttagaggctatcaagctctcccattgtgatagtttttgtttttcttcaaattataagcataccaagttatcaattataagcataccaatctatcatttaaaaaaatcagagttaaaactatgactaattctcaatgttttgtccacacactagtcatcagacacttttttaaaaaatttaagctagaaaataaagtaaacgaagtacataatttaaaaatcagcaagaggctgttttgaaaatctaggtgacaattttctttttaaattttacttgatttagcaataaatgaagtaggtggacttgggtcatatcatgaagaaaattcataatatttattacagtaatatctatgtaacaagaacataagttccttagcaaaatattatttcctatattgtgatatatgaaaatcttgatttaaaaatatttcagatatgagactacagatttttttcccatatgtatttatggtttaaaagacaaggaaaaaagcatgcattacataggggaaaatgcaaggaaggaaaaaaaaaacaaaggaaggatagaggaaaggagaaaagaagagagggaagaatgaaggagggagggagagaggatggagaaaggaaacaaggaaggagcaaagaaagggagaaaagcggggaagagggagggagggagaaaaagaacaattaagcatcaactatgcaatgtatactacaggtgcctggaatagaatctagtaagtcggtacaaacagggagaaagaatttcagatgatgacaatttccctatctcatagaaacctgtactagtgtatttatttgttttcattttccagcaagatttttctctatgtccacaagacctgacaggatggcttaatgccctggcaccccactcactgtgtgctgaagagggtgggagctccggcgtccggaacgtcttgatggtggccggcccctcccctcctggggtcagcacttgcacttccagtcggtaaagagtagatggtctcagattgggcactgttaggacataatgatcctaaggggacaacataaaagagcatgctcaccgacaacctttcagagacaacatgcaatgcacagagagcctagaacagtttttcccccactggagaatatcatacacaggcaagtttggttgctttgtaaaggcatagtttaatttatagactatttctcatttgtgggggttctctgccatatggtttcttagcacctcactcaattcttggcagcctaagacacttggcagagttaaaatatgctgaggtgccagttctcagggctcactcctgggattttatttatttttttaattccttaacgtaaaactttcccatggtttaaagtcttcagctgcacatcttgtgatgtgaactcttgatagtccaaatttcagtgaatgagccaactgtttttcttaaaacacagtatctgtcaatgcccataactgaaaatgtttatttttatgccaacatattcttctcaaaactcaataaaacctagtacatttatagaataactactctctaattccatggaatttttccttctgagatttaagttgtgtttctttccctctctgcccctctttttggattttgtaacggtagttggctattctaagggcattttcagagagggtaaaatcccacacatgattttttttttttttttttgaagccaaggaattaagtggcctggaagacaggccaactcattacagcctcgagccaaatttgaagttgcggggaagacggacaaacaacaagcttcttttagctattcctgccctccccaattcaacacttcaaacagggcatgttcacttggaccagagagacatgaggttaacaaagatagaagaaaatggctcaatcacttatatacaagatagggtaaggtcttttcatgagttggctctagccatcaaactttatctagatggcagcttatgctacttcttagctatgcagtcacatttgtgatgtgttaatgcttgcaaaagatacactcagaagaagaaaatgcaaaaataagactcaatagtgcagcacacagaatgacagaggtagccacctctgaaggtcagtaaaaaggagcagtagataccaatgacacagacatagtacaagaggtgggacctacggaaggcaggatctgggactgtgaaataatgctgttgggtaggctgttctgtctgctttccgtagtgacctcagcccaagtcacttgaaacccagtcatgggctgatagagattggccttggccatcttccaagaaaagtgaccggtgatgttcacatcctggacgatgaatgaagcagaaaggttctcaggcttagctagcaccttagaaagaacatgacctgcagcaatgcaagaaggaaaaccaggattaggcgactggagaaggtgtgcccaagggatccattgtaggaattttcagcggccagtctatgggatgatattaatagaagcaatgtgaccttgttctttaaacatgggttcagacaatcacccctttgacatatggggataggttgagtaggaatctcctcactccaactttgtactaaatgcttcttccagtcttttggggatcatttttagaatgctcttttgaagatggaggcaggagagcagtttagaccctggcaagacttaactatttcttaaagaatagcattgactgcagtgagaaggtaaatattaaagctgttagaagagttattaaatccgaagcttttttttttttttttttttttttttttaaaaggtgagatcttgctatgttgcccatgttggtctggaactccagggctcaagtgattctctcatctcagcctctcaaagtactgggatttcaggcatgagccgccatgcctggccaaatccagggcatttaaaagactttttcccactgcaagacagggacattggcaaggagatgggatggaaggtacagatgtgaggtttgccaggttggcatggaaagtgtgtgagtataacccacgcagcaaaggggtgggaaaataatgaaataattatatcaaactttcccaaaacacaagcggtatctaaatgtttgccttcatttccaaagggataacattactatcaaaggacatctttccaagcctgttaggctttaaaataacacattcattcctacatctcttccctccacattgggccatcataacacaacttagaaagagaggcacttttggttttcacggtcttgtgaaacgcagtttgacaaggtttgcaaagcgctgctgacaccgtagacctagatgtagaagtccttcaggtgaaaacgtacctgcttcgcccaggcagccaacaggcttgtggctcttccccttaagagcagagcatggtggagtagtgaagaaaacagcttctgccttggagtgactttttggccgtattggttggacagtcaccttatacttgcaggaaaatgacagatcttgaagaattatgtaattttcctagagcaagagaaagagaattatgctagcaataaatctcattagggattaaaaaacactggcaagaattgaaatcatattccatccaacaaggatgttttcctatatagtgtgtgcaatatggcttttataaaaagtacaaagcacatactgtccacattttgattaatgacaattgtgaaacactcccatggctgcgggatatgccttctagaattaaacagtatcataataattcctcatcaaagcaggctacttctaaggtcgcaatcagcatttttgagttggtagcagtgcaggtagtggtgtaaagctgtaaatacaaatctaacttttttcagttaaaaaaaactaacgcaggcttctctgagacatagaattagtttatatgtaagtttttctgttaaaaaatgatgatattctttagcaatataatttttcccttttttggagtgctgttactgttttctgccataatgttgtgattaaatataaataaaagaaagaggctaaatggtaaggagtcacgggctaagaatataactttatgataatgtcaaaagatgacatttcctgtgataacaggtgtgtatctctgtttctttcatatttggctaaatggcacttatccattctgttttgtatttaccaattcttaatgtatatgtataaaagtgcagatggatagctgggcatggtgactcgtgtcatagtcctagctactcgagaggctgaggtgggaggatcgcttgaactcaggagtttgtgaccagcttggtcaacatagtgagactccatggtttttacgtgtgtgtgtgtgtgtgtgtgtgtgtgtgtgtgtgtttaattattttttaagagaggaaaaaaagtacagatggaatatctctggcactcattggatgatgggtaggggatcttgctagaaagcagcagcgttgacgggaaaaacatgagacaagaattaaaatcaaaactgaggcttgagtgatttacttaagtgaggagtggaagtggctgcaggtgacagagcactgaatgttcaaaagagaccgggagtgacctccaggtgtgctggcccttcatccagatggtgacaggagatggggtgcacccaactctgcagccagttagcacaaacagtgaataggaaacaaatcaatctggacaacgcaagaccaacccaagcccaacccaagcccaagccaaggccaccatgtttctttgggagtctgaattgcttttctttggaaataaatctgctctttacatgggactatactggaatccaaggttagctattaaggatcctgtttcacagatatttcaagattgttttcatattgcataggagacagacatctgcagcagtaagtgaattagtggatgctccattgtagcataaaaacaaattataataattggatctaaaggtttaaaactaaatacagataagttctaaacccctagaaggataatttttcaggagtttgatttttatttctaccagatacattacatctgctcagcaaatagttgttaccactttcagagttcctaaagatgataagcctaggattggggaattgcattgacataagcccagttctgtaaggttctgaggcacacacatataagtaaaacaaaaacctcacccctctgcccacaaaaatattaataattccagcttctgtttattgctttctctgcttttcaaatcgacttccttatttagaatgtctgtttaattattttactgaaggtcacaaacattggagctaatttaaggataaatacaaggagaaacattgctgaacatgagacaaattaagtccagtaaaaaagaaaaagaatctgtgtatttctgaaaatccagtgacttgttttatctcactctcttaaaattatgccagcaggtatggttcttaaaatatcgtgcttgctttagaaaatgttcaaaacaaaaatattctagttacatatcacaaaccaaaacattctatgtttggggccatgtttttggattttttaaactgtcctgaggtatcacatataaactgccatcaaagtgtattatacactgtataataaaatgacctcttaaatattttgtgttagtttgttgattctaatctataattcatgaatgaaccccaaaatatttggaataacattttgggcaatattgacagagttgctatcctcagagagtttaatgttctcttaaagttgaaagtcaaaatattggtgcatgctatacaggacagggagattatttcactaactgagctgatggcagttagggacatggtgctcaatgatagagtcacatagaaatccacttgtaccattacacctttagatcacggtgacatgtcaaaattcagaaaataattcaaagcttttgtccagttaagatgaagcacacacatactcagacatatttccccctgaaatatgggagttctttaagaactgtgtctttagtctctgcactttaggttttgctccatgtggataacagagtaagctcccagtgcaatggtgtgaatggataaaagaatgagtgaatataatgaccattctgctttccacttccatcaagtcattactccatagctgatttgtgggaatgagttatctgtttgacctgtctagtttgtacatcctcctgtctaattatgttcacagatcaagttggcctagagatcatgtccttacgtgggtcatgccagatgatgcctctgatccggttgttctgttgtgggcacacgcttcaggaaaccaccgcacatgatatcggttgacagtgggatctataatgccaaaacacgcaaacaaaaataataggctggatgttacattccaggtagcctggggttcttgaacttgagaggagaaaaggagaggaaatgaaactctacaggtgaccaataaatgcacagtgagccaaaggaggtgagattctgattacttaataattataataattagtaattctgaatacttaatcattaagaacaaagtaagggaaaaaagtaatatactgccaagggaaaacctgtgttgaagtgcaagcactaagtagaaaaaaaaattagtaaattcatagcaaaatgattccaaagatgtcttgagaataacctagccatggtttttacagtaagcaaagccctacaatgaaaggcaacacctagcaacagctctcgtaattcctgttgcaaaagagaatcatcagaagtttctcaatcctacctttttttttgataaagatgagatactattgaatccacacaagaacaaaaacattcccttcacacttgcagaattggctatccacgtttatttcctgttatgtattgccataaagaagttcttttgtccaaaggatagggacgtatgcttcccactctcccttaaccaagcgcatcgtggcatttctgtatggctgatccctactgaaatatgacttggtgttctcaaacacaggccagaagactgaccctttgaacacgtttattcccagggcaagaggaatattttctgtacatttctttactttggacaataaagtggggggaaaaaagataaaatagcggcaagcaactcaatgagtgtgggaaagcagaccttgacagtctcgggtttattaatcaccccagtgtgtccgaggagtgtgaaatggcaccaaatggcaccattttgcaggtgatttaacatcttgtcccccaacatcatgccaagtgtttgatgggagttttcagaggagaaaactctttgatgaaattgggttgatctagtgggaacttcgctttgagcactttggaaccagaaaagaagaactttaaatccgagaaagcaaacagatataaaagtgggcactccgggcatttagctaaaagagaaatcatgtactagaggttttaatttttacatagcagacatcaagagtttattttttaaaaaaagaattataggctatgcacaacgctgaagtcaatcactgagtgtgttcatgttcttccattcaacagcaatgaaataatcacacaggagtggctgctgccctcctgaattttacatagtaatggggccaataataacagagaataaatacaatacatagataagatagatattatgttagaacgtagtaagtccacatataaatacagaaggtggctgggcacggtggttcacgcctgtaatcccagcactttgggaggccgaggcaggcagatcactaggtcaggagtttgagaccagcctggccaacatggtgaaaccccctctctactaacaatacaaaaattagccaggcgtggtggcaggcgcctgtaatcccagctactcgggaggctgaggccagagaatctcttgaaaccggaaggcggatgtttcagtgagccgagatcacgccactgcactccagcctgggcaacaagagcaaaactccgtctcccaccaccccccccccaaaaacaaaaaaacaaaaaaataaaacaaaaaaaaaaccagaaggtaagggcagtagggtggattgacaaaaagtgctgattttatataaggcggctggcgtgtgttcaattctgagtcaggacttgaagaaggtgtagcagtgggtagtggcactgcagagacctgtgggagggtgttctcagccagtcctgtccaacagaactggcgggtgtgatggaaatgttctgtctgtggtaaacactagtcacctgtgcctataaagcatttcacatgtcctctgtttaacagaggaatttaattctttattctgtttcattttaattaatttaaatttaaacagctgaagatggccatggttacaatattgggcagcttaaatgctctaccagcagggaatacacagcacgtgccaaagtgctgacatgagaacggagcatgacggatgactgaaggtctttggtgaagagcagtcaggggacttggggtggctacattacagcaatacaaggaggcttggctgccctggggatcctccatatcctaaaaatcctttacatattttacaatgcaattatattttcataggaggcagcatcaagagtgacacatggggcactccttttgggttccctcccttttgttagccctaaatctcgccatgtctgagttcactgcactttcatcttctctctgtgtcacctccatgaatcacttcattgattcccatggtttgaaaaatttttctgctgacagctcccaaatgtctactttcacctgagctagtcccttgaagagctgatgctccctccttcctctcccatgtggaggctttccaaactcaactttgctgtagctaccatgttgatttctgcacctcaactgctccttgcattcacacttttctttctggctgtaggatgcagaattttgaccccacacataaccttcgaggaaggtgggcttcagcaagcaactccaacagcctcagtgagcctcattccctgtatctgagaataaggatactaattcagccaatgcaataggtttggtgtgttttaaatcagttcatgtactggttttctacagctgctgtgacaaattaccttgagtgtagatgcttaaaacaatataaatgtcttctcttctggaggtctgaaatgggtgtcactggtctaaaatcaaggcaggcctgtactcctttctggaggctccagggaagaatgtattttcatgacttttcaggtttctagaggcttctggaattctttggctggtggtgcccttccaccagcttcaaagtcaacaacactgggctgagtccttcgcaccatgccatctctctgattcttgcactctgcttccctattctacttttaaggacttttgtgattgtattcgtttccacccaaataattaagggtaatatccccatctcaaggttggctttgagtcattgaatggcttttctctgccctctgaataaagacactaatactcagcctggcttccaggtctccactgcctctacatattcatctcatgcagacactcctctcgttcccaatgttttgtttgattctgtggttacttcatgaatccctgtcaaccccatttggttagagctccataactataaagataatgcctatttgctgtcactgttgcataaacaaagatgagcatggtgcctggcaggtgataaacagacagtaaacatttaatgaataaataagtgaacaaaggtataccagttcaaattcacttttatttctctactcattctggcaacagtgaaaataattccttataatctaagacacggaagaaagtgtgaaaagacatgatattacataaggtaattaaaagcaatctgagaaagtaaaatataaattaaacttagattaaaaatgccctgaaagtattgtaaatggcacccccaaatgaccagtatggggactaacaatgcccacactcatttatgtgagttgagctcaattttaacagatcaattcatagatatttgctttgatggaagtcatttatacaaacatcatgtccttagctttatcttgctaattactaaaatcctaagagcttgtattttaggttatgactgcaggtctcaatctgtaactagaatattaaaaatagcatagttcaggccgggcgtggtggctcatgcctgtaatcccagcactttgggaggctgaggtgggtggattgtctgaggtcaggagctcaagagcagcctggccagcatggtgaaaccctgtctctactaaaaatacaaaaattagccaggtatggtggcacatgcttgtaatcccagctactcgggaggctgaggcaggagaatcgcttgaacccgggaagtggatgttgcggtgagctgagatcatgccattgcactccagcctgggcaacaacagtaaaactctgtcttaaaaaaataataataaaataaaataaatagccaaacacttcctgaaaggctgtatctgaaaattctgtgctaaatacccagttgatctggttccttagcttaattccttccacaaataaatgacattacaaagaaagtacctgaaaagtatttttaagtgataaaaaatttacctgtaatatgcttcaactatggttcaaaaattagatgggtctaattttcttttcaaatagatgtaactcacagtgtctggcataaacaaagggctctaaaatttttcattaaatgtgaattcctcagttcgcaaaagtctaatgacaaagaatgatagggttattgacattagagctctgagaaagaggcaatccttgggttctccagaataataattgctttaaaaagaattgtaagtcacagcactagggaagggggcacacacttagagaggtgtcacagaatgccaattccatcagggtagggatttctgtctgcctctttgcagtgttttagcatcggaaatggtgcattgcatacagtaggtgctcagtaaaggttagttgaatgaagtcctctcatggatcaatgcctcatactctatctgtaaacatgatctggtgaaacagaactttctgatgtacaactaaaataagaatttttgagtatcacataggcatttctacttaaaatagaagcatgaatgtttcctctatgtctgagctaacttttcacatttacgttgtagagacacaaagtctagagccagaaaaccatcaagatgcagtggctcatgccttcaaccccagcgttttgggagtctgaggctgaaggatcacctgaggccaggagtttgagaccatcctgggcaacatagcaagaccgcatctctacaaaaaatatattttttaaaaaattagctgggcggccaggcactgtgggtcacgcctgtaatcccagcactttgggaggctgaggtgggtggatctcctgaggttgggagttcgagaccggcctgaccaacatggagaaaccccgtctctactaaaaatacaaaattagccaagcgtggtggtgcctgcctgtaatcccagctacctgggaggctgagacaggagaatcactcaaacccggaaggcagaggttgtggtgagccgagattgcgacattgcactccagcctgggcaacaagagagaaactccaaaaaaaaaaaaaaaaaaaaaagaaaagaagagaaaagaaaattagctgggcatggtggtgcatgtctgtagttccagcttcttgtgaggctgaggcaggaggattgcttgaggccaggagtttgaagttgcagtgagccatgatcatgccactgcactccagcctgggtgacagagcaagaccctgtctctatgacaaaaaaaaaaaaagaaagaaagaaagagagagagagaaaggaaaggaaaggaagggaaaggaaaggaaaagaggagaggagaagaaagagagagggagggagggaggaagaaaggaaaggaaagggaaggaaggaaggaaggaaggaaggaaggcaggcaggcaggcaggcaggccagaaagcttaaaacaattgtttattctattattacacagtaaaaatgaactaatatcaatggagtaataaaattactaacaaaattagctaagtggaattgttttaaaataatgtttgttctacaaatgcaatgttgaaaatatttattttctcccagagcattcactattataacccaactactatgtgtattaagtaaagaaagctaatatttgacgtttaattcatttatctatgaaactacatgctacatcctaataactgaaactgtctctgaaaaattttgagtgaaatgaatagatttgggcttttaggtccctaactccaagtccaaaagcaatattttgcccaccatcacttttaggaaatgtgacataagaacccatttctgtttatgattgagttttgattaatgagcaagattcttttcttcccttatttgccaaaagcattaagtctttttaggttttcaactcagtgtgtccacaattggaaataaattatcattcaaaaatattcagctacttgtcaaggagtttgaaaccactttagatgggtctattgagtttcatacagaggagataatttctcattttacaaagtcaaaaaaatccagaaaatccagccaaagtgtcctttcccatgacagaaactgtgctgatattcacattccgtacagtgctcctatgctagtaatactgagtccatttcaaaggtctcctttcctacatgtgtgataattatgaataagagcatgttttatgaatgtctggggaaactttggtttgggattctgtagatcatgtggtgagtacataaaaggtttctgtaaggaggaaaaatgtggaataagtttgaaacacatactttcctcttcattgttctttggacttcccaaagctttctaccactcccttctatcatgtgttcaacatcatgagctctgctacaatttatatgttcatttggctttcagatttaaaataacaagggaagtgggaatggataaaatttaagaaaaaggactttttggaaaatacgaaactctaattagagcatgagctgttctcagctcctaatagtaagtgtgtgtgtgatccagtggaaatcaactaacatttgcagatcccctgacagtatagtcagtggattgaccatagctccagtcaaatccacgatgctatcacagagctgcctcctgagctacaagtatgtatttctgactgcctatgacattttctggcaatcatgtagttatctcaaattcgacacaccaaaaccaaattctccatatcatggagacatatcccatgaaacatatcataattctactgctcacaatctttgttagtcgaagtactgttagtcattcaagctagaagataaacactccatttagatccatttctctttttctcttcaggcaggtcttaatatccaagtggccatacatcctggctttcctgggagagttacagtctatgtctgttggtggggaataatgtttacaaatgcctccttttattctcaaataaatcccagttcagacaataaattatgtggtcacttgtgtaatactcttacataactcgccaaccttcctcctcctactgctgtctctaattcatgatctgattatttcttgtcttggctactgaaattaaccgacgtgctctctctgaacttttccaatccatattccttgcacacttgcttttgctaacatctctaagtcctgctcagaatttcccctgctacttcacatccctctcctccatgtagaacaaaatccaagcttcctggcataccatataagcttctccatcacttgacattgatctgtctctccagcctcacacagtcacttcctcaatctcaccaatacttgacattcccgatctttctcccagctgcacctcttcatgtcctgggccagaagtgttcatcttccctggccaaaaaaagtaatccagcctttaaaatgtaccttaaactttacctcctctgtgaaaattcctctgcacacaacgtcaaaatctctctgctctcaactacttcagctgtttatccagactgctatgaagaataatgtcttattatgtggcaactgcctaactgcctaagcctcagaactgcaggttccttaaaggtaggaaatctctcttatccgttattgtattcccatcacgtggcacacagcctggcataaagtcggtaatttgtgtccatttgcaaaagaagacaaaaagtgaatggaaatgcattcattgatatctaagttaattcaaaggtgtttttttttgacggtgtctcgctctgtcacccaggctggagtcagtggcgcggtctcggctcactgcaacctctgcctcccgggttcaagcgaatctcctgcctcggtctcccaagtagctgggactacaggcatgcacccccatgcccggctaatttttgtatttttagtagagacggggtttcaccatattggccagactggtctcaaattcctaacctcatgatccgcccgccttggcctcccaaagtgctgggattacaggcgtgagccaccgcgcctggccaattcaaagttttaaaacttcacattttcaaatgaaagttgaacataccatttttggatgtattaaaatactcatctaaagactcttattactgtttgcaatgtttactatatatctaaaggattaacttaaaagaacaaccagacctttcttcccgttcttttttttctatatttcctttgtcactttaattgaaaatgaaaagattctgccaccagctgtcagacacaggatttgtgtaggaaaattaagctctatttgtttttacaccctattattttggtaaagggcttagcgtactcagtagagtcataagtattctgtctagatatttttacacaatgttctttttagattccaaactgtttgggaggatcttcctaaacaaggtaaaagcaaaatgccaaattccatatttttgccattcttttgaagggaatccataccaagtgttttcaagaacttcctgtcacttcaaagaaagttttagcgtgaatatatagagagggcatgagttgaaatggcaaggagcagatgcatggtctacaaaaaaatccacagaacaaatcctgacatgtcactaaagatgtagaatgaatctctgtctcttgagtaagcagtaacactgtaaccacaatagttttgactggaggctacactgtcaactgttgaaggccactgcacagaacattctcttttagaaatatatttgaaatcagttatatctttggaatcaaggttttggccagccacaaagagtgttctctggccagcatggatatgtacttattagatgatggcttaatgttggtctgtagtaggtagcattcctggaggttaactcatttcagaggctggaaatgggtatgaagaaaacagtttgaacactaactgactgcgaggcatttccattagtgaaacaaatcattactgacaaatagaggctagtttacctccgtcacatgagctcatcactcccagcttctcctttgtggcccagggtccaagtcactaaacatcaatcaagtcagcatcacttttggaacccaaatcaaggtcactccttgcctttggatcttgtccctttatcatcaagtccacaatttcatgcatcgtaaactggataatactatggactctaatattgattaataaatattgagacaattctctgcttatggtttctttaaagatttcagtatttgagaaaaccactgatattcttcacatttatttctaactttgagttattcaaagtaatacgtgtgtatatatgtgtacatgtgtgtatatgtgtacatatctatgccaacaaccatgtttcctatttgtcatgcactgaaatcattattgtatgggaatattggtcatattactgcttgctgatacagtgcagtgaaggtgaatctcttttcttctgccaaatttaataagatgcctaagttttgtagcacttgtattgcaaattggacaattaaatcatgtcttaaagcactgctctttgttgttcacaaaggagaaaacattgagagtcagtcctaaagcaacaccaagccttaaaaggctgggctcagaggctctttacgtctgtcctgacatcctgtcctctctctgcactataagcagtgccgtaagaatcctcacactgaaacacctaaggtgtctcctttgtgccaggcaccggtccaaccaatctggatgtgtaatctcatttattccacacaacagacctaggaggtgatctataatgtttcctctagttcatcatgttaatagaacaaagaagaaaaatgtatgatcatttcactagatgaagtaagaatatttgataaaaaccagtatccattaacaacaaaaactttgcaagtaagaagagtaggggattgtattaatctgaccagggatgtcttcaaaaaccttacacttaaacatcatgcctaatagtatcacttttagtcaccattgtactgaaactctcagccagttttaaggcaagggaaaactaaaacatcaaagatatggaaaggaaaatataaaattctcattatttacaaactagatgatggtttttgtagaaaaaatgcaaacaaatcatcagagaaaatgttataattaacaaagtgctaaaacaatattgctggattcacagtcaatatatgaatataaaatatatttataatataccaacaacaaaaatcagaaagtataattgaggaaaaagtatgccatctataataggataaaaataaacacaaataccttggaaaaatcatattaaaaagtatcatactttctatccaatatattataaaacattgttgagacaaaaattttaaacctgaatacagtggcataccatgtttgtagattggaacactcagtatttttaagatgcgaattcttcaaaatcattgacacgtggatgaattcaatctccataaatatctcaggaagtttttgtggaaatcgaaaaattaattcaaatatgtatataaaaatgcaaaaggccaggaatagttgagacaatttgataaagaaataaaaactagaggactatcattagaaatatttataaatctatagtagttaagacagtaaggtattgtcacaacattgcaaaaatatgtcaaagactctatagaaagtccaaaaattaacttgcacatatatgcattatttagggcaaatgaggcactgtagagctttggggaaaatagtcatttaaaaaatatatcatgatgtatcagagaaggagatcagaaggaaaaaaaaaaaagaacactgaccctctacaacaaaaatcaattctgggtaaaagagcttaagaataaaaggtgatatgatttggctatgtccccacccaaatctcatcttgaattgtagctcccataatccccacatgtcatgggaggaacctggtgggaggtaactgaatcatggggacgaggttttcccatgttgttctcatgatagtgagtaagtctcatgagatctgatggttttataaattgcagttctcctggacatgctcttttgcctaccaccacgtaaggtatgcctttgctcctccttcaccttccgcaatgattgtgaggtctccccagccatgtggaactgtgtgtccattaaacctctttttccttataaattacccagtctcaggtattcatagcagtatgaaagtggactaatacaaaagatgaaacagtggacaagaagacaagaaaggagaatatctttgtgacctttgtatgaaaaaggatttcctaaccaggacatagagaatactaaacctaaaggaaacaaaatgatgaattgcttatctctaaaattaagaaccactaagggctgggagcagtgcgcctgtaatcccagcattttgggaggctgaggcagggagatcacctgaggtcaggagttcaagaccagcctggtcaacatggtgaaaccctgtctctactgaaaatacaaaaaattagccgggcatggcggcagccacctttaatcgcagctactctggaggctaagataggagaatcgcttgaacccaggatgcggaccagcctgggcaacaagagtgaaactccatcaaaaaaaaaaaaacccactaagaagaaagttaaaaatgcaagagtggatcagagtggaagaaaatacttacatgaaaacaaatgatggctggatacagtggctcacgcctataatcctagcactttgggaggccaaggcaggcagatcacttgagatcaggagttcaagaccagcctggccaacatggtgaaaccccatatctactaaaaatacaaaaattagctgggcatggtggcacacgcctataatcccagctattcaggaggctgaggcgggagaatcgcttgaacctgggaggcggaggttgcagtgagctgagatcgtgccactgcaccccagactgggcgacagatcaagactgtgtctcaacaaacaaacaccaaatgacttgtatatactatattaaaagcactcatgcaggacagagtagctaaagagttgaaagagtccttcaaaaaagagaaatccaattgtcagtaaaattacaaaaaggtgctcaacttcttggacatcagaaaaatgcgaattcaaataacaatgaggtatcactatgaacataccagaaagggtaaacttacaaagatggaaaataccacatgacagagagaatgtggagcacctggaaccataatcatgccctactggtgagaatgtaaattggtacaaccattttggaaaactattaatgttttctaaagcttgacatactctacggcctaagaatcccacctctatggaagaatatgcgtcaaacaacatgtgttcgtggggcattcacactggtactattcttaatagctccacatctgaataagtaaatctccatccacagctgaaaggatacacagattgatgtatactaaggacatccaggcagcaatataaatgaatgaattgtttcatgcaacagaatgcattggtttctcataaaatgctcatggcaagaagccaaatacaaatagaaattgagtgattccattctgataaatttcaaatacaggcaaaacaaatattgagttttaaaagtcaggatggtggtggttactcttgtatgcttgagatatttactttttcaatagtagatgtttacattttcattttattacattatgtttaaaattttaatattaataaaatgttattttttaaatatgaatatgttgatattttaattaatcaatataatagatcaaatacttttcttatttaatatttataaaattattaactgtaatatagacataatataatcttaatgcaataaatgttgaataaactttaattaacattatagaaataaaatatgttaatattaataataatattattttacttgcagaatggatttcagcagcttgaaagaaaatcctggaataggaaccactccaacaccaatattgcttatggcacatggcccatcaataccttgagtaaaagtgaatttcagaggagtgaggagaattttaaaaacctaactcttgaaacaatctattctgcttatgtttttaagaggcataagagtgataaagataaaagactgtatgttgaataaattctaaaagtaccaccttgataacagaaaaacaaatattctaagactaaaaaaaaaaataaacaaaaagaatttatgctaaagataaatgttcaaacaaatgaaatgaatctatcctaaggataaatgtattgcagccttaattagaaaacagaaattctaaagaactgaaatgtttcattgtactggaataatgacatgtattatgatattaagatatacccatacaaagtagcatttatagaatgttatgaaaaatgcatgacaatatagcagctcaaacaatgttacacagaaatatgtgtgtatgttttaaaaacacactcacacacacacaccctaactgagtgaaagacagatgcatagaaaatttctgaaaggaaacccaccaaagtgctgtttcaggaaatgatattgagataataggtgactttccccccctactttctaaattatttgtattatggatctttaaaaaataataattaataatttataacaaaaattacagctcaaaataatgaatattttgagtgttttggatataacatcagccaatcagccctctgggaaagaaatgaagacaagctaatatccctgaaaggaaaatatttaagcaattgactgttgtagatttcaagatgtgagataaccgtcaactcattcagacttgtgttcaacaaccgtttgccttagtattgatactgtggcttgacatttacttcttcaaaactatctctatattactgtgctgtttaaagcaagtaagaaataagtaagtaatgtttatgtaccttctgtcttcttccagtagactttaacttgcagttggccatcctgatagaagggagctccgacttccagcgggcgagtgggtcgtcgtctttgaaaagggagttgtgtttgaattccaccttttctagttttcacaagctgttcttctacaacaaagtacaacattctaagttacttgttaaaagtaattatagattcctgggcaagatggccaaataggaacagctccattatgcagcttccagcgagaacaacacagaaggcgggtgatttctctatttccaacggaggtaccggctcatctcattaggactggttagacagtgggtgcagcccatggagggcgagcagaagcagggtggggcgttgcctcacccaggaagcacaagtggttggagaactccctcccctagccaagggaagccgtgagtgagggacagtgctatccagcacagataactacgcttttcccactgtcttcgcaattggcagaccaggagattccctcgggtgcctacaccgccaggcccctgagtttcaagtgcaaaactgggaggccatttgggcagacacagagctggctacaggagttttttttttttttttttttttttttttgttgttgttgttgttttagatggagtctcgctctgtcgcccaacaaagatcaaaagagacaaagaaggggaatatataatggtaaagggttcaatgcaacaagaagagctaaaataaatatatatgccaccaatacaggagcatcccgattcataaagcgtgttcttagagacctacaaagacacttagactcccacacaataatagtgggaggttttaacactccattgtcaatattagacagatcaatgagacagaaaattaacaagaacattcaggacttgaactcagctctggaccaagtgcacctaatagacatctacagaactctccaccacaaatcaacagaatatacattcttctcagcaccatatagcacttattctaaaattgaccatgtaattggaagtaaaatattcctcagcaaatgcaaaagaatggaaatcataacaaacagtctctcagaccacagtgcaatcaaattagaactcaggattaagaaagccactcaaaaccatacaactacatggaaactgaacaatatgctcctgaatgactactgggtaaataatgaaattcaggcagaaataaataagttttttgaaaccaatgagaacaaagacacaatgtaccagaatcactgggacacagctaaagcagcgtttagagggaaatttatagcacgaaatgcccacaggagaaagcggggaagatctaaaatcgacaccctaacatcacaattaaaagaactggagaagcaagagcaaacaaattcaaaagccagcagaagacaagaaataactaagatcagaggagaactgaaggagatagagacacaaaaaacccttccaaaaatcaatgaatccagaagctggttttttgaaaacattaacaaaacagatagactactagccagactaataaagaagaaaagagagaagaatcaaatagacacaatattaaatgataaaggggatatcactaatgatcccacagaagtacaaactaccatcagagaatactacaaacacctctatgcaaataaactagaaaatctagaagaaatggataaactcctggacacatacaccctcccaagactaaaccaggaagaagttgaatctctgaataatagcctaccaaccaaaaaaagcccaggaccagacagattcacagctgaattgtaccagagatacaaacaggagctggtatcattccttctaaaactattccaaacaatagaaaaagagggactcctccctaactcattttatgaggtcagcatcatgctgataccaaaacctggcagagatacaacaaaaaaagaaaatttcaggccgatatccctgatgaacattgatgtgaaaatcctcaataaaatactggcaaaccgaatccagcagcacatcagaaagtttatccatcacgatcaagttggcttcatccctgggatgcaaggctggttcaacatacacaatccatcacataaacagaaccaatgacaaaaaacacatgattatctcaatagatgcagaaaaggccttcaataaaattcagcaccgcttcatgcctaaaaactctcaataaactaggtattgatggaacgtatctcaaaataataagagctattgatgacaaacccacagccaatatcatactgaatggggaaaagccagaagcattccctttgaaaactggcacaagacaaggatgccctctctcaccactcctattcaacatagtattggaagttctggccagggcaatcaggcaagagaaagaaataaaggtattcaaataggaagagaggaagtcaaattgtctctgtttgcagatgacatgattgtatatttagaaaaccctatcatctcagcccaaaatctccttaagctgataagcaacttcagcaaagtctcaggatacaaaatcaatgtgcaaaaatcacaagcattcctatacaccaataacagacagagagccaaatcatgagtgaactcccattcacagttgctacaaagacaataaaatacctaggaatccaacttacaagggctgtgaaggacctcttcaaggagaactacaaaccactgctcaaggaaataagagaggacacaaacaaatggaaaaacattccatgcacatggataggaagaatcaatatcgtgaaaatggacatactacccaaagtaatttatagattcaatgctattcccatcaagctaccattgactttctttacagaattagaaaaaactactttaaattttatatggaaccaaaaaagagtccatatagccaagacaatcctaagcaaaaagaacaaagctggaggcatcatgctacctgatttcaaactacactacaaggctacagtaaccaacacagcatggtactggtaacaaaacagatatatagaccaatggaacagaacagaggcctcagaaataacaccacacatctacaaccatctgatctttgacaaacctgacaaaagcaataaggaaaggattccctatttaataaacggtgctgggaaaactgactagccatatgcagaaaactgaaactgggtcccttcctttcaccttatacaaaacttaactcaagatggattaaagatttaaatgttagacctaaaaccataaaaacactagaagaaaacctaggcaataccattcaggacataggcatgggcaaagacttcatgactaaaacaccaaaagcaattgcaacaaaagccaaagttgacaaatgggatctaattaaactaaagagcttctgcacagcaaaagaaactagcatcagagtgaacaggcaactacagaatgggagaaaatttttgcaatctatccatctgtcaaagggctaataatatccagaatctacaggaaacaaataaatttacaagaaaaaaacaaacaactccatcaaaaagtgggcaaaggatatgaacagacacttctcaaaagaagacatttatgcggccaataaacgtatgaaaaaaagctcaccatcactggtcattagagaaatgcaaatcaaaaccacaattagataccatctcatgccagttagaatggcgatcattcaaaagtcaggaaacaacagatgctggagaggatatggagaaataggaaggcttttgcactgttggtgggagtgtaaattagttcaaccattgtggaagacagtgtggcaattcctcaaggatctagaactagaaataccatttgacccagcaatctcattattggatgtatacccaaaggattttaaatcattctactataaaacacatgcacacatatgtttattgcagcactattcacaatagcaaagacttggtgccaacccaaattcccatcaatgatagactggataaagaaaatgtggcatacacaccatggaatactatgtagccatataaaggaatgagttcatgtcttttgcagggacatggatgaagctggaaaccacaattctcagcaaactaacgcaggaacagaaaactaaacaccgaatgttctcactcataagtgggagttgaacaatgagaacacatgagcacagggaggggaacatcacacaccagggcctgttgggggtggggggcaaggggagggacagtgttaggagaaatacctaatgtagatgacgagttgatgggtgcagcacaccaccatggcacatgtatacctatgttaacaaacctgcatgttctgcacatgtatcccacaacttcattattatataacctgatattagtcccagtgtacttcatttcatcctgttatttagtcatattaactgtctgttttttttttaagtaaaaggtggtgtaaccgcatgttctttcatgttcaagttaatgaacccccccttcaaaatccactggaatactaaaagtatattacatataatccccagtatttaatttggtaagtaacatatattcaccaggcttgaaagatgctccaatgtaaataataagtatgaataatatttctcattatagattttttatagttatgaggaaaataaaataatattacaataccatttcgtgaaaaaagtagataggttttcgtggaaaacctatacgtaatgtggaagtatgagcattatacatcaatacttggtgcagggctctaaacggaaatacggttcagctttgtcaaataaatagtaaggagcaaattgcacctactcagttgacaatgccaacttcagcttcatcactcagcaaccaatctgtgtgccattcagattagtgacagacatccaaattctgacagacattgaaatgaaactttaaaatatccagtaaatgaaatgaaatgcaaaggcaacagtacatcaggttgggtaatggaatacaagaacccattcagtaattagctctttctggcagtaattagctctttctgtcagcaattctgagcacttcccaagagccaggcattgagctaggagttgcagagataaagtttttgtacctgagggactcctgaaataccaccaggcaaatctgctctaatgatggtgcaccggcagtgagcttgaccaaaggcatctgcccagtagaagagcatcagtctgaccagccactgtttctgttcttcgaaaaagtggccacaagttttctgaggaatggagccatgggaatataactggtgccatgtgacgtggtattttgtgaagaaaccaggacacttcatgaaagatgaggcgagagtatgttcacatgttcattattaaaagcatgaacttttttttccctattgtccattaaaagtgtattcaacacatattcgttgcaacgtaggacaccacaaaactgaacaagaaggattccaagccctacgtatcccatatccagtggaagatagagatatgctactataaatcaaaacaccattaaatatatctttgaatcaggtagttcaagatttcattcttagcctaggtcatttcttactgtgttgttgtgtagagtcatgatctgactccagttttagtttgctttttattattttgttttaatttagctgtatctttctctcttgtgccattcctaattccccaaacctgctggttttctttgtatctataattctgattgctttagctcagaatggaccagcactacttgtttctgtcaaccttctttgcccatgaaaacttctcagaggctctccctggtgaagattttccagagtgaatcaaaacacaccactcttttgtgttcctgtattttttcagttttaagtaatttttttcttctttaatttgttcctcaaactcaacccagaagtcctctacaaaacagagctcatcctaatcttccttggatggcaactgcctagctcagaaacacgcacatggtagctgcctaatatgtattggatgaaatgaaataaataaaattatgaattgatggctgtttataccaaatatattaccaaatgctcatttgcctggggctattcggggtgttttatttacgtcaatacagtaatcctttaacatgagattcaaacatgttgcagaaagggcaataaacctaatatttgtttttctttggaaacagggtttcccaccattgcccagattggtctcaaacttctggctcaagtgatcctcccacctgagccccctaagtagttagcagtataggtacatgccactaaacctcacttttgactccaggtgtgttcctggggggcttggttggggtggtgaattttgacactaatttatattcatagagccatcctatgaaattaagcaggggtcagtaaactaaacttttcttaaatggccagatagtaaatatttttggttctgtgcatcatatggtaaatgattttggttttgcagactggtctctctcccaactactcaattactgttgtaccccccaaacagccggacatgatatataaatgacatgtaagcaaatgtgaccctgtgccaataaagtcttatttacaaaaccaggagggggctggatttggcctgtgggccatagtttgcagacccctgagaaagaggaattggtatacactgaagacgaaaaaaccagcgctcaaaaatactaagaattgtatccagtttcacataattcaaagagtgaaggtgaaatttaatcccagggccatcccatgccaaacttctgtttccatcaccatgtactgagtcttacagagcacccatttatatggtttaataattaagacaccaaaaatttccttaggccccaaatttctccctcatccactcactgaatttagaggttgcatacatagaaattctgccctttgatgcaagacttttctgctttctgaatttcaaatagccctctgagagataaaagggtaagctgtgttgattttatgcctataaacaatgtgttatcgaaactcttctaataaaagcagtgaggtttgcattcttgggcaggtgagaggaagacagaaagatgagatggagagaacatgcccaacctgcggtaagacaagatcagtcaaggaaagctgtggaccccagaagataatctacatcaactcaatttttcctgacactggcatgcccaatgaattgtctatccaacggaccagatgaaaggaaaataaaaacgcacatttgttagattcgcatttaggctattttagcttaaagagttcaaatcaatgtgtggataactgagaatcatttattttattttattttattttaattttttttgagacggagtctcgctttgtcacccaggctcgagtgcagtggtgcgatctcggctcactgcaagctctgcctcccgagttcatgccattctcctgcctcagcctccagagtagctgggactacaggcgctcaccaccatgcccggctaattttttttttttttttttttttgtatttttagtagagatggggtttcaccatgttagccaggatggtctcgatctcctgaccttgtgatccacccgactcggcctcccaaagtgctgggattacaggcgtgagccaccgcgcccagccggctaattttttttaagagacacagtctcactatgttgcccaggctggtttccaactcctggcctcaagcaatcctcccaccttgacctcccaaattgctgggattataggcatgagctactgtgcccagccaggatctaagagtttcacaaacccatttatgtttctaataatctgtgataatattgagaactcaccagcagataactaggacagataatcagtttagatagatactgtgtttagatactaggtttaagctcaatgtcaatcttgtcttcctacttgctttatatcctaggcaaactttttctttctttctttcttttttttgttttttaaacagagtctcactctgtcgcccaagctgtagtggagtgcactggcatgatctcggctcactgcaacctccgcctcccgggttcaagccattctcgtgcctcagcctcctgagtagctgggactacaggcacgcatcaccatggccggctaatttttgtatttttagtagagatggggttttaccatgttggccaggctggtcttgaactcctgacctcaagtgatctgcccatcttggcctcccaaagtgctgggattacaggcgtgagctaccgcgcccagccctaggcaaactttagtatttaattatagatgtaaaaacatatttttatatatcttaagattgaaccattgttgctttattaaaatgattcaagaagagaaatccaccaacaattagtgttgctgacacacgccatgggtaaaaaacagataaggtgcatactacaatgctagcagtatgaccctgactttataagaatgtctcctccactttcagtaataagcaaaaatggaatatcatatctacaatattctgaaaaagttatgatgtctgatttacactcgatagtcatagaaattaagaaaataaaatatgtacactatttttcaaagatccaagttttgattaattttatagatcatcaagagattcagagtattttctctcccatctattcttgttctggagagccagaaaataattccagttccatgaggcaactataaaacatttggaacctgtcaaacttgaaaatattcctcctgccttcaaagaagcaagctacctttccattaaagacaatgttatatcatacttccttcaagggattgtttcataaaactgcatgaacattcagccttcacttgaatagaaatgtttatcattaaaacacctagcagcctgcagacctggaaaaatataattcaaaaagtaatttatatagtgacatttactactctccttcctataaaatgtaatttcccttgcttatactgtaacgttgtaattattctttacttctagttggttcatgatgaaatatataatgttcttataaaagtcacagactagtgtttatgagattatatatcaacactgggatataaaatcctgacaaacattcaactgtatcctacataatccgttgaaaagtcaatctcttctgtggaatcacctgagacccaaacaatgtgtgttactataggtactttgcactatgacttcttttttcttacttttcttttattccttttctaatctatgtaagaggaatcagtcctgagaataaagtggtctttgataggttaactaccatatctcttaattaactaccctatcttttaattggtcagctaaagtattacctagttttaaaagataattagcaaaggaccttaacacagggaatcaaccggtcaaatagatttctttcatttaactgcctgttttgttcatttaactgccataattctagtgtctccccacctggctaaaaactctcactggtaaagataattcctttggaatagtcaaccaagtgaaaacacaaactcttggaggacacagttaaaatatgcaaatggcttgtaaaagatgtccaaccttggttgttccaagatgacaccaaaagccatttctttctctcttcccctttagtatttatgaccgtagcagatgaaagcttaagaaagctgtcgtgttagagtgtggcacagagctggttgaatggaaagacagttgcattcagctgagttgcagtcaatttactgagctcttactatgttcctggaaaattcaagaaacctgtgggtcctgaaataattgcaggacctagaaacaaactgaagtgaacagaaagtggtaaaaggaagtctcccaagtttctggtcagtagtaacctcaatggagaccagagatacatgagaacatcgagctttgtaagtggagggagtgagttcaatgtggagtatgttgaggttgagatgcctgtgtgacattcagatacagggaatgacaggctacagacatctggtattagtggagaaatcaaggctggagctgagtcattgagaatggaccatgagtaggtagtgactaagttgtcagagcagataaggtagaaccctggagagctccaatgtccaagagccggatggaggcaggagatcctacaaggaaactgaggtatgagaaaaattaagacatctgggagtcaaacatacaagggtcaagatgtaacaatggggaaagtgtagttaaacaaggacaaactcatcagaaatggtcaataaaattacaatggaaaacatccatcagacttagaaattagcaggggcagatttggtggaaaagtgagattgaaaaatagattgcagaaacttgagaaaaaatgtggaaaggagaaagataagatggtagctagaatgaaaccagcatcaatgaaaggtttgctttagaactggaagctgagcagatcaagccagtggagaggaataggctgaggttgtaggcaaatgagggaataactaattaacttggtttcaaaaatatttttgttgccgtgtttatatgccagggattatgacggatactgtgaccacatatgtagataatccatggtctctgatgtagatgagatttgacttcagtggatgcaggtatctgagttggggaggaatgggtctagaaactgcatggtgaagtccaccacatgcagaaggaagggtgcctccaccttagaatacagaagacaggagaagataaacatggacataagaatagatatgtttatatttatggggaaccgcatggcttactgagaggaagggatttagactagactgtgtactccatgtaatagatatgtttatatttatggggaaccgcatggcttactgagaggaagggatttagggactgtgcactccatgtgcaatgtggctcaaaggagagaaaaaggtttataatcatacttgagagggtagcagaagaagctaattaaagaatatctccctgagttacagggttgtgtggggatgccccaggaagggtgaagaagctgtggatatgctacagagatccagggttccataaaagttttgtctgtgggctggaccatgacaaggctctagataatgtaacctcaacaaggacaagttgaagtcggactttttttctccttgcttttggttctggaaattaacagatattaaattatgggaatttgcaatcccataccagtttctaatggggaaagaatgttgtttattggaagaaccaggagactaaaagacatgcttattttatacaatagatgaaatctccaccaccagtagagaaagacagctcttgcatgaagctgaagtttaaaggattttggcctgagaagggggttggtaaggaatatagaagaatatagtgaaggatgaagttttggggaaagagagaattgaagataactaggtagctgtcttgagagtggaactccaaaaagagagagatctgtaactacgctgatattttctaaagaaaactttgactgctctttacaaagaatagatatttaagaaagagcagaaacataatactaattaggagactatttcaatttataggaaagaaaagacaatagcgtgaacaagcgaaagaactggacagattccatatggaatttaaaattagagacaaaaggactttctgaagaattgaatttctggagagaaaaaacagagaaaaatgaagaatgacttctgcatgtttggcttgagcaaaagggtgaatgttggtgccatttactgagataggcgagcccaggagaggaacaggtatgggcgaaaatccagagcttgtgtttgaacgttttatttgaaatatctgcaagccatccaaggggaggtgctaagtgggtggctgaatgcaggactctggagttcaaagagtggtcagggtgggagggcagggagtcattagcacacagatggtggttaaatccttgcaactcaatgagacctccaggggagagaccagtggcccatccaccttcattctttcctcacgctgagttctctgcccatgcaatgcgcttctctaactctctacactcatccacgctgctgcgtttgtgtggaatgatgtccattccttgtgggcctgcagatcgctcactcttcaggacttcatgagggatgatgtgactctcattccccaactccatgttggtcatttctgcttccactgtttcctgtagttctgtctgtatgcaacacacagatctttgttattattttacatatttatctcccaaattcaaaattaggcacttttaaggcagaaaccaaaatacatcatcgtgctaggaataatgtatgtgtgtgtatatatgtgtgtgtgtgtgtgtgtatgagtatgtatgtgtgtatagttatgtgcgtgtttgtgtatatttgtagacacatgtgtatatgtatgcatatgtgtacatatatacctatgtgcatactatttatagaaaattatggaacatattgctatacagtacgtatatatagtgtatatagtgtattacagtatatagtgtatatataatatagtattcctggcattagacacagtgatgtcataattcataggcacacaatttcaatgcgatgggtagatggatgaatggattaaaaatgaatgaggttactaaacatatttccatgagaacttttaggtaaaatttatattgtaccgagactcacataaaaattgaccatttcaagtccatttaatctccaaagagactatttctcaaacagatagaaatctctgtttctggaccattttttgaagcattatttcaaacaaacctgcccatttggatcctacgttttcccaggggtggaaggtaattatgagcaacccctgtgtctcactctgcaggaccagcattgcctttcctaaattcagacaaatgtttaacacattcttcttctccttctgaacaaggcccactgtcctgatcaaaggcagctatgatgacggggtcctgctagcctaaaaaatcaacatcggaggagcccctgcgacaaacgcctcctccctcctactctcatttaatttgtcccagtttcctgaaaccttgctaggagcccctgcatggcagttctaaccggtatcgacgtttgaacaaagccagaaacatcaagtaacttattctctaagatatgagtgtcatataagaaagactcttctattgttttgctcagttcccagcaaacatactaacatactaggtaagaaaaaaagaaacaaggaaaagcaatatgagaatgatttagtaacttcactcaatggagtattaagtaacctttcaagcagtaattatgaccactgtgtagtactaggaaaaacaggcatgccacaccactttttgtgccccctatccactcgcgtacatacaaacacattattctcagtactatgatttattttggtctctgccttcaaaagtgcccaactttgatttgggagataaatatgtaaaacaattgcacaaaaataagtgtattgtatacagaactagagaaacactgtaatcccagcactttgggaggccgaggcaggtggaccacctgaggtcaggagctcgaggccagcctggccaacatggtgaaaccctgtctctactaaaaatacagaaattagccaggcatggtggtgcacgcctgtaatcccagctactcaggagactgaggcaggagaaccgcttgaacccgggaggcaaaggttgcagtgagctgagatcacgccattgcactccagcctgggtgacagagctagactctgtctcaaaaataccaaacaaaacaaaacaaaacaaaacaacaacaacaacaattacagaaacagtggaagcagaaataacatcaagttataacagtttaactgtacgtaatctcctgaaaaacaagtatgcagaatgcatatgtgcacgtcatgtaaacataaaaacagtcaatctgttaaaatgagacacaataagttttcttaaatttccattacaacaccaaaattgcacctacaatagataaaaaccataagaaagaattcaaaagtcaaactgtttcgtatgtcgtagtttaaatactttagtcacatgcatgtgggtaagaagatttgccatataattattccaaatcaaaaactcactctccctccattgtgccttgttgtgatatggcgcccatcatgtcacaatcatcttgaaaaacatgacacagtcacttactgttgttggttgcatgtgtcgatgtgaagtgaagggacacctttgcactcttcagccgtgtctgtccccagtacgttatggcttgcaattccacaacatagtcacagtctggctggagtttctccaggatcacagaattttgaaactagaaattaagagaatatacccaaaatgcgttacaaaccttccacgtctctcatcttcattgcaaaatctcgtgtgtcattatgaagcatgccaacttctgatttcttttaccaacttttctatatctttgggatctgaaaattcagttttactactgatcaaaataaacttcaggccaggtgcggtggctcctgactgcaatcccagcactttgggagcccgaggtgggaggatcgcttgagcccaggagtttgagactacctgggcaacatagcaagactgtctctacaaaaaaaattaattgggcatggtggtgtgcacttgtagttccagctactcaggaggctgaggtgagaagattgaacccaggaggttgtggctgcagtgagctgtgatcgcaccactgcactccagcctgggcaacagagtgagaccctgtctcaaaaaatataatgaaataaaaaataaaaataaacttcatagaaaggccaaatgtattttgaaatactgtttctaaaccaattattggtctcagataccatggaaataaatcattctgagccctcgccactctgagacaccacctctcgaaggaaagggagctgtttataataaagtaacagagatctatgttgccacatacatggaaaaattatgaattggcactaattgcaattctttgatatctgttctaaattttctaggagcaaatttccaccaaaagctatacaaaagaaaaattaacttgacaaaatgcttcaaggtgcttcattattttctgtcataatgtattgggcagggggctggagggtgggacctgtcagcatttcatcatgtcactttttgctctagattcctaagtgattccccaatttcagctcttccagctcatgcaataagtgtgcactaccattatcatttgtagcaaaatccttcaatataaaaaatggaactgtcataaaatttcataaaaataaagtggggctgggcgtggtggctcacgcctgtaatcccagcactttgggaggccaaggtgggcggatcacgaggtcaggagatagagatcatcctggctaacatggtgaaaccctgtctctactaaaaatacaaaaaattagctgggtgtggtggcgggcgcctgtagtcccagctactcgggaggctgaggcaggagaatggcgtgaacccgggaggcggagcttgcagtgagccgagattgctccactgcactccagtctgagagacagagcgagactccctctcaaaaataaataaataaagttaaaatagtataatggctaaatatcaatgataccaactttttgaggcatgttttataattctgaagagcacagatattgaaatctttagccttgctatcttttcatttctaaacatttatttatggaattcaactttataagtgataggaaaaggtatttatgtaaattttatgacaagataaaggaatgtatactaaaaggaatccaaataactatttttatgcagtaagcatttcaaataatacaagatgcttgttatcataagaatctcattgcagaaaatggttcaatgaagattttatttcttggcatctgacggataaaccactccagatccttttaatcaatgagaagaacatattgtgagacgtggccttcctaagctgttactgctcagtgattagattacagacggaaacacttcgcaacagaaaagccatgaacatccactcttccatttacaaggatctctctctctcaaaaaaaaaaaaaaaaaacttaaaagtaaagtacattttgcataatatcattttctatggccagacaggtaagatggggatcatttaaactgttcctttgatttccagagttctgactgacatttagataggagtaggtcaatggtctaaatgcaaatgcttctgcctaaaatataaaaggcaaaacagccggcatgcccctgcattctgtgaacttcctcggtagaaatgaatgggagggaagctttcctgcatccatggcatctctcagtttagcagaggcctcttttcaggccagttgccttgagttgaaataccctctgtgggaataacaatccttcctccagttcccactcaccccatccgtagtctttctccgcttcttctttgttgggacaagagacttactgctgaccatccagctccaaaagaccttgtaatgatgcacagggatgtccggctcctcggggagatcccaaactatagtgacggtcacactcccatcactgttgacggtggagttggccagccggaggttagccggtgctggtggggcagatggatctgaaatcccagtacaaagacacatcatatgactccacaaaactaacatctttggacatgtaatgactacatggtcaacacgtgaagcattgctttttatagatagaaaagctgaaaacgggggtggaggggcatggtggctcatgtctgcaatcccagcactttgcaaggctgaggctggcagatatcttgagctcaggagtttgaggacagcctgggcaacatagtgaaaccctgtctctacaaaatttaaaaaattagctgggcagggtggtgcatgcctgtggtcccagctactcaggaagctgaggcggaaggagcgcttgaacccgggaggtcaaggctgcagtgagccgcgattagcaccactgcataccagcctgcgcaagagaatgagacactgtctcaaaaaaaaaaaaaaaaagtaaaagaaaggcaaagctgaaaacaagcagttaagtaagatctccttgttaagcctcaaattaaaagatagagtattaaacagtaagataaatttgtttggtccaaatttgtaatacagaaggatcgttttaggcatttccataccacggcaacccagccaaatttttactgtgctgaaattgacatattttagtaaaatatagtacaattcaatgtgggtgaattgacattaaataggtaagcaacaaagaatcaccttttaacactctgaaaagaaaaagaaattcagctcataaaagcaattgttttcatcttcgtgccctgtagctagcaattcttgcatcagttaagaacaataaagggaaatcagaaaagaaaaaaaatataaaaacctgcaccattttttatccacattgcacactggatgacttatggatagcattcatttttgtgattgtaccatttctggtttgtcttattaacaaaaaccttctcagctgtcaagagaaagatgaggtgctggaattaccacctcacaaatctccactgaaaatacatatatgaagaagattaaatataccaaagctggagggtctttacttcattttctattacaaattgagcaagtggagatgctgctcaccaccagtgatttacagagggtttcatttcaagatgccatcacgggaagatgctgtcaataattctaattatagcaccatctgtgttggaggctcaaaaaagtaatatctaacttgatatacatgaagaagactggagaaaaaaaatccttgtttttattctcagtcatttgtggttttggaatgatggaaacataacttattttttgaaatttcttgctttcctctatgatatatcatgtctggacatttagttaggttagttcctttattttctaaaataagaaagcttcatagtattttttaggtaagaggctaattgaaagcatattatgtgatactgctagtcaagtcattttttttttaaattaacttttattttcagttccagggtacatgtgcaggcttgttacagaggtaaatatgtgccatggtggtttgctgcacaaatcaacccatcacctaggtattaagcccagcaaccatttagctgttcttcctgatgctctacctccccacctcccccaagcaggccctggtgtgtgttgctcccctccatgtgtccatgtgttctcatccttcggctcccacttagaactgagagcatgcagtctttcgttttctgttcctgcattagtttgctgaggataatggcttccagctccatccatgtccctgcaaaggacatgatcttgttccttttcatggctgcatagtattccatggtggatatgttccacattttctttatccagtctactgttgatgggcatttgggttcattccatgtctttgctattgtgaatagtgctgcaatgtacacaagtgtgcatgcatctttataatagaatgatttatattcctttgggtatataaccagtaatgagattgctggatcaaatggtatttctgagtcaagtcattctcaatcaacatcaggaatctctggaatgtccaagacttatactgggatatgctgattccctgagtgcaggtgggacccaggattatgtatatcttatatgaaacacacaggtaatatgaggtagatgacctgcaggtcaaaagtactgcatcaggtggctcctatgaggtctgaacatcacatatgtaaggaggaaatgtatttttcctgtcgttattggaatgggaagcaccccaatatggaggtctggcagagccatgtgaggactcccccagtcatcaatattcacaacactgctgatcacttccttctctaagaaatgcaggcttcatttggtgttcaggacactactctactggatttttttttttttttttttttgagacagagtctcaccctgtcacccaggctggagtgcaatggtgtgatcttggctcgctgcaacctctgcccgcctgcctagtttaagagattctcccaccttggcctcccaagtagctggcattacaggcacctgccatcatgcctggctaatttttgtatttttgtagagatggggtttcaccatgtttgccaggctggtcttgaactcctgacatcaggtgatccactcgccttggcctcccaaagtgctgggattacagatgtgagccaccacgcctggtctctactggattttcattcagtttcaacagaagctatttttcagccccatgctccatgatccttaacatctcataatctctagacaggagagtgttctgcatctgaattcaggggcctctctcttctcatctacactcactctctagggatctcatcaggtgtcacagttttaaaaaaatctttgtgctgataactttcaaattgatatctttaacatagactatgctcctgaatgcagatccaatcattcaaatatcaatactcaaaaaataccttccagtagctccacttggaggtctcagaggcatttcaaaactaatgtgtcccaaagaaaaatcatgatccctatgcacagcccaccaccaacacatatcctaccacacacagcccaccactgacacccccatctcagtacatgggaattgctctttccagttgctctggccccaacccttgaagtcatacatttattttccactcatatctcttgagcaaattgtgttagcactaccttcaaagtgtaacaggaatttaactgccttttaccacttccaatgccctgggccaagtgccaagggctctccactgcctccctagaggtttttctgaatacagcagtctgatgattctatactgccagaccatgtcactcctgtgcacagaatctccttacttagggtaaaaacccaggagtctcctgaatgccttgcaacccgtgcctcagttacctcccagagcacctttcattttatcacctccacccctcagcccagccacactggttcccatgctgtttcttggagaggaaaaccgcgatgctactgaggcttttcctctccctttgcctaaacgctttccctgatgtctccacggctggctcctttcctgctgcaggtggtgaccctatttaaaatagctacatatgctttgctccatttaccaaaaaaaaaaaaaaaaagtcaccatgattatgccttgctttattattctccaagcccttattactaactgttatggtaaatattgagtgtcaacttgattggattgaaggatgcaaagtgttgatcttgggtatgtctgtgagggtgctgccatggagattaacatttgagtcactggactggaaaaggcagaccctccctcaatctgggtgggcaccattccaatcagctgccagtgcagccagaataaaagcagggagaagaatgtggaaattttagactggtttagtcttctggcctacatcttcctcctgtgctggatgcttcctgccctcgaacatcagactccaagttcttcagctttgggactcagacctttgaacacagaccgaagggctgcactgtcggcttccctactttggagttttggggacttggactggcttccttgctccttagcttgcagatggcctattgtgggaactcatcttgggattgtgtgagtcaatactccttagtaaactcccctttatatatacatctatcctattagttctgtccctctagagaaccgtgactaatacacaaactgacttattaggtaccttgtttgctgtctgcttctactcacgataatgaaagctccctgagaggaggaatgtttgcttgttttttcacatctgtatctccagagtccagaagagcacctagcacacagtatgtgctcagtaagcaattgctgaatgaataaatgaaggacaggcttctaaacgttagctttgatttgtaatgtgatatttcagtttcaggttcaaactctgtcaatcagaattgctagatcacaagatcctaaagtgaattgcaaaatcaaaggagtgttcttcccagtttgaaataaaataattaaagcaacacctcttcctctggtgtaggaatcaatccttaacctacaaaaggtagttaccaacctttctgggagggaacctagtttacaactgaatcgtcacttcaaggcaagagaagaattaaaatgtgtgaaaataacagccgttcgtgttctcggcaatgcacctgaatgtctatatgctgaaaataagtagtcacatgaatattgcagatattctaggctcagaaggaaaagctcaaaataatctcctcttctaaagaaactctaacatttaagaaggtcactgaatttgatcatcttctttagtttatgttattcattacatcatttcctgccctggaaaatttttcttagatgttatcataataatctagaataacatcatctattttatgaaacattatgaaacatgaaacaacacaatttatgaaaacaacatttgagaaaacaatgcattaaaagatatgaattaataatattttctttacatttttctcaaaaggaaggcccattttgaatttacaataccaaaatggcaaacttccattaccaagataaggtactcccatctctttctcccccaaaataatcaccataaaactgtaaaaccaggtcagacatggtgacccacgtctgtaatcttagtgctttgggaagctgaggcaggaggattgtttgaggccaggagctcaagaccagcctaggcaatagagaaagaccctgtctctacagaaaaaaaaattttaaattagctggggcatggtgttgtgtgcctgttgtcctagctactcaggaggctgaggcaggagaactgctttagtctgggagttcaaggctacagtgaggtacgactgcaccactgcattccagcctggatgacagagtgagattctggctcttaaaaaaacaagaacaaaaagaaaacaaaaccaaaagagagtggcagcgatcacctgtttgttgccgtgattctcctctgtaaaccagccattcatttatccatttattcactatggggttcaggtgagacagggtcaatccagtttctctaatctgaagcattttactcagtcctaacaagtttctatatctaagtcattctctgccttgagaattggttccctacgttatgaagcaaggtgtattcattcggctgaattatacagaatgttttctttcattatgcatgatattttaattgttttagaattttgaaatgtagttggagatttccatgtgaaatttatatatatatatacacacacacacacacacacacatacacacacacacacacacacacacacatatatagatgtacatatgcataaatagacagtggctgatgagagccagagagtcagagagggaaactctatacgttattataaagccctaaggaattttacaacttatttcacctttttttaactggggagggttttaggggtcagagaggtaaagatatatgtccaaggtcattcacatcattgatggcagaacaaggagcgtgagaacaaaaaggaaaggagaaaaacggggttgaaggtctaacaatacacacctctacatgccacactctacatatatattccaccatcaaaataagggacaatatccctacagaatgtaaaaattcaaagccttttaatgggaaaagtgtctgttacaataggctagtgcaggcattgataggccttttctggaaagggccagatagtaaagattttaggctttgcggaccatatggtctccgttacaatcactcaactctgccctcatagctcaaaagcagccacagacaatatgtaaacaaatgagtgtggctatgttccaataaaactttatttgcaaaaccaggttgcaggccaaatttggaccctgggccacagactgctctcccctagttgggagaatttcaaaaagtgtgaaaccattaggtttaggaaactcgacatgagcactgtttatccctaattttacaaacatacagctgcattttgtctattaaatgttaacattattgttcttattttagagatggggaaattgaggatcacagtttgattcactacttcaagagcagagtttgatttactacctcttcaagtgagaggatgggaggcacaccacaagaccagtgctctcctaacccttcctctgagtctcaaatctgggcattttcccccagctcacttctctttctgtttgatgccaactccctccttatgatcttcacaattatctgcagaaacacactgcagagagcaagcacattttcagagataactgaaataggaaggctgtattagctccttctacgctatacaattagtgtgattaccaacgtaaaatatgctaaatatttagcatgtatacccaatttcagccttggggaaaaatagttccttttattgatgatcacatgtggtgctttcaggagagaaagatggaacatttggatttcagaaagataaatttcaggtttcatcacttaacctcttgtgtttcatgccacaaacaggcaaagtaacaagcacgaaggtttgacacaatggaaagactttgagcctatgttgggtaaagtgacaataaaatcacttatcacccttggagaaatgcaggcctattattgcactgacatgaatctcatgggaaaagaccacttctgcttgtcccagcagaaatgccatcactttttctgaggcaggctcctctaggtttaagacaacactatttgttaaatacagaaacccatgaggccataaagagagcaacgattatagatcatcataaagaaacatgcacatgtgcacatggagaacaatacctatttcaagaaaatgaatgttgattttacttatttcatttctaccaataatgtctatagattaaacttcgcactgaaacgcatcataagaacacctcataaggtatacttatggtatatacttgatgtaactttggtcaagtgcagttatattttaaaaacaataatataactgtgtcacaaagttttcaactaaatagaagtttgcttctaataatatttaaacctttttttttctttccagacttggcagttggggtagtgttccttctcccttaaaaaaaaaaaaaaacttagcaaagctgctgaagctacactgcaggcaaatttccaactattaaatagtttcaagacatatgtacagccaagccttttgcccattggaaatggcacatcccgagcagctgtggaacagagtaaaaagtcatgggtccccacggggcaacagggaactttattaccatcagtgatgtctgctctagttttactgacactctgtaatgcatgcatggaataacatccagtgtgatacttatatgctgtgaaaacaatgctgtctgcttccttttcctttgtaatgtatcctatgcacatggagaaataaggagaaaaagatggatgaagaacttggaatttagagggaaatgaatataattactaaaagataatatgctaggttaaggataatttaagttggatttttatgtttcttcataagatcccttaaaagtgtgttattttgtgatgtcaaattgatattgactaatttcaaatgaacaaacatgcttgcccgcttttggcaacatatcaaaaaaaatgaatttggattttgccttatacaatccacaaaatcagaactcttccttcttttactacccatattgacacatagatgtagtcacagtagccagaaacaaacacattatttcccaaattcagcaaactggtaaatactattttgtaataggtagtagctacttagcaatatatatttccaatcctaagcatgcaatattctgtatttttgtattttgtaattttgtatttactttatttgtaaaaatacgaatgtttatttgtaaaataactatttttactcatttgataaatatcagcaatatcaaggaaaggttaaacaccaacttactgaaaaagataagcaactgcaacatggaacccaaaggtgtttttatatttgtaaccctgactccaaattggtcattcccaaaatctgggctctctgttggttagacattagtggtcttctcattccaagaagtgaacaataatgtaaagctcgtcagattttgggaaatgagagaggtgaaaataaaagaaactagaaagggatgcctgtgtctgattattaactttgtaccatagaggaagaagattaggaatatttagtaatgtgggaattcctttcatgatttcatcacattttattcatgaaactattaatatatttattttaaaccgtaattcaaaatgtattagatccactctgtaacaggaatcacgctgatgttgagttaaacaagaggtaaacaacagatgttttcagggtcccaccctgactttcttgtgctaggctgtttcagggcacaccagctcaacttctgaatgccctcccacacctcctcacctaaggctgtgtctgggctcagagcaagctccgccagcatgcagaccagatacgctaggaacagctgcagacaaagactgacttgaacacccttaacccccctccagcgaggagttctgaggtgtgtgtgcttcacgctagctccctgagtgccccgtggagaggaagcttaggttgcctatggtaaataattcaccctttactgtattccttctacaccctgtcctacttcccttcctacctaccacattcttggatcacttcctaagtaaactgctcacactcaaagccttcacttggatcaggttctgaaggtgtctgatctttgatgggcaatctctatttgttgaaatctgtgtttcaaagcagcaaatatcaacttatgtagcaatatgcagacatatcaacatctcgtgctcagaggtttcatgttgtttgttccaaatggaatgggatagaaaactttaggtagacccccaggaatgacctgtgaaggtaacttactatgtgcaaagatgcagtcccacattctaaataaagagacaaaaagtagaaatgagcactaggcattaatctattaaactattatgcatctttaatttcaaagccaatttcccatctcaagtaccaggaagaaatacagtatttaagtaggcaaatataaaaattatccaaaactcttaaaaaattaatgattttgcccatcctatatttatgcattttttctgggaggggtaagagttagcaataaaaatactcagaaatggtattccccaggaaaaggaaaagcatgaaactaatttactaatctatgaataacttagaattttctataaaaatagttaatgttgagttaggtctaagttatgggaaaataaatgagttaagaagaaattaaatagtagtcaatccattttgccaaacacggactaattttgtgttttaaaataactataaagaagataaggacaagaagtttggcttttccatgaaaatcagttttatagtccatgaatcctatgcagtgagcctaaactaactggaactcattttacctatttttgctgtttaattttacttttatttgctgagatattcatggtagatgaaaaaaataaaaataaaaacccttcctgctttccttgacccagccttaagttatcaacactgtctctctacccaaaccaaatacactagataattgcttactccttgcacagactactaccttggaagtggtgactgttttttaaaagtaattttaaaccactggaagactggcacagtttcaattctggagcaaacagggataaatgggcatttattgaatgaaaatgcaccattttttgaaacaccacggtcattgcagttattatgaaaatgttgttctatctctcacgttgacaaatacacctgatatggtttggctgtgtccccaccgaaatctcaacttgaattgtatctcccagaattcccacatgttgtgggagggacccagggggaggtaattgaatcatgggggcaggtctttctcgtgctattctcgtgatagtgaataagtctcatgagatctgatgggtttatcaggggtttctgcttttgcttcttcctcattttctcttgctgccaccatgtaagaagagtcttttgcctcccaccatgattctgaggcctccccagccatgtggaactctaagtccaattaagccttttttgttcccagttttgggtatgtctttatcagcagcatgaaaacagactaatacaacacccaaaatttacatttccatatgtctcaatttgaggtgcatcccagatgttagttcttgcagtcttacaaaccaaaaatgtaagcactgaattcatagtagattccattatgttttccgtaaagatgcatcacagaattatgggagtttaacaaatcagtaaaacggtggaagacactccctccaggatatgtctaaaggagacttaaccagtacactaacaagatgctgccacatctttccctacctttctcaagctcatcaaatgtagaaaagagcctcactgcgaaaaaatgtctttaacaacttttttgaaatatgtaacttccataccataaaattgtctcatcttaagtgctcactgacattcttatatttactgtgttgtgtaactatcaccatcactgggttctagaatgagtccatcaacccaaaaagattgatccttcatcccttactgagaaaatttaaaggtagaaacaacaacacaacattttctgtctttaccttctctttttattactcttgtttcatttcctcatatattgaacaaggatttgttgggcagctactatgtgtcaggtactgttctaggcagtgggaataagaagtaaaaaagaaaacacatctggtcttatgaaacacagaaacagacacacacattcatcctaattgagtgcaaggagaaacagtgcacaagattaacaagcaaaatactaaggcagggtagacagtcataacagaaaataagaacaaaaatacaacacgggcaacgtggatttgtttgcttgtttgcttacacatataagtagcatggctaaagatggttttgctggaatagagatatttgtataaagaaggtgagccagccagcctttcaacaatctgaaggaagagcatatccccggtccaggaccaggtaaatgccaatatcctgaagcaagggaaagattatagtattcagagaacacagaggagcctagcatgttgagcaggaaaacagggagggtagtgatgaagtctaagaggaaggagaaagggggggtcaactgggtcttaaaatccattgtaaagaacatggcttctactctgaatcagatgggggaagctgctgggacactttgagcaaaaaactgtcgggaagtggctcagattttagaaggatcactcaggtggctgcgttgagagaggactaaaaaggaggggatccagaagtggaaatccggaagcagggatgagaggcctgggtctgaaacccaggatccggaagtggggatccgaaagcaggaatgaggggccaggatcaggaaacaggaatccagaagccttaaggcagaagccaggaggcagaagtggggatgtgattaggaagctaatacaattcccagttaaagacagaactgagcggattaggggaaacacagggaaaggtgaatcaaggcagatctgaggatttgcggtggcttgcagaaaatgtttagagtggagaatgactgcaggcctcttttgccacaaactgctgcaagagcagcattgccgattactcaaatggaggctattgagagaaagagtgcttaagggaaaagtccttaatttccttggggatgctcgtatttccagaaagagagtaatcatttgtcgatcactgtgactgctatgcttttggcctttttttttttttttcccaaataggcttttttctaaggaatagatcaagtaccaagctacaggatactcccacgctataggactgcagttcagatacatgggtaataaaagaggcaaaagacacagaattaactttatttctacctttaaattttcctggtaagccatgaaggatcttatcggggtgatgcactcattctaaaactagatgatggtgatggttgcacaagtcagtaaatactaaaaatcactcaactgtacacttaaaataagtgatttttatggtatagaaattatatttcaataaagttctttaaaacatttttcccagtgaggctgttttcaacgtttggtgagaatgagaaaagtgtggaaggatgttgtcccaccttgttagtgattaaatctgctttaaagatatcatagagggaatgtctaccaccctttggctgatatgttaaactcccgtcattctaggactcatcttcactgaaaatataatggaatcttccatgaattctgtacagacatttttggtttgtaaaattgcaagaactaaagtttgggatgctcctcacaatgagacatatgcaatgtgaattttgggtatatttgtaacagtgacagaacaacattttaatgaaaactgcaatagttgcattttcattcaataaaagtccacttaaatttgggagatgcagcttccattctagattataagttgctccgatatactaggaagtgtcaggacagcttggccttcctactttcagttagcaccctcatgaccctggggctgtcacaggatttctgcccagatcctgaggatcttgtgatagtaaggctctgtaacaaatcatgagagcaaaaccaccttggtcacctccactaggcaggaggtgccactgcaactcttacaggaaattaattcagcatctgtctctagaggctgagaaccacttctgtctgaggtctgattttgcagtcttattcacagagcaccagcccaaatcctgcaggcaactgaacagatggtaatatattttgaccagaacatctctggatcgcatttgaaccatgaaactcaaggtgaagcattctgaggctttttattgataactacctcctaacccacaattaattatttatttcacttgcctctctaaattttcaaatcacttggagacagagtcttaagacaaggtttgatgtctttatttacaatttcactttaaagtttgcttagttcatgaatttgcctccctgaggagaaaaaaaaagtgttttgtttgtttgtttgtttgtttttaaaaaaaagaggcttttaaatgtaaggttacagtatttgttaatgtcccaataaataaatttacttaaaataaaataaatttaaattagcttctgtgtaagaagatgacttgttattagtaagagactaatgtaactaatctgtatttatgaaaccagatccttataattagtcaagcagatgtctaattaatttggaaggtacacagccatatggatgcaactagaaaaataaacttgaagatattattaatagctggtcaaattatgtccttcaaccgtcacagattaaccacaaatgtaacacactgttgatctgattacacagaggttttaaaatatcaaggcagtcagaactgaacaaaattatagcaatgattaaatgactcaggaggggtttaaattctagatgttatgaagcaaacgtaggagtcaaattcactttcaatttaacaatcatttcaagaaaggctattttgtctagaatagctaaaattcagtctttctctttgaaaatcaattgaatggtgtttgatacagaatatcttaaagcaaaaactcaacagatgttgataatgaaaacccccccgccacttcaaagtttaaaaaaactcccttatgttatcttctatgatatactgcaggtaaaattccaattttgtccttagccataaatgtacatggtaccttcaaacacatctggtcccattctctaaaacagcaaagccacctgttgactaactataaatatgaacatagagacagtgaatctgcattccatgtgtgcctggtagcaaggatagtattctgtgtctgggaagaaaaggaagactgacctttggaagaacggaagtgtttgctgggggcagtgaagcctcgagttccatgcacattcacagcagccactcgaaactggtaccatcggctgggtcttatgtcagtcagttgaactcgctcgtctgtggtctgaggggacatgtcacagagcacagggaacatgtcactttttattccgacatgttagttggatctgtttagaaaaatacactaacccatcagccaatgcaactcagtctgtcttccccctgataagaggggcttatcatgcccagttatgaagagagctgtcagggaacaaagaaccactgatatttcaccccaaagaattaaacatctcttgaagtcaaaaccttatgacaagagcttgggctatttttaaatctggtgactaattacagcatttgagatattcaatcaatagagaatatttatgtatagtaattgttacattacagcaagaagatgaaatcatcttcagattatagaaagaaaatgtctttttaactcacatgccaaatataactgtaaaataggtataacaacccacatgcaacccactagcaatttctggaagtaaagtataacccaagccactgtttaaaaatctcttgagtaagtcacataacatctatgaagaaccagtcctgatctaaaagggtgagatgtgttagcatatatttgctcaataaaatgcccaaaaggaaaaaaatagacactggggaagatcagaaggttttgctgtctctagtgctacaattttaagatatcaaataactttaacagtcttcatactatatacctgctttcaacaatgttctgtgttttgtttccattggtagatctgaaaacctttgccttgaattccaagaaataaccatctacagtctatgccctcatctacaccaggtgccgaactcaacttggatctgtggatgaaactaaggaaacaggattggatttgaacactcccaaacttcagattataataacctcagcttaaaataacttaatgtgaaaatgactgtcacgtttacatcaatatctaaaagaagctgaacatttctgagatcaaaggaagaatatgaactcttacatgtggctttctacctgatttggcagactttgagaaaacactttcaacttcatcatttagagtttcagctgcgaatttaaaaagcttaaagtcagcatggtatccacagcgtttagcagagaaggaagtactacatgtagcactaacagtaaaaaataataccagcaacaataataaaagagcttttcactttccaaaaatcttttggagataaaagagatggtcttattgctggttactttcataattctttaagtaatttggaaaaattacaaatgaatctgtaccacgatttatgaaagcatgccgtgtaaatcaaatggaatttcaggctgtattctgattagctttatgttttactgaagcaaattttttttatataaaatataggtatagaatagaattactaaatttatttgaccaggttttttttttttctaatttaatgttgtgtttttacatcaaacttcttatttattttggggtctttacattgttttattttagtgcttaacccctttgagatactgctatttagaagatattcttcttccaaacacctaaatattgacatttattttacatttactgaaaaaaaaaaaaataggaatctagtccttggaaaaaatgatctaatcaacataaggtgagattttttttcctatagacatagatgtggagaaggcattttagttgtctaaaggcatgaaacagtttcacattcagaatctgttactttttatatccatgtagggtttgtgtgtgtgtgtgggggggtggttagcagctggtactggatttaacagctcttaaaaagaaagaaaatattttgcttttctcatcaacaagacagaagaggaggaagcactctctgggagtgttgccatgcaggtggtatatcagtttttaagttgactaagacaaagaagaaagtacttagtgaagatttatgggctgctggctatgtcccactaagtaattttgtgatacaaatcttatgccatgctcctaaagtctgtgggtggaataaaggtgtaaatgcaggagaaacagaagagaaggcatttagattattaaatgtcaaattagtccttataatgttgcatttcccttcctctagttggctttgagtttagctgaggaaaatgtggttcttggagaaaatacatgtgaataatcaggttataaaattatctcccttccatgtgtatttgaacaaattaagccaatggtcgagtttccgagcacattcgtttgtatctatgaacctcatcctctctttagaagaccccatgatgttcatttcatatctgagtaatttatttctgtagtcaagctattttgaggcatagcaagttaattttttgtgcgtagctatgtagcagacactacctccaggatgaaaatcaaagtctatatgaggttcttacctgggccactgtctgccagtgagtggcgtcatcttcgctaggatggattccataattccatcttctttgtaccacatagatcacaggctcaatagaaatattgaatttcgaggaccacttaacctccagctgtccagactgcagttctgtaaatcgtaactcttttctgggcttcagggggacacctgaaacaggaccgtatcaattaaaacaatctgcgtgtgactcaaattgaagtaaaagttgaggaagaacaaatatggaagagatgaatctgatctgatgacaactgagatttcctttcataaaagtggcctctccatacagggtttcacatctgaagtcttctgacactcagttcagctatttgctcctttttcttttaacttgtcttttttttcttttttttaataagacagtctaaattggttcctgattctgtaacaagtggcttattccctagtaatctctagagcaatcatttcatgtgcattcttttcaataaatcatgttacaaggttgtttcatttgaggttaacatggaattcacactaggagatcattataaagagtttcaagtcattttcccattttttatcatgctctgtgtctattgatatatcctaaggtcattataacatggtttccagatttgatcttccttctttctcagggagtttttcatttaaggaaaacactgcaaagcaaaatctcttcatgtgaaatctcctaagagtgatttccaaagttcaagtcttttggattccgcaatcaattgctcaagcattcccctatatatagtcttaatggcttaacattggaaaataatgaatttataatgtttggttttggcatgagtgagtgtgctgcttcaaaagtttctcacaggtgtttcattttaaagtagttaatcattctgatttctttatcgccttctgtacatgcaagttgtctggcaactgatacattgaagaaccacagttcaaaatagcaggcatttcagaaagggaatttgtaaagaaatttgtaatactaatagaatatgcaaaactaactgaatgaaatagaatctatggctccatgatggtgaatgccatcaacaccaagaacaccaattaccattaatagcattttctgtacacaatggtcgtttgctgaaagcattgaaaactcatttcaaaagctagttaagaatgctctatttcttcttccattttgtaagtttaaacacagaagaaactggaaaatgtgcaaacaccaaatgcaaataaggtttgatgcatgttgacatggttgaatttcaactcctatttcattttgatcttaattcatggtaagtcttgtttacgaaaattttaaagtcatcaaatatttggatggatggaattgaataatttttttaaagcatatttatatatggtcaaaagtcattaatctaaaaaaagctattttctggagaaaatgtttaccatacctattgcagtctcctttattactgatgggtcatggctgagtagtgacctttagtttacaataaatttgtctcatctgatcctcactgtgagtttgtgaagtgggtaaagggttaattatctacatgttgaataggagataactgaatctaaggaatattaaattagttgcctgggactacaatctgatctcaggtttctctctgaattatctgctgctttctacatttcatattagaaaaggccacatagagagatagagaaaagagatggttttgatagatatgcaaatcccttggacattcttattctaagatcctcagctttcctggtggatctggaacttcaccaagtcagtctttgactcctgttctgccatgacatgcatttatttcaagcttgtattgtaaacttttcatctcagtgcataaccatagcaatgggggtacctagacttggatgattagcatactgctgctaagcaaatgtttttccagtctatctctaatccctggctaagctgcagaccatcttttccacctgcctgctgaatttctctgtcccagatatgccccttctcctgggatatctatctttatgacaactttattctttaggatgtctaagggatcttagaacctttttgatatgttcttgcagctaacaacatttagttgtcttactgcatagtacattttcaagaattatcaaatcattttgtctccatgatggccacctgactttactcccttccttgttcccaacctatttccctgcatctcaatctctttttctactgtccccttattggtactttggggttatttttctaacgtagaagcgaggttctctccttcagtttcccaaactctttaattgcatcccattctctatagaatgaagggaaacttcttggcatccccttcaaggcatccttcttcataattggctaccatttatttgtcaatctatctcctggtacatctttaattttttgtcacagatattatctttaaacccagctttcctacaaatacactgccaggtccttaataataccatggcctgtttatggtttttttgtttgtttgtttgtttgttttcattctgaaatgtcttgccttctgctttctaactgtaggcccttgaatatttccaggctcggaccaaatgccacccctctgtgacacttcccctaaacttctcaattggaaataaaggctttattcttttgccccccttcaatgttgagcctgtaactgtcaagacatgcatttaactgcctcttgctgcagcaaattcatttaatgatgcctgtctttccattaagccacagcccccagaggtcaaaaaccatgtctccttcattcccgcacctcacaatgtcccagaagagaacattctgcaatagcaaatgttcaatgaacagtcaatgtttgctgaactaatagccaaacccactttcttattcttcactcaagaatatgtctgtggaaataagagactagtgcaacatttatgcaaaccactgcaacaatggtaatccctactctgtttgaaagtcacctagggaagggtgaagatttatcataagtattctgtactgccatctttatcatatattgtttcaagcaactcagatctcttttccagcatggtcttattactcacatgtacattcactctgttttttaaaaagataaataccagaaaataaagcaatgccaaaatgtttacaagatagaacgtttttattacactgaccataggactttcccattaaaaagaaaaaaaagaccaattcctgatcggagagaaaacccaaagttaattgattttaatagaagcagctctgtatgttttgtgtcaagaaaaaagccaccaaaatttgttcagagtgatgaaaaaccaatctcaacaaggtgatcatttagtatcattcttgcattgaagggtggcctgcatatgccagacaaatagttctaccgaaggggataaggcgagggagagtagccgcagagaacatttcatgatttacttgattccttggtgcatagtaaaaaaaaatgatgaccaattcttcaaactcatagagcacattctccgagacttctgaatctacctttctctttggctttccaatgtataatcttctagagtaaatatagctacagtaaatagcctccgaagtgacctgaactcaccagaagccaatccaagcagcccagtgccctcgctgtaaggttttaatcttgaatagcattcaaggaccaacagccttaatcaaatgtaatgagcatcagggcgatgtcagttcaaatttcttcatttaaaaatctctttaattatgatgaagcatgaccctgcaatttgcatgttaagaaatggtccatctgctttccattaaagtcagttggctcctttgattggaagtaactccagcgctctactgtaattgtgtgcagatggggctcaacccccctcaagacctccagccctcactgccggggcgcacagtcctcactggctgaaccagcatcccaactgcataaccagatgtatagactggatctcttctcaatgtgttttttattatgtaaatgattagcatttttctctttaaaattacttttgaacaaattagtcatctgaaatctaaatgattctgttgaaaaatttacaaacgttatcgtatggcaaactgcaatatgtgacgtccagtttttttctttgaaatgcaagaaacattctgctgaaatcaaaggaacagaaacccaatgctttttaaaaatgttgaaaatatatggatagaaaaatcaattaggataagcaatctacagttgcatactcattgtgagattttattactattaatttttatcatgaatctaaatgatataaaaatgtagcaagatgtattgttctagtgatttaatcactacttgatatctctcataaaggtaattagaactctagaatttgtatttacatcacattaaggcattgggctactggatgcaaaatgttgaaaatttatttgtgagaagttgtataaatctatttccagaggtctgaagtttcactatttgatatattaattatttgtggaaatattaaattaactctatgatcgggtctttttgaaaagaaacagactgaagtacaattaattcttggtttatccatggcaaaaggaaactataggtcacaaattagtctgaatctttacgtttgtaaaattttttaacttttctttctccctgcccaaaccatttttgctacagttggaagccaagagaggcagtgggatttggcaacaaaatagtaaaatatatcaccctctggaggaaagattgtctcaccaagccataaaatagacttagagaggaaatagaaatagaaaggaaaaaggaagtgagtgcccccaaatgcactcatttgtattctacctgtagactttctacaactatatgaagttttgcatttcatagaactagtaccagcaggcatctccaatcatgttaatatttccaagccttcattttgatgctaataattttatttaaaaagtaaaagaaaggatctctgctgtttgttttaaactatagtctatgaaggttaacttacttccaggcatcagttaagtgcagttcttacagcatagcccaaaatcatattttcaagacacccatcgcttttaaaaactcaagtgaccagtataaaaagctcttgaagctataaaaccagtactttctatcttcccttccacaaacacagcagaccaaacagaaagtatgtatgagtttttataatttaaaaatatttttaaaaattaattcattaagtaataaaatgaaatatatacagaggttggtaaatgtccatttatttaaaggttagaaaaacaatttgcccacttaaagagtattgtgagcatgacaatctcagtaataaactactggaccatgtggggggttagtgtcacatggatccttgcaccccaatgcccattatagatgacagcaaatagtaggcactccgtaaatgtgtattcaactgaaatgtgtcaatacttctccatccaagtgacagcagccccttgtaaaggtaaaccggggaaatgttaagaaaatgttatttcggatttccaaacagcactatgcaacactttaatacataaaaaatgaatgaatgaggaacttcaggttttcaatatttatcccatagaatgtggttctccatatagcacactctgtatctagttttatacgcttcaactctacaatgtaaaacaatcccatgttattcattagcctaaaatgattcataaagtagtgattttgttggattaaaaatattctatattgacaaatcttttagttggcctattagatagacaggtggataacagatttagatacattttgggacagggtctcactctgttgcccagactggagtgcagtggcatgatcatggctcattgtaacctcgaattcctgtgctcaaatgatcctcccacctcagcctcccaagtagctatgactacaggcacatgccaccatgcctagctaattttattatgtttgtagagatagggatatcttgccatcttgcccaggctactcttgaactcctgcctcagcctcccaaagtgctgggattaaaggggtgagccactgtgtcagaccttagttagcctattatatcataacacaaccatgcccagtgagtgtttccattagagatccatacattcaaaataaaaatgacaggagagctagcccagatgggagcagatgttagatctatttctgctacctactaccaaatcacttaggcatagcctgcaacctctgtttcagcagctgtgaacagagagcaggactagataatctcaacccaccatgactcccactcttattaaagaaaaaaactacacagacctagcagagacagagagagggaggcaatcttatttcacattagtttggggcaataagaaggcatcttggaggtaggaaagacagtgatcacgagtatcctaagattgcaggttggtttgtgcgctgactgggcacatggttttctccttgcaaagccaagggatgggttagaacggacactttccctggggcttgtgtacatcagtccccctctcctcttttgagagtgaagaagcagctggactccaggttgggaatgccaaaagggacttcaaatgcctcattagctaagatgatgaaggagttgctgtaggctctatttgccctccttttacacacactaacatattaagaggcactgtcaaagctcccaggacatgaaaaccagccttcctggagggactactgaagaaagcaagaaaaaaaatctacatatatatatatgtgtatatatatatatatatatatatatatatatatatatatacacatatatatacacatatatatatctacatatatatgtgtatatatatatacatatatatatatatattttttttttgcaaaataacaatctattaacttgactgtcttcattacacaaaagtcactgtcaggttaacagagtctgtttattctatttgtagttgattcccattgattctctctctctccacaaaaatctaagttaagagctaatttgtagtagaagagtgacttcagtactttaacaaaagttcacctggtttcgttaaacgtagttttacattgaaagtgtctttgtatacttaatcatttattctggcccgttctacaatattccccttattctcaagtgaaacaggcatatttgaaattcatattaactcttcagtccttttataaaagtgcatattttaatttatattatctctttaaaacactataggttttacaaaagggtttaaaaagacgattcccaaagcatcctatttttatggtgaatgctactcatacatagcatattatctttaatgacagataagatttcataataacagatgctttaaaagttagatggttttaaatttcgcaaaagtgacttgctgtaatttaaaataagaggcatgaccacaataaaactttaaaactattaaagaaacatcacttggtaagaagagaaaagcattgattattttgaatgtaagacataggacttatggtgtgtttccaacgataaagaaaaaaaaaccggttgaattacatagatttcagaggaaagtattcccaagtgggagctaaaggaagatgggacagatacttaacttctgggagatgtgaattgttgtaagtgttagagtaacatggacttccaaaaataggcagccagcacataaatcaaaactggcattgatggtgaatacttctttatacacattttttttaagtaccagtatttagaaataatatggatttggcatgtgtatgtgaaagacatagagagagaaagacatctgttactctctctgtactttaatgaatactgcctactgactgactctatattaggggtccccagctcccgggccactgactggtagcagtctgtggcctgttaggaactgggtcacacagcaggaggtaagtggtgggtgagtggacaaagcttcaactgtatttacagccactcctcatcactcacattaccacctgaacctcctgtcagatcatcagcagctttagattctcataggagcatgaaccctattgtgaattacacgtgagggatctaggttgcatgctctttatgagaatccaatgcctgatgatctgtcactgtctcccatcacccccagatgggaccatccagttgcaggaaaacaagcccagggttcctaccgattctacgtgacggtgagttgtataattatttcattacatattacaatgttataataatagaaataaagtgcacaataaatgtaatgtgcttgaatcatcccaaaaccatcccctgccccctcccccaacatggaaaaattatcttccatgaaaccagtccctgttgccaaaaaggttggggactgctgctctatataactcttcaatgagacccccaaaattaacaaaatgttatatgtcacggtgtattttgatggtatcccaaactatacctaatacaatggattcatcttggctttaaaagagcttagtcccatttacagaaaatgatcagcagcactcgatattaaggagctaagtgctctagaaacggcttttgaatataaactattgcatttgctaaaccgtttgataaactgaacctccatgttttgaggaagggaaatcctttgtctagaatctcaaggtactaatgaaaatatttaagatctgtacaacgacactaatgttcttgggtcatatcggcagaaaaagcacaataccagtatatttgttatgcatttttcaagtgtgcttcatctcccagcctattttctaaggatttaaatcgatttattccagtgtacctagtagagcttacttgaatcagtctgactgaagaaaaagacaaaaatgttcctgaattgttgctgtccatcacatatgtcaaattaaaaagaattaatatgaatgacttgctctgccccatgtcgagttaatatggctaatctttatgggtctgtgattatgttaagatgtctgtatgtggtataaaataaattttctaaagattttatgttttttagacttttcacacctatgatggacacccttccctaggcacacacagatatatgtgacactgcatgtgtcttcacacccccagtgctgccccttacctttgtacagagtcttgggtacttgacaggtgtgtccacacccattcgaacaacatttcttcaccccagagcactcattgtcaacttcgcagctttcaacacaggcggccgcaaatccactggctttctcaggagccggacagtccccctgcttcaccaacaggatgtatttgaggaactcacagctggtcaagcattcgtagctcttcttggggaagagaggctaagtcaaagaagaattttaaaaaatattccattaaagacacatgaagtctgatttccaagacatctgaaaggaagttcaacatttttccccaccaaacctttgtttgaatatttgacaaaatgcatgtatttgttttcttttctcctatccaagtgacattttgtgctgatttctcaaaggaacataatccataagtgatgattttatattgcatgcaacagacaaacaccatgtatatgcgcccacgttcacagatcatatattctatcttggtcaaagatgttttccaaaaaaactgattatagtcacaaaacctgttcagtacaatttgagggccctttttggattatatacattacacttataacacatcactctctttaattttttctttctccctttttttttttttttttttttttttttttacagttaaggtctcactttgtcaccccaggctggagtgcagtggtgcaatcacagttcactgaagccttgaactcccaacctcaggcaatcctcctgcctcagcctcccaagtaactagaactacagacacacaccaccatccctggctaatttttattttttgtagaaatgaggtcttgctatgttgtccagggtggtattaagtcctggcctccagcaaatctcccactctaagcctcccaaagcactgggattgcaggcatgagccattgcacctggctattttctcatatatcataaatactcatcaaaatagcaggagctctataaaactttacaattctcacaatggtaacatatttattggtattgtatagcacagttgtctaagcgttctaattgaacatatttcaataatttccagcctttattattaatatggaattgtcaatgagttctgcagtagaagaatgtgaatcttctttaaaaatcagcccacacctatgttatctgtgacacagttggggtctgaacagcatcttgctgaggacattttggttgagcccagaatcaatcaaccattagtgagaataggaagccctggacttattagaggaatgcattattgaaaaagcctgagtaatgtgaaagagccatttatcaaatgcctatttttccttaggaaaaaatggttcaggacagcactcggtcatccctaagacaggagctgcaattggaagataatggctcttttctgccactgaacagaggagttgctgagatttctaaaagctgtcccatccagggaaagaaagggaaggatgctctctgtgctcttgctctcctttttcctatggaagagaatggccaagacagccccaccagccccagccctccacccagccctatccctaaccctctttttgctttatagaagatggctgaaaagatgatcaccataaccctaacttttataccaagcctccttttatccttatgggagatggtttccatgataactactattccattaaagacacatgaagtctgcttgaatgtttaacaaaatagatgtatttgttttcttttctcctatcaaagtgacattttcttttatcaaaatgcattttcacctggaatgcctgtgcatagccaggttaaatttcactgtctcttttacctgggggtggctacgttgttgtgaatggaacgtaatcagcaaagttctgtgccactgtggaccgaggcttgcagatggtgggggatggtgcccccgtgttcttctttattagctggatatgggtggcaccacagctgtagggaatgagggaatggtggggccacaggaggagagacgccagaatgctgtctgcccatatggagaaggacagcaccctgccgggaacagctgccttgaactgcttcatgggtataaagcaagtacacacgtgtttgaactcttgtacatgtcaagctccgtttgctacaaccattcagggtacctgaaccaatgcaaaggccatccagtgaagggctgccatggttcctcaacgttggaagtggaagatgaacaaggaggacactttctgtttatttgatgtcacaacagggttaggaatataagaaataaatgtggtagctttggtgaacagaagtctagggggagaataggaacatcaagcagctcagtgccagcatgctgcttgatgctccacagtgatccctaaccagggctcattactggtaacatctggaaacacctgggttacacctggacgatacctgggaacactcgcctgtgtgctgcctgctgctcctccctgatgactaaatatggctctgcaccatcgtgacacctgggtaacaccgggtcatccctaccattgcctggtaatgcctgggcaacacctggtaagaccagctcatgtgttgctgttgcttctcaatagtgattgaatatggctccctaccacgaggtaacacctgccaaacctgccagcatgctgctggctactcctcactgttaaacaaccatgaccctttagtcagataggtgtctggtagcacctagataccctggagataggaggttatctaggcaggagactgaatggtttgggctattaaccagagagtatttcaccaatagtggaggtatgttataaaacaaacaaacaaacaaacaaaaccaccattatcaaagtctctagtgggaggtggaaggttggtgggaggaatgtctctcttttccggcagttagttcattaattttagcctatgattctcagattgatgatgactggaaattccactgaagactcaaaacataacttcagcaaggaatatcttagtaatcctagaataaactacaatttcaacgtaaatgattctccactgtctcacctgcttcttttccccaaacaatgttcaattaaaatatgcgtaagagttgacggcaaatgttatattatgtgcattttaccacaattttaaaaaaacactgtgaaagagacagaaaatttttataccatgagaatgtgtgcagcaccaaattgttattgtttcatagtgacaataatctttctgatattgtaaatttagtggatgacaaagcattagtacttcattacaagttaaatacaattaaatgcctgttcttttcttaattaacaaaaggaaaacagtggaaacactagctagaaaaactataatttcaaggtttgaattagaattgtagatgtcatataaaattgtttgttagtaattaatcatacataaaacgtgaaaataacatgagttgactgaactaaaattatttctcaatttaagaactttaaggtaaaacttagaagggccatggtgtcaatattgaattatgacaaatttacagctaatttaattaaaaagaaactttataagtatttaaagcattattaactctcaaggcttttatctcttactctatttcacagtccatttttctgttagctgttagatgtgttttacttcattgagttttgaagctctaagtttagtttcaaacctaagttaataatcaaagaagtatgctaacagatctgtaacaattatgtagtatttgccaactttcttctttcaacaattcatatacattacacacactgaaagaaaatacttagttaccaaaatcattggccagtgcctcatgggctgagatttccaagtagaaatacttgtattaggccgggcgtggtggctcacgcctgtaatcccagcactttgggaggccgaggcaggtggatcacgaggtcaggagatcgagaccatcctggctaacacagtgaaaccctgtctctacttaaaaaaatacaaaaaattagccgggcatggtggcaggtgcctgtagtcccagctacttgggaggctgaggcaggagaatggcatgaacctgggaggcggagcttgcagtgagccgagatcgcaccactgcactccagcctgggcaaccaaagcgagactttgtctcaaaaaaaaaaaaaaaaaaaaagaaatacttgtattaaatctggcaagtgtttcctgcttggtaacttggaaatcacagtgacttagtttgcatcatgatataatgaaatcaactcagttcatactcttcatctatgaaaacagagtatgagtcaagaatcagataaagtttggatcctgtattcgtatattattctaattatctatatgccaactgccacacatttgaactgtgagggacaggaaaacagaggctatgtctccttatcttcattatttactgaactattggggcagacataaaaacaaataaacaaagacagtaacctagaacagttatgaagcatgtgttcccaatgactataaaaggggaatgatcataattagcccaacaatttagatctttcagttgatatgagagttattctgtatggatattcaatgttttcctttttggtaaggacatagaaacacatatgttcatctttgcacccatggtttctagactggtttataatcttgaaataatacaggtaacattatgaatattacatgaggtaacacacacaaagaattaagcactattgtgcatagttggcccacaatacatactcaataagaattaagtaatttgtgtctttttttcttttatcactgctacaagtttactctttaacatttcaaaattcttctggtgtgctcatgaaaattttgtaagatccaaagacagaaggaagtctgtattcttctacagtgtgtccagccactagattccaacccactacttccagattaagcactgaaatctgcatctcaggaattgtaccctgtacttaaatgaagttcatcttagagcagtgtggatttggtgcaacagtcttacagaggagctttatttaactgttctattaaaggcagatttatcaaagggaggttttgatgctgtctattaattttctttcataattctcttggattgggttgaaaaaatattatttgtttgaatataaattagagaacatatggtatgtgtacataaggtctctctccaggtcattaataatagtttaatgagaatttattgattgaatggaataaggagaaaaatgtgtacaggtcagagaaaatgctgtgtgaatattaatactctagatataaacaaaatgtgcaaattggtctccagtaggaaatcctgtgaacaaaggtaatttgagtgtcacaaaagtataataatttctgaccattaagcatgtaaaatttcatgtgataatacaaattactcagagatttgttaaaaggaatgagaaaataatagaaaaagacttattcaaatcagtatgcatgtaatacccatcaattttatggtcaataaacacgtgtgacaacatagattctatgttctatttcctgtttctaaaattatatgcaggtaatgaaggcaaattgttaactgtaaatttagtttttataactacaattcatttttataaaactattcatatgattaatttcacgaatcacacaaatgtcactctcaaattattattattattattattattattttgagagagtctcactctgtcgccaggctagagtacacttgcatgatctcggctcactgcaacctccaactccctggctcaagcgattcccctgcctcggcctcccaagtagctgggattacaggcatgcgccaccatgtccagctaatttttgtatttttagtagagatggggtttcatcatgttggccaggatggtcttgatctcctgacctcaagtgatctgcctgccttggcctcccaaagtgctgggattacaggcgtgagccaccgcacccagccaaatgtcattcttttgccaggtcattggctccaatttaaaatttgaaaagaatatggtcactatgcccattaattttgtttattttgcccttactgtccccaaaactaagaaagaattagtctgcaaagattatgtattttttctagattagtgattaatagtatctaatggatgtcattatgcctccaaagaagagataaagcaaagtgttaaagaaaaatatctttgaggtgcattggattaagtaaaaaatccttcatatgttaacgaatagatatatgtcatactatatattaatatgcagtattaatgaattctcatatatcccttctacatgtcatctcctaagagctaaaaactaaaatgtggtttttagtgacttacctgggtaatatgctaagctccactaagaagaaaatgaataaaacattaatttatccacctgtggcaagtagctaaaaataaaattaaatactaacaaaagtaggcaacatttcttgaatgctttcagaaagagagacagtactatctttgtttagtttggtataaaatgcaaggtattgtacagtaaaataatctgttcagcaatcatggaatgataaagacatccaattcagtaaattatcttaatgtgtttaaaatcacataaatacaaggcttcagctatgaggagaacattgcatttggctatttggttcaattcaacagacttgtaccatacgtcaattctctaggattataattgcctttgcaaagagtcagggaatggggggcttcgcttcctgctcctagccaacaactgggattgctgaatacaatgaaacctcaaatatacaatttcctaaagtgagtgctccatcattatcaccactgtcataaccaccaccatcaccatcattaccatcatcattagcagtggcagttggtcaccaagagatgctgatgtctatcacatccctcactctaccccagctgctttactttctcatttcacctattcttccccagtccccacaactgttattatttccattttaaaaatggggaaacaacagctcagggagatcataacatagcccaaatcacaaaacacgtaagagtctgggcaacgatgagagctagtgttttctgagggccccaccatatctcacggtaaaataagaggactgggctcacccagtggctctcagcttgcttccctattagaatttcccagggagcttctaaaactgatgtcttgggtgaacttctgacccgtttcttcagcattccaggcatggaccctggaaactgcactttggaaagaaccgcagatggtcccaatgtctggccaagactagaaatctgctggatgaatagctctctaatttgtgttcagttattagacttcctgattctacatgtttagaaataacctgaatattcaaaaatgcaatcttacacttcctgggaagagatagtggggtgatttcaaatttctttctttttttattccttttctttagcaaacaaatttttaatcttaattctatgctgagtagttgaatagctccatctacccagatacagaaaagctaaatgcatttataaacagaaaatctaagtgtacataaactcctagagaccactgagggtaactaaattaaagtactccaaactataatccaggggttactgaaaatctgattctgatacatccgtctctgtatgtacaaaagatatatttcaggatgctcaaaattaaagcactgacattctaaacaccaagcaatcactgaattaaagtatgttggtaattctttgaacacagtgtctctgaagtcagtgacatcaaaaaaatagcacatgctcttccttttgtattttcactatattaaaaagcaacagtacaaatgctgtggtgttaaaaaggatccttattttttaacaaaggaacttttataaacaattctgtaatgaaaggaaaatagtatgttaatacataaaagtttttgttaaacaagattttacaatttttaaatcagaaaatgttaagattaaatgttaagattaaacaaaaaagcaacctacacaatttccattaaatgtgtctttgtacacatgtcctgggcactttgaaaatgttaaaatcattaaagtttgacttctgccgctgctgcccccatctcagcattgccccctccctaacctggccaaagggtctgattccaaatttctgaaaacttcactcccaaaaaacacagcgagatgaacagaacatgaattcaatacaagagcatgaagacaaggtagtgagacaatgaaatgagatgaaaagggttagaaaagagttaaacaaaaatataaaatgtgaaataagacaaaaacataaagttaagaaataaactagaaatatcaagatcatctgaggtcaggagtttgagaccagcctggccaacatggagaaaccccgtctctcctaaaaatacaaaaattagccgggtgtggtggcagctactcgggaggctcagatgggagaatcccttgaacctgggaggcggaggttgcagtgagccgagattgaaccactgcactctagactgggcgacagaaggagactccatctcaaaaaaaaaaaaaaaaaaggaaaagaaagaaaagaaaagaaagaaagatagatcaaggaattaatagaaaaaaattataaatcaaagggcaggttatgttccaagaataactgaaaagagcaagcaacactggaatatagcttctgcttctgaacaccaaagggaaaactttaatttttcaggcattcaggtaaaaaaggcaagctgattatgaggaagaaaatataattgctaccaaatgtctctctactaaatttagtatgtgaagctaacaaagcaatgtctatataattctaaggaaaataaactctgtgagtgtatgtgccttgtgggggggttgtgttgggggcagggggcatgatgtgccatgcaatggcaaaacctagccatcctatcataaacagaaaacaagaacaaatgggctagtacaatattcggtacccagataaaataaagtaatacttatagaagaaaaaaaagttgtccaatccaagtgtactttagatataactgtaggtaaaatttatcatgcataaacttaaagaaaacaccatccatagacccctgtttaaaaacaaagatatgaattaaatttacaaaattaagcatacagtggaaaaaagaatcagtaaaattaatcatttttctatgtacctaagtatgaaactaaaattaaataaaataagaatgataggagggagaatttgctgtgataaaactaagaattttcaaataataatatgttagaaaaactggtaggtgggaggagtggtggagaaaacctatgagtgtgacttatcttgaacttaatattagaacatcagtaaataataaaacaaatatggaattgaaagagtaacaattccaaccacataatatcttttataatcttttctttataatattttggggtgtctttgtcttctcttgccttcaagtaatattaaactttaagcatttatttgaaactagtgtgcacagagcttccaggtgctggcctcttggccagccatttaagtaggcattgggagagcagtcttggccttgctgtgttaacacgtttctgcacagtaaaccatggctgtttctacatggtaaatctggaatgatggtttggttttacttttctgtgcggtttattaatttttaatgggcatgtatagtttctattaaaaataaatagtatacttggctgggtgtggtggctcacgcctgtaatcccagcactttgggaggccaaggcagacagatcacttgaggtcatgagtttgagaccagcctggccaacatggcaaagcctcacctctactaaaaatccaaaaaatcagccaggtgtggtggcacacaactgtaatcccagctacttggacaactgaggcaggagaatcttcaaactaggagacggaggttgcagtgagccaagattgcacaattgcactccggcctgggcaacagagtgagtgagattccaactcaaaaaagaaaatagggtgtacttttaaaaaatgaggcaaaactgccaagtgtgtctttcaaagaagacatctaaacactaggcatgaaataagaaaaataactctccgttcaaatgttactaatttatgcttggaagtattattataatttgcttggaagcccaattataaatactaatttcttagatgtgattgcaattaattggattcccaggcaaattatagacattggccatggaaaatataaaattaggagaaaagcagaaacacgcatattagagaagtcacttttctacaagtacataccctcttctttcaattacagtaatctttacttatgtttatcttggcttccttcttcctggcctggctcttctatttattttgaaaacaaatgtgtcaccttgtatgagtcagcaacacctcagaatcttgctgcaatatttctggaagatcatgaggcacataaatagctcgagaagttcacaaatccctagagaattagggatagttcaggtaccacatttaaactatgatttatttccctctcctacttctgcatttgttagtagtgaataccaagaatgccaatgcaatgttcagcccactaaaccatttatatactgatttatagaccaaaccggcattctaggtactaggaatttaatggtgaacaggtgaaattgtgaaaatgatgacccactatgcttagtttacatgtttactaacaaacaggtaaaaatcattaaacagtttagtttgcattataataaaggtagacacaggaagttacagatataaggacgagatcaacaaataattagacaaggacaaaactttaaagaccagtcatcaatactgatgatttaggcaagtaaaagtgatgtggaaaacagaagaaaaagagagagggaacagaaacaaatacagcctgtccccttcagagcttgacaaatacacaagcaagataactgctgtacaatttggggggcaaaattaatttggcaagtgtcactttcttcaaaatattaaaggaagataaaatattaccctaagccttaaataaagcttccaaaacacttagcatggatcctagcacataataaaggtgcaatcagtgctagccacctttattagcatcagaattctttaacgcagttctagaaattttacaagaaacaataggaatccatatacattaattatagatggcctaaaatcctcatgtaaataatttcttttaaagaggaacaaattagaaagttgtcaaatacagttgtttactctttgatttatattgttcagtttctttgctcatctcattttgcaaacactgtcaaattctacaaactcatcacatccatccaagatacaagaaaaaaaaatctcatattttacctcttagagatcttccttgaaatttcttatttctttgtttatacactactatattataccacttctggactggttagatcatcacaaaatgaaatagaaactaactgatatgattaggctttgtgtccccaaccaaatctcatcttgaattgtagtccccataatctccatgtgtcaaagaagagaccaggtgggagtaattgaatcatgggggcagtttcccccatgctgttcttgtgatagtgagtgagttctcacgagatctgatggttttataagggactcttcccccttcactaggcacttctccttcctgctgccttgtgaagatgccttgcttccccttcaccttctaccatgattgtaagtttcctgaggtctctccagccatgctgaaaagtgagtcaattaaacctctttcctttataaattacccagtctctggcagttctttatagcagtatgaaaacagaccaatacactaatgtacatagaacatagtttcctcgttatgaacaagtaagagaaagtacaaattccataagttaagggactggttcccaggggacattaggtaatatctggagatatttttgttcctcacaactggaaggtgctattggcatctagtgggtatgatctgagagaccaaaatggatgcccctttatcaactaaggggtatgctaaggttcttggttggcatggcacatttctaaattcctatagctaaacttgttaacaataggagctatcaactctgatttacaacccagacctctacaactctgattggacagaagactggccttataaagattattttctgataagcaactgcagaccacaagccagtttcagctagattatagaggctgtgcacaaattctgtgtcctgtagttcacttttcgatgtaaagagccaaattccacctcatcttaatgctaaaaccctgccccaaagtgaacattgaatgttatgttattacgagggtattttaagaaagttaaccaaagatttagcagaaaaatgtctgagaaagcttcatcagagagcctttctccaccataacaatggccctgctcattcctctcatcaaataacagtaattttgccagagtttcaatgggaaatcattaggcatccaccttacagtcctgatttgtctcctgacttgttcttgtttcctgttcttataagaatctttaggtcgggcatggtggctcatgcctgtaatcccagcactttgggaggccaaggcaggcggatcacgaggtcaggagatcgagaccatcctggctaacacggtgaaaccccatctctactaaaaatacaaaaaattagctgggcgtggtggtgggcgcctgtagtcccagctactcgggaggctgagacaggagaatggtgtgaacccgggaggcggagcttgcagtgagcccagattgtaccactgcactccagcctgggcgacagagcaagactccatctcaaaaaaaaaaaaaaaaaaaaaaaaaaaaacaacaacctttaaagagcacccatttttcttcagtgaataatatttttcaaaacctacattgacatggttaaattcccaggaccctcaattctttagggatggactaagtggctgataacatcacttataaaagtgtcttaagcttgatggagcttatgttgggaaacaaagcttatatgttttatttttggcttttgattccatttttccatgaactttctgaagtcctcttgtgtatgtaaccacgttattcagacattggacaataggtagcacaagacaagaaaacctataaggacacaaatgagatgagctacaattttgccaaaaaaatgatttgacgtagtttcaaatccacagtgcaaggaaggctaatcccaagatagctctgcaatttttccaagttgtggataaagagattaaagcttgaggctgagatggccagatcttgtgggcagactgtaaagcaggatgaaactgcatgaagagagaaacctacagggattcagagggaccctttgatttctggctgaatactgacttgaatgtgcatggcttcaaactgcataagtctggggaaagaataatcagacagcaataaaggaaaccattctagcaaaaactcacatttcaaccagtcagagtgcagagaatgcacaattcatgaagcattggctagagtcctcagaaggatatcacctagtaatgggataaattgggcctagtctaaaggctactactctgaacccgcccccaagaaagcttaaaagaaacttttaaaaataagaaaatgaatctcaaaaggaacttaactacatgccagaacaaagtctaacactttctggaaagatacagcaaaattcaaaacacaaaaatttgacatccaatcaaaaataatccagtgtgcaaagaagcaggaaattgcggcacataaaatgggaaaaaagggatctacagaagcaggaccagaaattatagaaatgatagcattaacagcaaaggacatttaagaactaatataaatatgctccatatgcccaggaatgtagaggaaaacatggacatagggaggacaggaatgaaagctacagaacagagctgcatagaaattccagaagtaaaaaggaagaaatgaaaaatatgtcaaataggatttttaaaatgttagacaccatagaagataagattacttaaaaggaaagcaaagacacaatgatttaaaataaataaataaataaataaactattaaaatgaagcagagggtgggaaatgaccaaaaggaaaaaaaaaagatcatagactcattgacccatgagacaaaataagctggtctaatgtgtgtaattagagtctcagaacaagagaagagagaagatgggagaaatcaataaataatattgaacaataaattaaaaatttgattaaaattgtatgtccaaagttagaggaatctcaattacccctaagcagaagaaacaaagataattaactcaaagtatacttaaccgtattgcttcatatgccagatactgaaggaaaatcttcaaagcagatagaaaaattaaaagatactttatatatagtaaaacaaggataagaatctcaaaggtttttcagaaaatatgcatgtcggaagaaaataaagcaatatctttaaaatgctatttaaaaaaaaaatcaacttagaattttatacccatgaaatatctttgaaaagtgaagatgccttaaagactaccacaggtatacaaaaggtgaactcatagccagcaacctagcattataagaaatgttaaaagcaaaaggaaaatgataacagatgaaccttggggtctacacaaagaatgaagaattctagaaataataaatacatgattatatttaaaagatgatttttcttatttttatatctctggaagaagataagtttaaagcaaaaaccataaaaatgtgatgtggagcttgcaacaaatgtagaagtatgatttaggacactaagaatacaaatgaagggagtaaacaatgaaagtatattgttatgacattttcatattatacatgaagtcattcaagatgaaacatactgtgttccaaaaagcaattctcaaaaaatttaaaaggatagaaatcctaagttttgtcttaactagaaatcagtaggaagatatatgtaaaattctcaaaaatttacaaaataaaccatacactcatatgaaattcaaaaatggaatcacagaagtaatcagaaaatacctgtgtaaaaataaaaacatgctataacacaaaatgtgggttttagctaaaatagtgcatagggcaaaatttatagcataaagctcttatatatgaaaggaaaataaggtctcaaattaattatctaagctcctacaataagaaattatataaagagagtcaaactaatcaaaattaagcaaaagtaaggaaataataaaggacagaaatcaatagcataggaaatgacaaaaaaataaagaaaaacaataaaacaagaagtttttttttttttttttaaagaagcactaaaattgacaaaattctattgggatgaatcaagaaaaagtagagaatacataacttaccaatgtcagtattgcaaaaagggttcatcactacaaacctaacagacatcaaaatgctaacgataaaggtgaattaggcgataatatgacctatgctatttttatcaatgtgataacttggatgaaatagttcacttcctacaaagacataggttataaatgctactaaagaagaaatagacaacgtgaatagtcttatgtctactaaaaaatggaaataacatataaaagtctcaataagtaaataaataaactttaagctcatacaggagcttctacttcttagagaagataaatatcagaattctttctaaattcctccatgaaagctctaccaactcacataaaaggagactctcttcattcattgattcatttaacctgagtacatcattctgctagttacatgagatgagaaggctaaactttattcctgctatcatgtttacaatgcattggggaataaagataaatcaacgattataattctgtatcttgaataataaaatagtgttttttgtttttatttataaagaaccattttcatctgctgattttttctttttcttgttccttctttttttttttgaaacagggtctcattctgtcacccaggctggagtgcagtggcacgaacatggctcgctacagcctcaacctcctgggctcaagaaatcctcctgcctcagcttcctgtctagctgggaccacaggtgaccacaagcatgtgacaccatgtttggctgattttttttattttttatttttcgaggagatggggtctgactttgttgtccaggctggtcttaaactcctgggctcaagtgatcctcccgtcttggcctcccaaaatgctggtattacaggtgtgagccactgagcctagcctcatctgctggttttcaatcattttaagcaattgcacattttctccccatagactatcactgcacaaatcacagaaggtttcacagaattggtagaaaacttcaagtgagtgcttttttgttgtttgttttttaaaacagggtctcactctgtcaccctggctagagtgcagtggcacaaacatggctcactgcagtctcgacctcctgggctcaagcaatcctcctgccccagcctcctgtgtagctgggaccacaggcatgtgccaccacaggcataaacatggctatccctaaaacagggagccccagtatccaagaagtacaaccacacacttgctactcaaaggctaggccttggttcagtagcattagcatcacttgggagcttgctggaaatgcagactctcctggccacaccatatacctactgaataccatatgcctactgaacaccatatacctacttaatcagaatctgcattaaagcagattcctagatgattcatgtgcgtgaccaagtctgagaaggccagttctggatcatgctggacactggagttggcatcttcagatgcatgagtttctccctctccatatttacatttccttcacccctagttccttactccagagatcaagttatccaatttgtgctccatgtatctctgacctcacactcctgacagcattcatttcccctgacatataaatgtattccagtctttccaaggtaaaacacaaaaatcactttctcaactgtgaattccccctaaacacagcctcttctctctcctctatgctctagagacagtgttagggaaagactttaaacttatagaaaaagttgcatgtatttggtctgaatttcctccttacattttattctataacgcagagttgtatctgttacctactattgatccacagaaagtctcccacacagatttccagtgacttcctaactacaaaactcagtgagcccttttagttcgcatctcactgacctccaatagaattaaaaagtgttgaccttgtctccttgtcttcctcttttataataaaagtagctaatatatatgtaatgtgtgttatcttcagatactgattaagtgctttatatgcattcaaaaaaaatttttttacttaaatttagtgcttttgcaattttcatgatactcccctaactccttatgtgcctatttgcctagcccttcttttcaggcttaggtctttaaatcattctgaataatctccagtcttggtcccataaattttcaaaactcatcaattctcctacaactgagtctagaataatttgatactcccccgagtaatataagaaaaatataaaaaaatttttatattttataaaaaatataaaaattgagtctcagtgcttaaaaaggaaaaaaagtttatgttccagatctataaaatttgatacaatgcagactgtacccatcatatggtggttggcaaagaatatctcataataattataaaaattcataagcattcttcaaaacatttccactttactactactacgtcccctaagtcgaaaagaagacttagatgaattctgcatctcttcattggtgcccaagtaacaccatctagaaatacaagtaacacttttatgtgttacaaaaatgtaaaataccaatgttaatcatttttaaaaataaaagcctattatttatcatactaaaaactttttgaaaattgtctatgtggctgagtgcggtggctcacgcctgtaattccaacactttgggaggctgaggcgggtggatcacgaggtcaggagttcaagaccagcctggccaagatggtgaaaccctgtctctactaaaaatacaaaaattagccaggtgtggtggcaggtgcctgtaatcccagctactcaggaggctgaggcaggagaatcgcttgaacctggggggcggaggttgcactgagccgagatcgtgccattgcactccagcctgggcgacagagcaagaccctgtctcaaaaaaaaaaaaaaaaagaaaagaaaagaaaagaaaattgtctatgtgtcagtcactccagcctccatccctttgtctggtccttactctcagctggtcaccctgattcctgttgcactgagaaaagtaaagcattcaaaagagaagttccatagacgccattttcacacccaccaatgcagctgcatctggtgcattaaaatctcatgcatccatggattctcatgtatccatgaattctcatgcatctcctgtcccaggacgtagaagcttgctcccatttcaaacctgcctccatacacacacaatggtagacattgccatttaaggtcatgtgcttcagcaattcccccctttctcctctaacatcaaataacccctctcttctgaataattttcatctgcttgtaaaatataattatttctctactctaaaaacaattaaatgtttgattaccttgttcacacctcttcccacaatctcatttgcgcccctgatcactttttttttttacagtaatgctcactgaaatgtttctatactccctctctgtttcctccaaccatttatctgaaattcatgccaattaggcattttcttctgccacccaataacactgctcttgtcaaagtccacagtgagctccctgtcgcagaatccgattaataaatttgaagtctccatgctcttgcagcacttgacgcaactgattacctcttccttgttgaaaagctttcatcgtttggctatcggaacaccacactcccctgtgttttctcccaatttattggcctctcttaaatctccttcttcatctccctattcctcttatgttgctgtgattcagtttaactcatagacctgttttctttctgtcacctcattgagcttcattactttaaacagtaccttcatgcatggcatttgttctttcagcctagaactctcacctaaattccaaactcctatgcctgtttccctacagcacatctcatacggatttccatttacatctgaaacatgccatgctcaacaccaaacttctggtctattctttctccccaccccacccccaaaactatctgtgcctgacacatatcccacatctcgtacattccagctttcttaccctagtttttaaggacaaaagccctggcaacaccactgactcaactctttctcccgttcctcatattgaatctctcaccatgaccactctagactgagccaccactatctctcatttgctcagtggattagattgtaccaagtaaaagaaaaagcctgagtgtctcacccactagacacactactgcaggtcccattctagtgtctctaaagaattgacaacttccttaaaaggaagtactcaggagccatattttaatgctcttaggaaaatatttccaagtggaaaatctttgtaataaaaattgagtctgtctttcagtttggacatatatctgtttaaaaagaatagcaacaaagttaatctttatttccctttcacaagtatattctaattggggaagctattgttctgatatgttaaagcaaaacattgctaaatggtacaaattctatgtgcttctccttttccagccaacacacatttggggaatattatatcactttcacgtttagctctcatcagcttctttcaagacctttaactattttacagacatatccagacaggtacaggttctgttccaatccctacaggtatgcatttaattatcactttaaattttaagacataaaaccagttatagagcagcgaagagataaaaagttttgagtgcaagaaatccccacaggagaggcatgttaacccttttactttctgaggtctcttttcagtagtgttggaatatttctttcagagccacgtgaaggggcaaggagccctgtcttccttctctccttgaggtgccattaattaactatgatttggccaggcgcagtggctcacgcctgtaatcccagcactttgggaggtcgagatgggtggatcacctgaagttagcagttcaagaccagcctggccaacatggtgaaaccccgtctctactaaaaatacaaaaattagctgggcatggtggcaggtgcctgtaatcccagctacttgggaggctgagtcaggagaatcgcttaaacctgggagacagacgttgcagtgagctgagaccgagccactgcactccagcctaggtgacagagtcagactctgtctcaaaaagaaaaaaaaaattaactatgattttaaaccactaaaacttccttctcatttaaggataagcctgtccaagcagggatgactgggccaagaaccttacattcgacacaggctcatcttttattccctgatgagggaagtaaaacctcctcctctgctctgtgtgctgtgacacagaataggtttagaagggaaaccctacaatacagcaggaaagaaatgtaactagaagctacaccacctggattttagatcttatactccactaaccaaccatgtgatcttggacaaataaatctcttctccttgtgtatgagtttccttgtccatcaagcttacctaatgaaattcacatctaacttcttctaaggactgttatgggaatcaaatctataagcctgaaagacatttcaaaatgcaaaatcgcaaagaaattacttgataattatatatgtagtaaagtgaaaacctccttttccttcccatttccaggctgagaaagactacttatctcaggatgcatattcatcccaaacaacttgtatttttacccttgattgatccctgaagccaataaggtttcagctttctatgacgttaacaggtactgcatacttccaatgttgacatccactgagttcttacttagtgttgagatttcatgaatcagaaacgtcaaagtcaaagatggcagctgttttaccagctgttttatccaatgctgacatccactgagttcttacttagggttgagatgccatgcatcagaaacgtcaaaatcaaagatgggagctgtttcattcagcaaggaggcaagtcataaacaatgatatatcaagtttcaccaaaactaagatcattaagaatgagaaataaataatgccatttaaaatttaagattccattgattgtgagaaaggaatgtttcaacctaggaaaatgtatattttgtatttggttaaaaaaagtttgtcatggtttttaagatttttgaaaataagagaacaggccgggtacggtggctcacgcctgtaatcccagcattttggaaggctgaggtgggcggatcacctgaggtcaggagttcgagaccagcctggacaagagggggaaaccccatctctactaaaaatacaaaaaataagctgggagtggtgatgcatgtctgtaatcccagctactcaagaggctgaggcaggagaatcgctcaaacccgggaggcagaggttgcagtgagccgagatcatgacactgcactccagcctgggcgacagagcaaacctctctcaaaaaaaaaaaaaaaaaaaaaaaaaaaaaaagaaagaaaagaaaagaacagtgataatggttagttaataaactgaacctacaaaacagaatctatttgcctatctatgtatctatgattacgtgccatgttccaaaaacttgatacatgaaaataaaatctcatataatccagaggactgctgaaatatctcaatttttttcctgttttgatacaaacatttaacttcttcatttaaaaaatgacatttattggccgggcaaggtggctcacgcctgtaatcccagcactttgggaggccaaggcgggcggatcacaaggtcaggagatggagaccatcctggccaacatggtgaaaccccgtctctactaaaaatacaaaaattagccgggcgtggtgatgcatgcttgtagtcccagctactcaggaggctgaggcaggagaattgctggaacctgggaggcagaggttgcagtaagctgagattgcgccactgcactccagcctggcaacagagcaagactccgtctcaaaaaagaaaaaaaagaaaaagaagaagacattattacctctgacattagcctaaaagtagcaaaagttaccgtgcaaattataacaaaatcggtaatcaaatgagaagtgagagagatcacgatatgagaatgaaatgaaccaattctaggtatgttgttattaacatgcctccaaaagtctcctccatgtaggaaaacttatttgtgattaaaattaccaagaacaatgttttatgtttagaaatgggtgctgataatacagattaagaagtaacagtactctaaatggtaagatgagttttgtaatataattatgactgttctttgttttattgttttttgttttgacacaggctcttactcttttgcccagtctggactgcaatggcatgatcatagctcattgcaaccttgaactcctggcctcaagcaatcctcctgcctcagcttcccaaagtgctgatattacaggcattagccactgtgcccagcctgttctttttcttggagcaggaattaaaaaactttttctataaagggccagatattagatattttcagctataagggccatataatgttacaagtactcaattctgttgttgtagcacaaaagcagccatggacaatatgtaaacaaaccagtgtggctgtgtttcaataaagttttatttataaaacaagaggcagaccagtttgccttgcgagtcatggtttgcaaacctatgccttagaagacaaataagctcagactgccctgcaggtaaacataccgggccgaacatgtctaacagtgtaattgtttccgttgaagaataatgtaatctagagtcccttctgggtctgaacttttacaaagggaaagcttagagtcatgacaatatggaattctgtgcattcttaacaaataatgtgagaatggggaggatgaacgggattgttttaggcctgtctccataagtgactaggcttaaaaatgctgaaacagccatcagtgttttcaaggttcagcctacttcaacacaatagtcagatacttactgcaaaataaaacagatgcaaaaaacacacagggacctaaaaacaatcaaagccactaaaatggaacatcaagtcttgagttatttaaccgttgggctgaagcaattcatcaaagctcctcacattaaatggcatctgttttccccacctttcaagtttcaattaacctttcatgccagaagggatcacattcaaacacctgagtcccattttaataaactggatttggttcagaacacctcacagttacctcagagaatggcaattacagaaacctgctcttgaatttgaaatttacaggaagaaaggtttcaaatgaccttcaattatatcttccttctcagcgatcagatgtaaaaatatcagcccagagtcactgatatttagggataataaatttataaaacaaacaccttgttcctcaagattctataaacaggtcaggagcagtggctcatgcctataataccagcaatttgggaggccaaggcaggcggatcacttgaggccaagagtttgagagctgcctggctaacacgcaaaactcctgtctctactaaaaatgtaaaaatcaactgagcatggtggtgcacgcctgtaattccacctatctgggaggctgaggcacgagaatcacttgaacccaggaggtggagggtgcagtgagccgagatcacgccactgcactccagcatgggaaaccgaaaaaaaaaaaagattctataaatatttatttttgtgcctatagatgtatagtttgtgtatggaatagggtagaaaattaaagttaagagcacaacagtcactccactagacagtgtgctctaattgtgttgacaaggattaccaatgcgggtaaaaattcagaataaatagttgattcagatacctcacagagctgtgacccacaagcctataacacataatacaaagtaaatatcattgtgttacttttgtacagcttgataagctctgtaccatgcacttacattcattatctattttaataaacaccgtgtaagatcaataggataaatccctcatttgaaaaatgaggttgaagacacaggttaattgatttaactgaattcatagagtaagttggttttgcagttaggattagaatcaagttaccatcattcacagctgagatctttcatccaggagaaaataagccccacaaaagctggaatttttgcgtgatttttttactgccacatctctaccaaactgcagggcacattataggtattcaaaaagttcatgttgaataaatgaatgaatagatatttttaaaatagttaaagtaggaacacagaaaaggtaaaagcagaacacaaacaaagacatgggatggcctcactctccttatccttgcagcaaatcaccagttttgtttatttctgctatgttttttctacatctcaaggggcccaaacccactatgacccctggtgattggccaagcggagttgaccaggaacaacactcagataatcagtgagggatcaaaagagggatcaaaatcaaggagttttagacccagtctttctacctggagggttgaccgttgacaagccattcgtctgaggagcctcaacttcccagtccttcctggcttccacacgtaactcttggggacttactatctgccttgcttaactacaggagtatgggaaaggtcaagtaagattatgaagatattttacacacaatacatattgatgaagccattattgtcctaattctgcattcattttctcagaataagatccagagtgaaacataggcaatgggattacactagcatttatttgctatagtggatgaagaccagaccaatgtctctggatccttggaagagttccctttcaccccccagttctgttcaaagataatccataacatcatttcattctgatgtcgggggcacctcttctggccaagaccctcaactgagctctcctgactgccaaaatggactcttttgactcattctctactattctccccaaaccttcagattctcctacttctcaagtccactgtccttggaatccttggaaccaggcagtctgcttggccttgtgtctggttacttctcagcagaatccaggctggtacagggcctgtgccccctgtattccatagggaagacagtccagtaaagcagatctccttttttgcactattggtgattttagacagtggtcctctaggacaatattacacattctcccaataaggatgatagagagatgaatgggtagatacaagggtggatggctggatggatgaatggatggatagatagacaaatagatatagatagataatagatagatggatagccggatggatggatagctggatggatggatggatgatggatggatggatggatggatggatggatggatggatggcttgctggctggctggctggatagatgaacagatagatactaatctaactaatagttagctgaagtaagatgcctcctgtacagttaaaagcgggcaagcattctgcccaggatatgaggaggaaccccgaggggaacaaagagatgaaaatatttgagaaacaccattagcaataatatgagtctcttctcccaaatggcatgaatacttcaaaagcatgtaaaaactactcagaatagctatgatgtaaggtgggagggtggtgacaatctatacctttagaaagcctgtagtcttccatctacacatcatatttttttttttggtctggttagccaataatgcaagcagtgggtagccaggttttaagaaggctctatattttttacatgaatttacgtatatccacacacacctgcagttaatgatctccccaagctgcagaagaataagaaggcccattcattcccatgaccccacgtaagcatagtcagatttgggtcaagtgttttaagtaccactgacgttctcctacctcacaaaagctttggcactggtgtttcctcaggtcccctgattccttgcagggctccaggcactggaagagaggaacaataaaaataaataaaacatggaaacaaacaaagctgagaggaaaaaagaattcacctgtgattgttgctttttcaatgcctgtttattctagttagtttagaaaaccaaagaatcagctgctctttttaactgggtataacacgaatctgagcaaaagcatcattacagaacgcggaccaaaaaatgtatttcaacacaattggaaaggaaaagttacagcgcccggcagtgacttacaggaaaagtaatgatcgtcaccatcagctggaggaattggggtaagacatattttctattcagtaagaaatattttcttttcttttcttttttttttttttttttttttgagacaaagtctcattcttgtccctaggctggagtgtgatggggcgatctcggctcactgcaacctccacctcccaggttcaagtgattcttctacctcagcctcccgagtagctgggattacaggcgcctgccaccacaccgggctaatttttgtatttttagtagagatggggtttcaccatgttggccaggctggtctcgaactcatgacctcaggtgatccacccgtctcagcctcccaaactgttgggattacaggcgtgagccactgcgcccagccaagaaatactttctaaaggttgttgtttcatgggatttttttcctcataaaagttaatattacatttcttttaaattggcagcatagggctattttttgtacactcttctacaagtgaaaatgcattgtattaaatttatgtctgtatgtatgtacacatatgtattattgttaacttgtgtccttatctcaatgaatccaacagcactcagatacatcgagtttaatcactccattaaaatacattgaataaatctgttagattatgacatgagagtctcataacagaaaataaggtttgcttaaacatacatgcatataacttattactatatacattctaataaatcaaagacactagccagactccattgttcaagaacgtttgtaataataaatagtaagattgttggataaacaaattatatgcacatataatatagtttattactaatatacactatatatattatatatacacacatgatatataaaatatatatactctgaggccaggtgtggtggctcaagcctgtaatgccagcactttgggaggctgaggtgtgcaaatcacttgaggccaagagtttgagaccagcctggccgacaaagtgaaaccccgtctctaccaaaaaatacaaaaattagcctggcattgtggcgcccacctgtagttccagctactcggaagactgaggcaggagaatcacttgaacccaggaggtagaggttgcagtgagccgagatcgggccactgcactccagcctgggtgacagagcaaaactctgtctcaaaaataaaaataaaaataaaaataaagcatatatagtgtgtacatacgggatgtctgtgtgtgcctgattgttagtagccaggcctcatggttgaaaaaaaaaatgttacattcatatgcatggaaacttgatcctcaaaattatatttaatgcaagttgtaattttaaacattaatagtcatatagtcagatgtcagtcatctaaatataagcatagccctagctctcatacattcatggttattttatctatattatttctatttcattattgatgagttttcaaatgacagtagaaattctcagttaaatttcagatatgtataatgtagaattccggatatatggtgaagcaatactacttttgcactctgttttctagtaatctcttccatgttttaaaatacagatacagttagaagatacactggaaaactctgaagaaacttaattttcaatatttgttgccatctttttatcaattatatgtatgaaatcaactgcccctgtgccaactgtcaattctttataacaataatgctcaaagtgtgatcaattactgatattatgggcatcctttggagtttgtgtgaaatgaaaattcatgggcctcattctcaacctacagtctgaatctctgggaccagggtccaggaatctattttaacaagttctactgaaaattctgatgcttagtaaactttaaaaagaactgccattggccgggcacggtggctcacacctgtagtcccagcactttgggaggccgaggcgggcagatcatgaggtcaggagatcgagaccatcctggctaacatggtgaaaacctgtctctactaaaaatacaaaaaattagctgggtgtggtggtgggcgcctgtagtcccagctacttgggaagccaaggcaggaaaattgcttgaactcaggaggcagaggttgcagtgagctgagatcatgccactgcactccagcctggatgacagagcaagactctgtctcaaaaaaaaaaaaaaaaaaaaaaaaaagaactgccaccaaatttgatgtttgcatttaacagtgtctttatggaataaatgcttgttggatgtttcttgagtgaaatgacaaagacttaccttgcaagtagctgaatctctgcccgtgaacaatccctagaccattactctttggagtaatgtctctttcttgcttcatataagtgccattaagaacatatatttctcataaaaaaatttttagatgtcatagtaatgttgcatatgaacattttaaattattttcatttttttaaaaaaacttgagctctttaataattcttttctaagacatatatgagcctgccccaagttacagtgcttacttctctcaagaatgttcaaaaacaaatttttcatcaatatagcaattctaaaagaaaaacaattttaatagtaatgaaacattgtttaaaaacttatctaaaggccgggcgcggtggctcacgcctgtaatcccagcactttggaaggccgaggcaggcggatcacaaggtcaggagatcgagaccattctggctaacacagtgaaaccctgtctctactaaaaatacaaaaaaaattatccaggcgtggtggcgggcgcctgtagtcctagcttctcgggaggctgaggcaggagaatggcgtgaacccgagaggcggagcttgcagtgagccgagatcacaccactgcactccagcctgggcgacagagtgatactccgtctcaaaaaaaaaaaaaaagaaaagaaaaaaacttatccaacttacttatgatttccttaaagaactagttttttgtttcctatggctacatcaatgctttgtcctcaaagctcttgttacttattttttctagacatttgcttcaaggcaaaaatgtttagtagttatttaaaagtatgctaagacctaattcttcctcaagaccatttgaaatgaatacatgacactcttgccactgcaaggtaagtctttatcatttcactcaagaaacacccaacaaacatttattccataaagacactgttaaatgctatgtggctaacaacgtctgaaaataagcatgtgatttttgttttctcttattgctaaaaatataaattataaaaatatgctgctacatgtgtacacagttgcattttcacaactatagatatcggtgcacaaaaagtctcaagcctttgaaatctccataatcccacataaccatggtcctgagagcttgtggaattgtcaaataccttatacaaaacaaatactatttacaaaaacaggcatatttctggaatgctaatcaaagcaatacacaacacacttgttttgctattaatccagaagctctgccaagtctagcatcagtatatgtcattcatttaaagctctattttaattgcattcctgcttcagatccagtaactagtaatcagcagtatctaaagacatttttcaaaatgttattaatgacagccaacattttcttttaataatcctccatgaaatctctctgacaagcacaacctatatacaatcatctgagtaaatgtttgcaggataagtttgccaaaagtctatttctttataatactctggccagttaaaaaaaaaaagatttcaacaaaagctaaagtgttgcgggagaaaacgacaatgacacactttctctcatacttcatgtagaacaaaaaacttcctatttctgcaagcaatttaaaaaaaaaaaaaggtatgtcaaaagactgcagccctgccagaggtgttagaacccaaaggactctatcttgaacaggggctgggtaaaatgaggccaagaactgctaggctgcattatcaggaggttaggcattcttagtcacaggatgagataagaggttggcaggactagttgcacaagatacaggtcacaaagaccccagtgatgaaacaggatgcagtaaagaagtcagtcaaaacccaccaaaaccaagatggcaaatgaaagcaacctctggttgtccatgtgctcattatgcactaattataaggcattagcatgctaaaagacactcccaccagtgccatgacagtttacaagtgccatggcaatgtccagaagctaccctatatggtctaaaagggggaggaaacctcagttccagaactccccacccttttcccagaaaactcataaataatctaccccttatttagcatataatctagaaataatgataagtttactcaatcaagcagcccatgccattgctctgcctatggcacagccacccttttattcctttactttcttaataaacttgctttcactttactctgtagccttgctcttgaattccttcctgcatgaagccaagaacccatgtggcctcccagactgaactccaattttggggtttaccttgtgacaaccccacatctctcttccacgagaggagtgattatgagagaaatactactaccaggagacaattgctttagaatgtattacataaactcctataggcgccatgatcatgtactgcctaaaactatccaaaacagtaaccaaagtttatatttttagcaaaggttttaggctttcaagttttaggatgatagactaaaatcatttcttccgaggctactgcttcaattccaatgaagaaacactttaaatttcaaagaaaaatatgtagattgagagagctaatcgcatatgtcatcgtttggcaggtagatactaagtatgtttctacttaacatagaaactttacagattacagaccacttttaaaactatttgtctagtggagcctcatcacaacacatctatagaagtatgtaaaattatgcactattggctgggaatggtggctcatgtctgtaaccccagcactttgggaggctgagatgagatgatctcttgagcccagaagttcaagaatagactgagcaacatagtgagactttgtctccactaaaaattaaaaaactagctgggcatagtagtgtgcacctgtagtcccagctattcaggaggttgaggtgggaggatcacttaagcccggaagtttgagactgcagaatgcaccactgcactctgcagcctgggtaacagagtaagactctgtctcaaaaaagaaaaaaaaattttaaaaagggcacaattattcttacattttagagaggaaacactgaagttaagagaggttaaggaaacaaagctagtgactctgggagagattggggcaattgggattgaacccatgctttagcacactcaaataaagggtattttccatgataaagcactttatgccacttgctacaggggattcatgagacaatgtatataaaagatatctgtacactgaaaagtactttgcaaatccatgggattagtaaactatggtgctcccagatctctctgggattcagttccagaatgccctaggtgttacgcattccaagaccttcatataagcacaaccaataagactatttcatgtcacagagagagacctccaactcatgagtggaagtactgatcaacaaggaaattgtggatactactttgtgaatcaccacctggccagtttggcaccaaattccatactttacatttaaccaaacactttcataaaaggacagcagaagaaatgttcttaccaaaacagccatcacaataaattctaaagcaaaaaaggttcacacgaaattcaaaattttacattatccaataatcaacaagtggaactcgtgatcagattatgctaaatgaatagaacccatgctaaaacaaagaagcagcaggtccatagatttcaatctgttcgaattagcaacaaattagctaaatcaacaatatggattaatatttctaatgtgcaaagtacttatctagtcaccaagacagggggaaatgtggcatgattcattctgccctgagggagcatggaatctcttatgggagaaaagtatgtagataaataagtccgcatcagtgaatcataaaataaacgagttaagaacgacatgccggccaggcgtggtggctcatgcctgtaatcccaacactttgggagggtgaggtgggcagatcacttgaggtcaagagctcgagaccagcctgaccaacatgatgaaaccctgtctctaccaaaaaatacaaaaattaggcaggtgtggtggcaagcgcctgtaatcccagctacttgggaggctgaggtgggagaattgcttgaacctgggagctggaagttgcgtgagctgaaattgtgccactgcactacagcctgggtgacagagtaagcctccatctcataaataaataaataaacaaacaaaaccaaaaaaaagtcataagaaatgaaaaaaaggatatgtattttcatagaggatcattgaaaagaacttcacagaactagggacccataaatcagcttagaagggtgactgtgactagaacttgaccagctgtaagtaaatttgggataaggataatattgaatgtatggagtggggagtatggtgtctgattgctagtaggagaaaacacatagcagaaaacaaggctggaaggatagcccttggattcaatgaggagccactgacacactcagaactaattgtttgttccaacttgtgtttatgaagacttgggtgttggaacagaagatggattagagaggtgagacattgcagtaaagtaaaccagagcaaaagtctttacaacgtcttccaatcttctgtctgccatttctagtgtcagtatgccaccagggtgtcagaggacattgggtgaaaggaggaaaaggatgttaacctatgaaagggaatatggaagtgcaatctcatcaacatggttaccaatttgttttgagaagtggggatgagagaaatcaaatggggaaaggcaccaaagtttccaatctagatctcaagggaactgatggtgtcaccaagacgaaggaagaaggagaaacaagcatggggaaagatacggaactgagtgcttaacacagcgagttagaggtgtccagggtacgtacaaggagtgttgtccaacaagctattgaaattgtggatatgcagtttaggataaaggttaaagctaatgatggcatttataagtttcttttgtctttctctctcatcattaatttattccttttacaaccatttcctgagttctaactataaccacagtatcatgctaagtgatgggcctatggctaaatctatgaactacacaagggactgccttcaaggaccttaagtctctacaaagatcatagcatgtacatttacaagcaaacgtcaaagatacagataaagaggtacagacaaaattaaattggagtgtcaaaaattttaggagttgggctatgcgaaaactagaatggcaacctgtatgagatttcatggtttagtaaagtttttttttctttaatctgttttgttctctctttacgtgtttgtgcttcaaaatgaggtgactggaacacgttaataggcagaaaacaaaggatcaaacggaggaagtctgactgaagatcaggatgattgaagatgtagaagaagtaggaaattatcaattgatcaaggtcccagagactgttgtaggggttacaatatgaaaacaatgaattttagagaggcaacgtatcactcctatcattgaacccaaccctatacagcttccagatttgaaaactgaaacattttcacagaggcaacggccaagtggtagggtttagatccatggctctgcctaggactggacatgaacgtacagtttcactccagcttagaggatgtaagcatttggatgtagggaaatgtgacaatgatcatgtggcatgttgataacctgtgtgaataagccacaggtttccaatatggtgggaaggcactgatgtttagatgtgtgtgccttcgtggatgcaattctggtggctgggctttagtagtcttgaatggatagataagtcaggccacttcccaggtgagggactctgaaactcatgattctagccaagtctgaaggcaaccaaaagagcactgagttttagatttggactgacccagaggagaatccctcatctacctcaagctaaatgattttttcccattcaagttttattttaacctctctcaactatacgtttctgatacataaaacagtgaaaaaatatttgctcaggtggacttttttcaaatgaaatttataaagaccaccttttaaggtgtctacacatagtaggtacttagtgaatctagttctcttccatttctaggggaccaataaggagactttattttatagttctttcatatttccctaatgcctacctacattttcccttttaattggaaaagaaattcaaatttctcttaattccagtctctcaagcatgttctaataattgtttttaaagtgccacatttcttgcccacatttccaaaagctaagattgaatggtgtggtaatattctgtgtgtggccagaacatggaatgagaagggatatcctgagaccatagcccagtaccttttctttcacaaaagtattttctgttgaataattaaaaaatcaaataatgccttatacttaattttgtctggagtattgcctggatataaagaataagccttggggttcttaaaaaaaaaaaacctccaactttttattttatatgggtatacattcatatcatataacaatgctatctacaaaagtttgcaaagaccatttctgttttctgaattaatggcagcaagtttctctaaaaagctgtggacctgctttttagatgaaagctgtttttttctcccaaatatatttcctaaaatatgtgcaccctactgcctttagaagtattcatggcctccctccagctctaaattggtactgtatagaaattgttacaatcctgtgtgtcgaaaagtgcactgtgtcttgccaaaataatgaaatcttttggcagacagccctctgaagtgcagttgaacaatcattgcagcctcaatcacagaggattagcatgccagcctagcacaaccacaacagcatcaggcctgagacgttcgcatcacaaatcaacttgctctgaaacgtccgaagggcaatgactctctcactgcgaaacttatcaggaaacacgggcctcattttatcacaactactttttcacaacaaagggagtccttggagtttcgggggaagtgtttagaaactacataagtaaatgagaggaaagcaatcagaaaaccatactctcagtgtaattcttttccacttaattaagtttcttgaagtagacaaagtcatggaattctcttacctggaagacaaagcataccttctttgcattcctatttttcaaccgcaatcttctaatatggcatttttggtacagtattgaagcttcaaatagtattcccatggtcactgctcaaatttaaaagatattaattatgaagagaaagtgctaactttccagtgtagaaacctagcagagcgcaccttaacaaaaggatcaaagatattgcctccaagaatgggggaaaaaagcaaaacgaaactcaggtgtctcctgaaaggatgcactagcaaggactcagcatctcacagaggcaggattcctgcccattatagagaacctgaatctaaccaagaggaaataccaaacaatctacaaagcaattagcctctagtcttcaaaaatatcaatgtcctgaaagacaaagaaagactgaggaatggttccagaccaaaggagactaaagatacatgacaacaaatgccacacataatgaagaattggatcctgaatcagacaaaataaggctataaagaacattatcgggacaatcagtgaagtttaaatataaaccgtagattagatgttggcgttacatcaatgttaaatcacctacacttgataattttatcaaatgatgttggtattatatcagtgttatcacttacatttgataattccattctcttagtagattctcttagtagttactaagagaatgcacttgttcttaagaaatgcatgcttaattacttggaggtaaagaatcatgatgcctgcatcttcttttcaaatgattggaaaaaaatgattataagtgtatgtgtgtgtatatatacacatagtatatatgtatacgttatacatttgtgtatatatacatatatgtatatgcagagagagagaatatgatgaagcaaatatagccaaaaaaaagaaaaagaaaaggaaaaaaaggaaaggtaacgactggtaagtctagattgggtcaagcaactagaaaccagggaccaaatgtggcccacctcttgtttttgtaaataaagttttattggaacagagccatgtctgttcatttacatattgcctgtggctgcttttgcactacagcagcagagttgagtagttgcaacagatgaccaagccagcaaagaatatttataaatctttgacagagagcttgcaataccctgatttagatgaaaagtatatggaagttctttgcagtgttctcataacttaagtgtgttttttaaagttaaaataaaaaataaattcataaaataatcttaaaattatttaaaatctcaaatcacaagttttctctagctggcattattaaaaagctattatggatataaatctatgggcagagagcattaaaaaatttaagttcctatcaatgggcttataggaataaacagatttaaagacaaatgcttcagatctgaaacctcataccaaatagatgatatgtcttcccaagcaactgttcaagaagaaagagacaaaacctagaatcttttaggctctgtaaagtcagtttcaataggctgtataaactggtggtttaaccacagcctcagaaaccctaaagtagaggacccagcatagcctcagtcatcttggaagtcccaggtaagctccagggtgactctgtaaggatcccaattgtccttcctctctgccatcacttctaattacaaaacacaggaaacgaggtcactcagcactgtggtccaatttgcctcttggaccctctgtgtccctccctcctttatactagataagtccttcttacaacatccaagcacgatgttcctcacaacgaagataggagatggatagaacctacttcttttgcagttgcaaactactgcatggcatgtcctagataagtattagttttcagtagtatgttcactccctggctacattcatacatgaattctaaaatcagcagaatcagtctgtgtttattaaaagtccaatgaaggaaaactgatgttggtgttttgccaagacagagcagtaaaggaggggtaggtgtcctttcctcacaggaggaagcttacatcctcacatgaacattttcctaaagacacaaaaaaactcaccctcagtgggaagtttactggcgcacagacagcttaataaaatgatatacataacaagacagccttttctctgggaaaataaaaatgcatatttaatcaaagtgctaaaaaatcagtaagggctagaaactattatctgtacatgtaatttccaacccagaaagtgtaacacacacacagacacacaattttttaaaattataatctgattataggacatctgtatatccttcggcagactatcaaatccatcgctcagctttctccaatactgacccccaggtaatcaaaataactcaagaatcctggcagagccattagccaggttttacaggctgaattaacgggatccatgttgtgcgtccagaatctcaagtgttcattagatcagattttgcgtaactcaactggaatcaccagtcacagcattcgaagaacttaaacagccaggcccgtctccccagtgaaggtcagaattgaatctgcacagcatgattctgacatcactgtgctgcaaggttaaaaaaaaaactgtgacaagttgaatggagattaggatttccctcacttggtgctatgtttaaaagcttatgctcatctagctctgatccttatctccatatatatttttttcctacacattttcttgacaacacacatctcctaagaaaacatttgattggtagtcctggagaaccatgtcaatcttattcccaagttgggtggcctggtgtcctttcttcctgtgctaatgaccttacaaaatgcggcatacatcacaggaggaatgggattttgctctttgtccctgtgttaaatctcacagagctacttataagcctgtcttatttataatatctgcttcttgcttaacaagattgtttatatcagtaatatataagaatgccatgggtaactatatgctgttggcttattgtttccaataaatgcatctctttgtctgagaggtgagtgattatagtaggttctaagagagaacctaaaatgaagcatgtctgtgcagtgagaccaatcagcaacagtgtcaacactaatcctcttctgatagaaggagcttgtaacactgacagcttaatatctatctgtgtggcttggttgtctgatatgtcaaactcaaggaaggcatggtgtgctcttgaaaagaccagggagccaaatctcatggggactttcatgtttcctgtctcccttgccagatcaaatcaccccagctttgtcaacatgaaagctcctctaagacattagtgcatccctgagcaaactcattcaatttggcattatgtggtaggtctgctccagattaatgagttagacatcatattcataacttttcagatgcttaaaaggaaacaccatggtggagaatgtatgttagttatggatggaaaactccgtttataatagaacctgtttggcctttaacccaaacttgaaatttgtacaacctcacttgaatatttaattttattctctcttcaccacaaaaagagtgatgttgaagttcttgtggccaatggaattccatcataatacagtaacaatgaaagctatttgtgaactcaaccaaaacgagcagcaagcactaactcagtaagtttggatcatgaaggtttgtttaactactgcagtctttcaagagattttgcacagggtttagaagagcctccttcatactgtgggcaatgcaaatgtcagtttcttgtgcttgttttcccttgttatccccttgactgaaatacacatttaaggactcaaccaaagatgtctcttcctcttgttgttttgcattttacaacttagctaactgaacactgttttgattaactctaagcttaccttcattacccctttacccattcattcatcagctgctctgctgaaccaaaaaaatgcagaaaaaagaaaaaaggagtagctcacattacctagaccagtggtgtccaacataatgcaagaatggaattgttctacatgtacaccatccaatatggcagccagcagccacatggggctactgagcacttgaaatgtggccaatgaggctgaaagatgaaatattcaattttaataaatttaaatctataaagctatatggctggtagctaccatattggagagaagaaactgaaaaagttaaaaggaaagtacaaaagtatgcattcaacatccatcacacccaccttccagtggaagaggaagtagaagctgcatttcccagatgatcatgccactgaaattctgaattcaattaggttatgctcatcaatatatttacgcagcatttgaaggcaaaaagaaaacagaagatattttcttgcttgtgccttgttcactatttctgtggtttagaacccttgtgaaaatgtgagggttttctgctgcagtcttcaagtcttcattctccagcttcctgggtatctgtagaggcttcatcaggggatggcccttgactctcacattgttactccagagagggctcagagcaagcaggagagtcagctctctgttttagagtcacttctggaggctgagcctagagtccattccttcaacacctctaatcattttagaagcatctaatcccttgtattaagttccttctagtttatgtacctagagtagtttgttttcttcactgacactacctgatgaaagcaactaagatgatacatgtgaactgaaattttttaacccttgtgacatcaaaaatgcaaagaatgtagccataacttttctgattatctattgtgtcaccaatatcatttctaatcttacaagagtctccctttactttgtaacctccctctctaccttctctgcgtatgtatttattgattcacatctatgcattgggcaatccaagagatattaggagcacgtggatgcatcaaacacacagtctgcatgctttgaccttagaatatgatggagaacaaaattaagccattacaatacagtgggatcaaagccgtgagacaaaggcgtacagaagtacagatggggagaacctaacccaagtgacaactatgcaaaattccctgggcaaagggatatgtctaggcagaaaacaaaataatgagtaggattaaccaggcaaaagcaggtgggatgagagaagagtatgttccagatagatttgatctttttaagcatgaaaataaaactgtaaattttagcaacatagaggcactccagaggtttctgctgtgttctgagatgaagacaaatgatctataattcacaggctatttagagtcaactttagctttgggacaagtgggagcttggatcttagcaatgcttagagcgactgctggatatgtttttagaagtatagcaggctttatgtagaccagtagaacaaagaaaagaaaatgattcttattgaagacatgtacgtttcctttatcagagagaaaggacctagctttcctttccccaaagcatgcataccactggtaaaacgagtaatctaattacttcaaaaagacagcactcgaaggtctgctttatcaaatgataagattccctaagtgaaattctaatgcacctgaaaataacttatataagaacatcatttttataacagacatgtgatatttacaatatagatgatgccattcatgcctgctttcttccacttggggggagcttaaaaagaatctcactcacacatgaaatcattttggagatttaaaataaagtgtacaaatcccacaaatttaaataggcagcttaatgtaatttaatgccactacatgtaacagtttaactggacaagaacacacagaaggaagagtaattattttccatgttttattagtttctttccaactcattcagattgttatacatatatcaattcataagagtaacttaaataccctgtatcctcagaaaactgtttcaccaagatgctgctgataatgtaccctcacttcaccaagaggaaacagatttgctttatttctaatgtcactgaatgtacgtttataatttacagaatgcttctcttctgcttctttactataatagaaatgtattcatgtttatagaaaaacaagaaactcatatccaacttactcattttaaagaggaaatgtgatagactaacatgcaaagaatatattacaaagagaatacaaggcaaaaatatcagaatggcatcttctgttggaaatagaggatactaaatatttttggaggttacacatctgtcagatataaggcaagtccttcccatgaagtgataagcttctctctctttctttgggaaatgtacttgctgttgctctttgttaatgagcaaaatcagtgacccctctagctcagaaaagactcctgatcactgcctccaccgcatccccacccagaggactaaatgaaccagtgacaacaaaatgctcttgtgccctaggccctctatttctcggagtttatagaccacctaacaatcaaagcagggcagtagggggaggccgtctttgtccctgctgttactttgtgttttttctcgctggcttcccagtcccctccgggcaccatcatcaccatatccctcatggctaagcagccagaggcatggggctttcactccaaatttcacggcatgatgaaatgcaggggctgcctctctggggatctcaaagccctcctttgtgggcctagttgagggtcaggttaagtagcacattttggcagcaggcatctgtttgtcttcacgccatgatcttcctaacaagggggagggagaggaagggaagcgggaagaggagagacagtttcagaaaaccaccttcacagtggcaagcaaattcccttcagcggcttgacagactatgaggccaatgtaaatccaatgcctaccacactgatggccccaccgaatcaattcgattgagccgtgagacagggagcttttcctttcttataggctgaggcctcacttgttgctctaaagagaaaaaacaaagcaagaccctttcttgctcagactttttataaagaaaatgaacctgtacaaaaaaaaaaaaaaaactgttggaaaggtcgcatttcttgttttttttttctcttgtaatataatcatagaattttaaaattaattcttctcaatacagaaaccctgttgctataattgggagacattgctactcaaggcaaataaagagctcattctatttaaagaaagcctttatgtagaaaagctttacaagacatgattaatattaattatttctacaagtcatagatacaatttctactctggaaagaaaccagtgggtagggattgttccctaaaaactcaaaccactgaatatgaccaaagtcaatagttcaaaagtagagttggttttctaatataattaaaacccacatatcaatgttttctcagaaaacagaattatacttcgttccctgtgtcattctctaagaatagatacttacttcctcatgtcagcctatatgcaagaagaataagccttttaaaatgatgagaaaattagtaggaaatgataaatgagaaataagtaggtcagtcagatgtatggagtatccggaagagtaaggaatatcacaggggattcgaaagcaataaaaaataacatacttcatgaatctgaagaatcattgtaaaaatcatcagatgcagacagacacacacatgcatgcacatacacacagcacaaagaaactaaagcataaattgccaactatctagctcacccttggtaaaggagggaataatcagatgtgcagaaagagggaaaaggaggtatcacatgatataaaacagcattcctcacattcatcttctcattaaaccattatttatttctgtgatcccttttttcttcagcaaagtggatgatattattccatcaatattttaaaaagaaaaacagtatccactggagaatcagcttctttagcaattgtcaccattgctccattacactatcacacacacaaaaattcaagacctgcacatcaggagatggaaatgcaaattacactggtgtgcatacacacacaaatacaaaggctatcttattggaagtcttcatggatttcttaaagcgcatgggaatattatgtcaaatattaaatacacaccatagtcagtttggcacatgaaagtaaagtcattccaaggtaatgatttaaaattgtgtggtgtttaggtagtctgctcatcttttctaaaaagtattcatcaaaattccccgaaaactgatttaagattaatgcttagagttctagataggcatccattctgccgggtttttttccccctgttgtctgggattttattttattaggtcaggggtttgcaataggggcaaaggaagagacacagagtttattttaatattgtaatgtaattctagagtaaattagtaaagttttatgtataaaatctcagaataaaataaatacaacatatttataattctatccataccattaagacttgtacacaaatgctccttacagcattattcataatagccaaaaagtggaagcaaatttcatatataattactgacgaatgaatgaataaataaaatgaaaaaagaatacatggaaatattgtttagcaatgaaaagaaatggaatactaaagcatgctacagcatcaatgggcctttataatattatgctaagtaaaataaaaagccagataaaaagattacatgctgtatgattccatcatttatatgaaatgtctagaatgagtcaatctatgtagggaaagaaaatagattagtggatatgtaggactgaaggaattggagggaaagggaagcgactgccaatggctatgggatttttttgggggtagtgataaaaatattctataattctgctgataattgcaagactataaatacatgaaaaaccaatgaactatttaaacaagtaaattgtacagcatgtgaattatatttcaagaatgttattaggcaaaaaaaaaaagtttctaaattcaccagtatatatatgtaatttatattgaacaataattaaaaatgtactgactttccctgtcaaatagattgtaagttaaaaattcagtgatcttcaactatcccattttgaatagattcatattgtcaaacatgtctattccattcaatggactaagcacatggatcggtatctcttaaagtgtgggtttggtcctcccctctcccacactccaccaagattaggattgagtaggtttgaagttgcagccagaaaaatgcatccatgggcaccccaggtgatcttgatgcaggctgaatttgagagtcatgagccatatagcagcaattacttcaaattacatgaagtctgagaatagatcatcaacacataaaaatggaaaactttataaagaactttcaatgcctcctctttcgtgttagtttttgaataataatttttcatgcaacataaccattcaaaagcaataattctagaaactgttagacagcaattacattaacttaaggtttatgagtcaattgaaacacatttttttctaggtgttgatgacctagaggaaaatgaccacttgaaaaattaaaaacttagagacatatcaatgaaagaattggcactcagtgaactcctaataatgcatatagaaggtctttattgaataaaatagaagtgtttgcaactcagaatcatctactctttttaaatgtcaatttaacaaaataatgtatcatttaaagatctggtgactaaaattttcagtataaatcatgtgttgcattaataagttgggccctttcattttgtgttatgctgttgttccattctacttgaggactaagctctgattctttcatgttgtccaaattcctatctaaggggtctagggagtcatgccctacaaaccataagttctcattagatgggctttatttaactctatatatcatgacttattttgcaacgtgactctggcataacattacgagacaaggaagaaaatcaaaatattttacccccaaaatatgttttttgttacattttgaaatggtcctgcaagccatcctttgtgaggaaaaatgcacatctgtaaagaatccctattaacatagctagaccttttccttccagtctaccaccttttaaagggtctgaataggaaacatttgtcatctattgtttctaacagcagccactgtgagacttcaaaagaactttggtctcctcaatcttttatcttaacctgaacatttcctttccattgatcccaggtctttagacaaaaactcagccaactgtccatcagaaaatgtttaaatttacctataacctagaagtgccacccccccaaccccgcctccactttgagttgttccgcctttctgaaccaaaccaatgtctttcttaaatgtatttgattgatatctcatgcctccctaaaatgtataaaaccaagctgtgccccgaccaccttggacacatattctaaggaccttctgagggctgcgtcatgggccatggtcactcatatttgactcagaataaatctcttcaaatattctacagagtttgactcttttcgtcgacatacttgtgtttaagatttagcttgacgaaaataccgttatgcagaggaccattcagcctgtaaagtaaaaataaagtaataaagttctaagcctccactcaatggaccccatcttagccaaggggtcccaaataaacctgaaaaattagttcaagccatgacaggaaagaagggacagacatgcctccttcctttggagtttaggcacaactgaccagcattcacattagcatagggatcttaagactgacaaaacagactctttgtagcaataagatacccaactccaacctgaccgtagtatagcatcacatgacagatagcaggccctgaaaaaaaaaaaagtattttacctcaaaatatatttctttgacatattctgagatagccttgcaaagccatctcttgtggggaaaatttgcattctgtagagaatcgccttcccttattagttcttttccagagaatctgacaccttttaaggtccaataagaggtatttaccatctattctctctgaagcctgctacctggaggcttcacctacatgacaagaaccttggcttcttcaaccccactgtccttatcttaactcaagcatttctttctgctgacttcaacatttcaggcagagcttaactctttcaaccaatcgccaatcaggaaatctttgaacccacctatgacctggaagccctctgctttgaaatgtcctgccctttcaggctgaaccaatgtatatcttccatgtattcatttacatctttgcttgtaacttctttttccctaaaatgtactgagaagctgcaacccagctaccttgggcacatgttctcaggaccttctgaggccctatcataggccacggtccttaactttggcagaataaacctctacattgattgagacctgtctccaatacttattggtttacaaaccttaacattatattagatgggtttcccatgtgtaatttcaaaatgcaatgctttcactgtaaaagaactcagctgcaaacacatgcccctcaataggcagctcaaagttcctccagggagaagcactgaggcagaggtgaagctaggagctgagtgcaacatcgacgaagggagtccaggcatcctgttgtccagcaggaggggaaatggccatgtctcagcagaaagaggaaccaaagagctttctgcaggtgtcggcagaatgtgaattgacaaagattctcaacttcacctttctgaagaaatacttctcgtgtggcccctcagaccccaggctcaaaacacacacacctttcagtcaacctgatttcagcaaatatcctaccctaacatagcagtagatttacctgtctggacttttgtttttactattacttcccctcttcatatttctccactcttcttctgaatgtgttctctttaagctttgttgttgttgctgttgtttccatttatttttatttttagtttcagtttagtttagttttgttttgagacagggtttcactcctgttgcccatgctggagttcagtggtgcaatcttggttcactgcagcctcaacttcccaggctcaagcgattctcccacctcagccttctcaggaactgggactataggaaaatatgaatagattcatattgtcaaactaaggcgcctgccaccgcgcccagctaatttttttgtgtttttagtagagacagggtttcaacgtggtctcgatctcctgacctcgtgatccgcccgcctcggcctcccaaagtgctgggattacaggcgtgagccaccactcctggctgtgtctgggtaatttttgtatttttgtagagatggggtttcacaatgttggccaggctggtcttgaactcctgacctcaggtgatccaccccctcccccctcagcctcccaaagtgctgggattacaggcgtgagccaccgtgctgggacaattttattcttttaggttaataataaagagcgaaaggaaagatggtgagtctagcaacaaggcaataaacataggacagtcaaggaagacatctttttttgagacatggttttactcctgtcacccaggctggagttcagtggcgcgacctcagctcactgcagccttgacccgccaggctcaagcgattctcccatctcagcttcctgagtagctgggactatcggtgcgtgccatcacctgtaataggcatgccatcacctgtagtagccgccacctgtagtaggcagataaagtaggattttgtgggcctagtgattttggaaaccatagctaggcctttaaagtcctttgagaattgctacattgaagtgatactgtatttctcagcatgaaaataaatgtgaacgctaacactcattttccatcttttcatggctgcaatagaaagcttcatgtattttgtagattacaattataagtaaaggctaatccccttccctgccaaaagggggaaggcttgagaataaaatcctgtttcaaaagaagatttctggaccggcgtggtggctcacatctgtaaccccagcactttgggaggctgcagcgggtggattgctttgaggtcaggagttcaagacgagcttggccaacatcatgaaaccctacctctactaaaaatacaaaaattagcttggcgtggtggtgcacgcctgtaatcccagctacttgggaggctaaggcaggaggattacttgaacccaggaggtggaggttatagtgagtcgacattgcaccactgcactccaccctgggctacagagtgcgaacctgtctcaaaaaaaaaaaaaaaaaaaagaagatttcacagggcacttgcatgctaccaatgagatcgaggtggagggtccgatccttgtctagggtacaatttgtcgtgagcatagaacgctttgttctaccatcaaaggcagaaatgtactattcatcttgtataggcagggtgtctcagcctccacgctactgacatgcagggcttatccataagcctttgttgtggggggcagttctgtgcattggaggatattagcaacttcgatgctagtagcacttccatcctcaggtgtgaaagcccgaaatgtctcaaaacattgccaaatgccccccagggacaagaactgcccccgggttgagaaccagtgatatagggtacatgcttataaataaataagcacgaaaccatcaccaccatagggaaaggcattcagaacaagtctttctggttatgactcagaaccctcatctccacaatattgatttcccaatcacacagtccagatggaaattctaagaaagggctaactcacgtaggctaggagagaagcaattcactgtcaccgcaattcaaaggatgatagaaaagagcaagcaaaatatatagcaagtcgcactaacacttgaaaataacttgagagctttcaaacaattcccacaaatccaaactgctttgaagcatatttctatgataattctggaatctttatgtaaaaaaaaagtgaactcttagcttttgagtgagttgagtgtattgccagcttagaaactattttagagacatttttcctcttagctacaagcagtaagcaagtgcacttcgtatgttcaatctccttaagaaaagacctgggacttcattagggtgagtgacagaggagaaaatgaatcgtttgagccaaaaaagcatcttaaacctataccttttaataatttctcatttcaacaccctgacatgctctatgcagcttgggcatctcattagggacaaataatatcatcagaacttcccatctccacaaagcatttgaaatccagtgagtttattaaatggcatagtgttataaattgataaatgttataaatttataaactgtataaatgttataaattgataaactgtacaaatattataaattgatagacaaaacaattaaaataatgcttccaggatgaactaatcttcgtagtggaaaacaatttatatgcctccaaagtgaaccaatatgatatattaaaatagaacaattggccaggcgtagttgctcatgcctgtaatcccagcactttgggaggccaaggcaggtggatcacctgaagtcaggagttccagacaagcctggccaacatggtgaaacccagtctgtactaaaagtacaaaaattagccgggcatggtggtgggtgcttgtaatcccagctacttgggaggctgaggcaggaaaattgcttaaacctgggaggccgaggttgcagtcagctgaaatcgtgccactgtactccagcctgggggacaaggcaaaattccgtcaaaaaaaaaaaaaaaaaagaacaattacatggaaattattgtgtaactgaggaaacaaatttaactggatgaagtaaatgccacaaaaatgcaataaacactcaaataactatttgccataaatctagtctaaaataatgacaatcatttaaaaattgctgtatctaagttgaggagttaaaaattgtttgtgttaatttttaattctttatatttggactattgttcataaaagtaatatcatagaaattacacttattatcaaatagcaatattattttaacaatgctttcatgaatctccaaaaggtccacatatgctattaaatagccagttttgacatatatactttctatctttctataattccgttgatgtctttgttcagtaaatgcaaagattagtcctgtgggatgttaaagaacactaccagcatcaggtgcactctaggtgtttagtaaagaaaaattgaatccaagagagaatagccacttagacaccttttctttgatataaaggaccaataaacggacagtctccccaggcagcatctcctttatcagcctccattaaaatggttccaatacagaaaggtgttaagaagtgaaaatccactagacatacgcttcactaccctcgtctacagctcccccaggaacgatacccaaattcctttagtgcccagagtattcacaaaagggccggtcctgacctccaagatgtttcataaattataaagtcaaatctattgtctacatctctgatggtgagaggcaggtatggatggaagcattgagggaaaacaaaatgtcagggtttattaaccccaagtaagagcgagaagagtcccatttttactgctgaggattttatgacccagggagttgacatacgtgactatgtctagggcaatatatcttgatagtgacaaagctagaacttgaagatatgtctcatcatggccagcccaccatcatccccagggattcaccaatgagccatcttatcaacatggtccacagaggtgggacctaccattaccattcccatctcctcctctgctttatttgttgccatacgccttattatcctcttatatcaatgaggacaagacttttgtctttgtccatatcagtatccccaagaacactttgcataagcaataggtattcagtgaacgaatacaacaataaaattgcatcaacctgagtcttaacatgtccaagttccccaatttaaaatttctcaacaatggtaacaatcatctcaaattttgcctgcataaaatggtgctccaacaagtcccatccacttctcagctacatcttctgggtgcaacagcctgctgagccccaatctgggggttgcagtggatttcccaggaagccaatcaagttcaaggtggcccctcacttgtaggagccccttccatggcactggaagagacccaggaaatgtgttcacatgcaaattataaaatttgcaaaattaacctattttctttttgttaaactacataagcttgcatctcacatgcctaaatcctgtagaagtgacaggctttatatttgacaatgacttgcccagtgttacttgtgtctactgcttatgatagtttcctgggggacccataagtagtgtaatcctcttgagacttgcaactttttctggaggttccagttctcctgggtccctcctggcatttccaggcaactgcagaacactgcagtgtccctgagctttgctaaaccattgctttggaatgtgctgataaacacatctgctggtgcatttcccattttctgtttctgaggagatcctgaagccttcttggataatcaggaggagaatctgaacatgtcaaatcacatgtatttgtaaatgagaacagcatggtcagaaatcagagctagaagatgggttaaatagaacaacagtaggcgtttcaagaggatagcaaaaaaagagagggttgaagatatcctactataaaatatcatctgaaaaagataaacaggctaggccaaggtgggcggatcacttgaagtcaggagttcaagactagcctgaccaacatggtgaaacgtcgtctctactagaaatacaaaaatgagctgggaatggtggcggacgtctgtaatcccagctactcaggaagctgaggcaggagaatcttttgagcccgggagacggtggtggcagtgagctgagatagcgccactgcactccagtccaggcaacagagtgagtgagactccatttcaaaaaaagatacaggggctgatgagaatgaattatcgcccacaggaggctgtccttttgaccacactgctgaatcaaagtcaaaggagaggtgtagacagggggaaacaaaatccaatttgtagtcacagagggagtactgggtgaaaaacattttgaaaaggagtcggggctcaacagaactagtttatcaatgaaagacatttcaaagccttgaaagaaaaattactaatgcccattgctaattaatcattctacagattctcatgcaaatgttctttggatggctttgatctgcactgacacctgaaagaaagcacacagtgtctccggacgggagcgatgcctgggaggcaatggcatgtgtgggtacacagccccctgtatgatcccctaataccctgggaactctggagccgctgagggcggccaagccacagaaagcagggctccagcctagcccatgctaggacctcagagatggctccactgtggccctttacctcccaaaccacaaaacacaccctgatcaaaagcagatggccttcccatgccctcgtccttaacaccaatgcaaatcgcctcccagaactgttcaatactcccatactcactgaaaggagaactgaatacgttaaggtcttgaagaattggggagaaaaatgttaaataaaattaactagatattggcaaagtaacaaaactgttacctcatcgatgggggaaaaaaaagactacttggggaaaattaaagagaaatcctttttcaaagctatgttctcaccaatgggtagccaagtgtcttcaatttcgtagtcttacctgatttataacaggagtttgtctgagagatagacctcatttaaaatttaaaattatgtgaaatcaagaaacgatttcccaagttgagatctctccactggcttccacaaggtcactcaataataaaacattttgaagtgggaaattgctcgtacaaaactaggcacattgccgccttcctacccacgtggaataaactcctgtctgcctagtagtttagctgacatttcatttactttcctaaagtttcagccacaattagtgatcaaagacatctggggtcctgtctccctagggtgtactcccagggaacattcattttagacagcaggtaaagaaaacaaggaagtcgttggcactggcctgatgtgcatttattttttatttacttggttttttgtttggttttgtttctgttttttgacagagcctcacggtgtcacccaggctacagtgtagtggtacaatcacagctcagtgacacctacatctcctgggctcaagcaatcctccacctcagcctcccgagtagctgggactacaagcatgcaccaccatgcctggctaattttttttcctcactaatttttgaaagatttttgtagaggtagggtcttgctatgttgcccaggttggtcactaacacctggcttcaggcgatcctcccacctctggctcccaaagcgctgagattacaggtgtgagccactgcacctggcctcccatgtacatttagtttctgatttttgtttttaggaatgattcaacatgatacacatattcataagaaatagcaaaataacctaaaatggaagttagcaagaagaaataagagggaatgaggacatcaagtggaatctgtaaagagtgtgataccaaactacactctactgagtcctcaacacccactgaatgtaggccacaaatttggatttcagcttcctaattcccaacaggaaaagaagaacttgatcaattcctacaatgcaagtattcacataagttaaaagcatgaaaggaacctggaagaacaattatccccaatacaaaatctaaaaataattttcttctgaagttaagaaatatcacgttctaacaatagaaggtactcaagcatcctcaccatggcaaggttgaggagtttcatagagctcttcttcatggcatgcctcacacaaggatagcatctcaccaaagcaaagtcagtatcatcaattctacagggtccaacaaattgcatgagcataaccagtcctctgtccacctggaccaaaccagtctttgtgcttacttatttaattaaatttatttatttatttatttttatttttgagacagagtcttgctctgtcacccaggttgtagagcagaggcacgatctctgctcactgcaacctctgtctcccgggttcaagcaatcctcctgcctcagcctcccgagtagctgagactacaggcatgcagcaccacactcggctaatttttgtatttttagtagagacagagtttcaccacgttggacaggctggtctcaaactcctggtctcaagtgatccacccgcctcaacctcccaaaatgctggtattataggcatgagccactgtgcccagccatcatgcttacttagaatactgagtataattcagtattattatactcacactcactcacactaagatctgtttcttttgttcttgcttttatcatctgctcacctcttcattgcagttgctttagatttggtcatctcggggtgaaagaagaaatagggctcaacctgtagctattggaacaggtctacatgaacccactgtcattttgcttggatgctctcctagattgaatgttcctggactgagagcctagtaaccagatagtggattcttgttatctactccagtaagtgaagtggtgcctccatccttggagtcatcctggacctctctcctcccaatttcaatccttcagcagatcctgtaggctccaccttgaaagtacttccccacatacctacaatctctgccttacttcctccagatttctgctcaagtgtacaaatacacatgacctttttaccttacttgtcggaaaataaacaccctcctcaaaccctagttccccttatctggctcaatttttctccctggttctccttactaaccacagtacttgaattggctcactgcgttttttgtctgtctcacgctagaagggagtttcatgtgggcatggtatgtgtctgtcttttcaccctatggtccagagtccataaaagctttcagcacacagtaggtattcaataaatatccagtgcatgagtgaagaaggagacagcatgacatggggttgcagaaaagaagccaatgactttgttttcatgttaaattgtattgagtagcaagcatgatgccacatttgagggattcagtagtgaccagaactgaaatggctatagccctccagccagctaaatcccttggcactgatcctaaaagacacaaaattcatggctgtgaatatcagcttgagcctcagatccttctctgtctttactctcaactccaagccatccagccccagggctagagctgacactgccttcgttaaacctgttcccctggttcttgaagccaaatttggtcttatgtctcccataggtctgtatcaggagggcagatgattctggcacaatacttcagtataaacaaaccacatgtgtaaccaaaaagcaaccaataaaattaagtacgaatgttccccagcaaagacaatctgtgctctgctccaaaggaatagaattccataaaagaaaaaaagaaagctgtggttttcttgaaggtctatctctattccattcacctgtacagatatttatctcagtaaccaaatatgtttttgacctactgctaaaaattcaccaccatgggaactaaaataaaacaaaagtctttttacaagcacagattttacaaacctcgattcttgctttcatctccgttttattcaccaagtgtagaagcagtacactttctaaagaatttaacataaagagcctttaacgtctccaagaagcaaagttcatgaagagcccaccctgtgattccctgtcccatgactacggctctcagtacggtgtgttgacatgatttctcatctgttcactgctctagaatagtctatcagctccttaaaatcaggggccgggtgtctcattcaaagtttggcaagctaagcccattgggaaatgaatccactctgacatttgcttttgtacagccccatggtgatatttaattttcaaatggttgaaaaaaaataatattttgtaacacctgataattatatgaaaatcaaacatcagtgtccaaacacgaagtttcaatgggatgtagccatgcccattcattgccagattatctatggctgctttcacgctatgtcagctacattagcagtccccaacctttttagcaccaggatctggttttgtggaatatattttttttttccatggactgggtgaggaggaggagaatggtttctggatgattcaagagcattacatttactgtgcactttatttctattattattacattgtaatatataatgaaataattataaaactcaccatgatgtagaatcagtgtgagccctgagcttgttttcctgaaactagacggtcccatctgggggtgatgggagacagtgacagatcatcaggcattagattctcataaggagcctgcaacctagatccctcacatgtgcagttcacaacagggtttgtttgcactcctatgagaacctaatgttgccactgatctgacaggaggcggagctcaggtggtgatgtgagccatggtgagtagctgtaaatacagaataagctttgcttgctcacccagcactcacctcctgctgtgtagcctggttcctaacaggccatggaccattaggggtccgaggccctaggattggggacacttgagacacatcaccacaatcatgctacatcgtcacactgagtggttgcaacagagacaactctgtcccaggaagcccaagacacttgtcatctggccctttagagaaataattttccagcccctggtctaatttatctcctcctccccacagtgcagcaaggacctagaacatagctgatgttcatcagtgtttattaaaatgaactgaaattgtcagcaaaactctgacctctggaaataatctgagatcccccaaattattattttgttatcttataaagcacttctaatacaattagcaaaggctctagcaattacaaagcaaactcatctctcatagaaagttccccagctaggaaaaactggagaaggtaattttatctgatggtatgtcattcagtccaagtccctcaaaacatcagtggagtaagcagaactgtggaattgtttctttgattccaggaatcctagaatcaatacccaacaccattatcacacacacgagcattaggccttgccaagggtagcagccagtaaatatcaggaatggagctaaggaatcagaaaattgaaagaggccccaatttttatgcctacaatatctgacccagccactacctgcacatctccacttcataagacatctttctgcattcccgcaaatgtgtcaaattgggagaaaatccttcctcatatcaaagcagggctaaacctgttgcctctctacctttgatccagcagtgatagttaaaagcacaggctgatgcattagaatgccttgttgtgaaatgtcctaggagcctggcaaattgtgtagcctttctctgcctcagttttcttgtcaataccatggggacaaaaacatacctgtgagtcttgcccaacaatatttaaggcacctacctttcatgatacgagtcagccataccctgtccatccagctgcttggaacctttactgccctcatcctttggggcagactttccattttcctttatgccctgagccactcattcatcctcgtctaagttgctaagcttttctactgaagttattgcaatcattgcaaatatcttcttacccatctccctgcctcctgagtctctacaaattggttcttcccatggaagccagtacctttctgcatggcatggatccctgttctgcaaagtccaggctctttggaacacagttctcaacgccatacatgacttgaaaagctcaactcccgatgtgaggctcttggcgttcaccctcagatgaccatatgttcccccaatgagccagtacctcaggttccccagacacatgctgagggagtctgtgcagtaagaaatctgatctcactcaaagagagatctgttgtccctacccctgggaggcaatctctaaacttgggatgtcctgagtggtaggtgtctttgttattcatggtgcccctaggaccatgcctgttagtttttgctagttaggaggcacctggtagagcccctccaggccaattggtatgagcccaatctccagagaagtgggaagggggcaggcagagattgattttaaccacacgggtcatggctcgatcaatcatgcctacggcatgaagcctcagtaaaaactctggacacttgagctcaggtgacttcccacgtgggtgatatttcgtgcatcctaccatgtgtggaaatgcatcctgaaaacaatggaagcttcgcattgggaattcccctagactctaccctgtgaactcctcttttggctggttcagattcagatcatatccctgtaatagacgtgagccttagcataatagcctgcagtgaatcctgggggtatttttagcaaattgtgaaacctgagggtggttttgagaaatgctgaacttgtggttgggcagacatcttgaacatacttggcaatttggaggactgtgcttgcttttttttttttttttttttttacggagtcttgctctgtcgcccaggctggagtgcagtggcacgataccagctcactgcaacctctgcctcccgggttcaagcgactctcctgcctcagcctcctgagtagctgggattacaggcacgtgccaccacgccaaacagatttttgtatttttagtagagatggggttttaccatgttggtcaggctggtcttgatctcctgaccttgtgatccgcctgcctcagcctcccaaagtgctgggattacaggcatgagccaccgcacccagccaggactatgctcttaacctcagaggttggcacagtctggttttacatgatcctaagatggagaataaggaagaaggggagtgaggcaggggacagaagggagtccagggtacactaaggtaatgctttatgctctgagtacctgggggtcacctgcactgggaaccactgggagtctgttctccttctcaagtgacagggaagccatggtatttctcatctactacctcctgtctattggcacttgagggcagttcccgagggcattaactcccagtacctctagcctgcttctcagtcagaatagggaagtttccacactatgagcaagttctcagatagagagtggcagatgcagcagaaagagctgtgggtgctcaatgtattggcaagcaccatggaagggacatggttaatgccctactgcatgagctcagctatttctaatgcctcagatatgccctggtgcctcttgctttcttgtaacatgctgtccaacctccctgttggacacggccaaacccctccacctcccacgcttccaattagctagctcttcctcagaggtcagctttaatttgtcccagggttatgggtccttctcctattttccctgccagttcacttatagcattttcaagctgttaaaatttcctctttattgcttgttttccctcctaagactatgtactgcttaaaggttggactcatctgttttttaacctccatgccaaagatacttacgaattgttcaatgaatatctatctgttggatggatgaattcattctgggactgaatgtatgaatgaatttaatacttgctctcaggagcagtctcaccttagagggggtcacaaaaattcgaatggaataattgtagccatggaacaacctccttgatgaagatatgctggaaaatatcttcacaagccctcagattacaccacctagattagaggactacctcttctgctctcactttgcaggtaaagaggcatgcaccagaatgctgtggaaacatgatcaagagtggatggcaggctgggcacagtggctcacacctgtaatcccagcactttgggaggctgaagtgggaggattgcttgaggccaggagtttgtgaccagcttgggcaacatagaaagactttgtctctacagaaataaaaaattagcagggaggccaggcacggtggctcacgtctgtaatcccagccctttgggaggccgaggcgggcggatcacgtcaggagtttgagaccagtctggccaacatagtgaaacactgtctctactaaaaatacacaaaaaattatccgggtgtggtggtgtgtgcctgtaatcccagctactcaggaggatgaggcaggagaatcgcgtgaacccgggaggcggaggttgcagtgagccaagatcgtgccattgcactccagcctgggcaagagaatgagactctgtctcaataaaaaaaaaaaaaatacacatctatgtatatattagtagggtgtggtgatgtgtgcctgtagtctcagctactctggaggctaagtcaggaggattgaatgtgaccaggaagtagaagctacagtgagctataattgtgccactgcactccagcctgagcgacagagtgagactctttctctctctctctctttctttttctttctttcttccttcctttcctccctccctccctccttccttgcttgctctcttccttccttccttctctccctccctgcttgcttgcttttctttctttctttctctttccttccttccttccttccttccttcctccctgcttgcttgcttgccttccttccttccttccttccttccttccttccttccttccttccttctttcttttctcttttttcagggtctcactctgtcacccaggctggagtacagtggtgcaatcttggctcactgcaacctccacctcccaggctcaagtgattttcctgcctcagcctcccgagtagctgggactacaagtgtgcgtcaccacacccagctgatttttgtacttttagtagagatgggattttgccatgttggccaggctggtttcaaactcctggcctcaagtgatccacccacctcagtctcccaaagtgctgggattataggcatgagccactgcgcccagcttgtttttagagaaaaacaaaaacaaaaagcaaaaaagagagtagatggcaggttggaggagggacactttcacactttggccaagttctcaggcagatgtaggcagaaatgcactagaacatcatggaaaacatgaacaagagcagacatcagcttgacacccactgaacacaggggagccagcatagaggagaaggggctaccttcctgcatataacatgaaacccatccctgataatgacttccgaggcagctctctgggcaacgctgtcttgttccatacacacaaaaacttgtttcttgttccacacacacaaaaaggtctcaggtggacatgtggacattgtctttgggagactggcttaggtttgtttgtgttctccccattcctctgccttctcctgactaggcatcagactcaagtttggcccttgcacatacttctccctgatgagttattaatactaacctttgcttgcaccatgaactttaatgacatgcccaaggtcagccagcttgccagactggctctaaaacccacctcattttatgaccaagagatatggccagggacgggggctcatatctgtcatcccagccctctaggaggccaaggtgggaggattgcttgagcccaggagttcgagaccagcctgggcaacatagtgagaccctgtctataattttaaaaagaaaatttttaaaaaagagaaatgcatatagactttaacccaaaactatgatataatcttgttgagaatacaaactctgcttcatgcttcctatgcatacatgccctaaagaatgtatagagtatcctgtaagtagcatgtctttgatatatatttatcataataaataaaactttaatggcccagagagtgctacaagccggggcaggcctagaagctgaacagcaaacaggaggacaagagaaccacagcagtgcaaagtagaagacatttttaagtaacacactacacattacagcagtacacagagcagccaggtgagaaattatgaggatctaggtggatgggtcagttttctagaaatgccacaataaagtcccatagactgggcagcctaaacaacagactatttattttcccacacccctggaggctggaagttgaaaatcaaggtgtgggcagggctggttcctccagaagcctctctccttggcttgtagatgctgtcttctccctgtgtcctcatgtggtcgaccctctgtgtgtgtctatgtcctcatctcctcttcttatgagatgtcttattcatttcaggctgctatcacagaataccatagaccgggcagtttataaacaacagacatttactctcccacagtcctgaaggctgaaagtccaagatcaaggtgtgggcagggttggtgcctcctgaggcccctctcctgggcttgtagatgttgtcttctccctgtgtcctcaccaggtcatccctctgtacatgtctgtgtcctcatcttcttacaaggacaaccggtcctataggatcagggccctccctaatgacctcattttaccttaattacccctttaaagaccctaactccaaatacagtcacattctgagcaactgggggttaggacttcaacatctgaatttgcagggaagacagaatacagcccgtaacagtagactttttggaatgctactgcctgtttgattttaatgcaggattatatttgactacaagtccaaacactatagctagcctagaagggttgcagccataacaaaggtaataaagaaccaccttccccatgacccccatgtggtccttgccccctgatggtcctgggcaagcacagttgatcacaatcccaattagcactgttacttctaggagcttaaaaacaacagcatcgcgtttcaactagcccttctgccagagtgcatgtgctacaataacatactgtaagggacggacatcaaacaggagcacatcctctcggggaaactgcaagaaagagggtttaaaacactccaatgaaatggagcaagctgcaatgaccattaaggacacgctgagcacagaaaactcaacaaagatgaaagaagaaagaggaactaaaccaacactagtccttggtaaattacatgaacctcgtttcttggtatcttttgattacactcaggcctgaggcatctgtagtcctgcatcaggctgatgcccctgaagcccaagatctcactcccagctctgctcttaatgcaggacccacaatttttgctttcttctgtaaatgaccagatagtggatattttaggcagggatggcttcaagggtgagcaaattacagtcacgcagggccccacatttagaaggggcccaaccttggtttaatgctttgccatcactgtcttcagattcttaatttttcaaaggggccttgcattctcatttttcaccgggttctgcgtataacaccacaggtcctggttttcatcttcgcgggccatgcagtttccactgaaattatttgactctgccggtgtagtgcaaaatcagctacagaccataagaaaatgaataagtgtggctgtgctccaataacatttcatgtgggatgctgtcatagattggactgtgttccccccaaaattgatatgttgggcccccagtaccctggaatgtgaccttatttagaaatagagtctttgcaaatgtaattgcttaagatgaggtgtttagggtgggccctcacccaatgactggtctccttataacaaggaaaaatttgtacatagacagagatacacatagagggaaaaagatgtggagaaggccaggtgccgtggctcacgcctgtaatcccagcactttgggaggccgaggcaggcggatcatctgaggtcaggagttcgagatcagtctggccaacatggtgaaaccccgtctctactaaaaaaatacaaaaattagccaggcatggtggcaggcacctgtaatttcagctcctcaggagggtgaggcaggagaatcgcttgaacccgggaggcggaggttgcgatgagccaagatcgtgctagcctgggcaaaaagagtgaaactctgtctcaaaataaataaataaataaaataaaataaaataaaataaagatgtggagacataggaagaacatctacaagccaaggagagaagcctggaactcatccctccctcatagccctctcagaaggaaccaaccccactgacaccttggttcacacttccagtctccaaaattgtgagacaataaatttctgttgtttaagcaaagctgtttgtgatactttatcacagcagcctgagcaaactgataagagatacggaaatttaaattgcatataattttcatgtgtcaaaaaacattctgtttctttggatttttttttcatcatttaaaaatgcaaaacccattcttagctcatgagccatacaaaaataggtagcagggcagatttgggctgcaggcagtagtttgctgactcctattgaaactgtgccccgaggagttaaagaaaccaatgactaacagaaattcttgagtttgcaggatggtagataagaaaagaaacaacctgctgaaatgctgaaactccctatgcttgtaagataacaaaactggctgaaatcagttggaaccaatagatccaactggagcctgcccagaacaaagcttgctgacatcatggcctgaatttctatcttgtgtttcctactaactccctctgaatgtgatccatgaagtactgtgaagaggtaactatgcctgcccaaggactttccataccttccctttccttccaccaatcaaccactaatcccaggatccaccttttctaataaaattattacattacatggaatcaatccaatgcccatcaatgataaactggataaagaaaatgtagtacatatgcaccatagaatactatgtagccataaaaagagatcatgtcctttgcagggacgtgggtggagctgggagcctcagcaaactaacacaggagcagaaaaccaaaccctgcatgttctcacttataagtgagagctgaacaatgagaacacatggacacagggaggggaacacacactggggcctgtcaaaggggtgggggaagggagaacatcaggataaatagctaatgcataggtgatgggttgataggtgcgacaaaccatcatggcacatgtttacctacgtaacaaatctgcacgtcctgcacatgtatcccagaacataaaataaactttgtttgtttgttttctgagatggagtctcactctgtcgcccaggccggagtgcagtggcgcgatcttggctcactgcaagctctgcctcccgggttcacgccattctcctgcctcagcctcccgagtagctgggactacaggagtgcgccaccacgcccggctaatttttttgtatttttttagtagagacggggtttcaccatgttagccaggatggtctcaatctcctgacctcgtgatccgcccaccttggcctcccaaagtgctgggattacaggtgtgagccaccgcccccggccagggatttttttttttaatatggtactttgtagcctctggaacagcaatacagaaattccagccactacaaaataaatgtatgcgtgcatgcacacacacacatacacacacacccctttaccctttcagttgagccttttccataaacaaattcaccctcccttgatgaacttgatttgcaaggctaaaaccaaataaggtgtaagttaagaggagagcctgctgacacaagggtaccccacggtctctgcagataggtttctcctcctggtaaaatctcaacaggcacagagggcaagaaagaagagcagccacggtggtgtctctgcctccatcacaggctcttctgcattctttctctagcaccatttctctttttgaagaactcagtgattatggcttttggggcacaatttcacaggtccgcataagcagatgtttttatgcatatcgtctcccccagggctctcttgtgaacactgtataagcaggcacacaaaatgatgaacaaagcgtccccaggacccctctgagatagagttgatctcaggcatgagcaagagaacgacaagacaagcctgaagcatcccgtcatgctgcaaaggcgggacgtgctcccagaatgacaggcactcatccaacggacgcagcagtgtgcttcaaaattccccacaagtcaaaccttgacaaactggatatcaaaacaaataatggtgggaatggattccaacccatttcaatacttcagaacccatgagtccatagtgacaacacacaaataagaagataaagctctgccttaaaacagaaagtaaattactaactgcataaagaaagaagtgcctggcagtgcccaggctgatctgtcacagagttgtacttcagaggtgagatattgcactccctaactcaatcactagtcaaaaggtcttgttaatacaaaagacttttctaatcttggaaaaaaatagtggaaggtaatactgtccaatgctaatagctaggtggtagatatatgggtaacattttttccctccaactatttccattctttacgtattttgaatgggtgtgtactgcttttctcatgctcataaagacaattgttgaactctaaaacatcaaaatatttcattattaagactactcagtatggatgtaaatattgcaggtgctgagatgttggggacccaattcacttaaacattttttaaattctccttttatataagttactagtattggaaaataaaacaatcagttaagttgaccttcaataacttaagagataatggtggcaatatccaccatgattattttagcaaagcaaattactttggatgatattctttaacatttaaaacgttggcatttctttactccaagtcctccatgccccattttttaaaaagaaagggaagagaaagaccagacttggtggccaacacctatgatgcttgagctttgggaggctgaggcaggaggattgcttgaccccaggggttcaagaccagcctgggagacatagcaagatcttgtctcttcaaagaaaaaaaaaattaattagctggacatggtggtatgcacctgtagtcccaaggctgaggcaggaggatcgcttgaggccaggagttcaaggctgcagtgagctacaatcacgccactggactctagcccaggtgacagagcaacaacctgtctctaaaaacaaatatgatactaataaaagaaaagaaaaaaatcccaaattttaaccttattatataatctttgatgtatatttaccagtatgaagagtcccctttgttgtatttaacaaattctaaagaataacacggttatagggaaaataaaggaaatagaaagaggttaagaatgtttacattttcactattatcaattcaacaactccccaaccagtattagattattttccctatatcataaatgtcataataaaaaatgaaataaggttcctggagcctgagagaaaataaatacatatacacacacaatggagtcataaaatctgcaacattgtaagttttcccgttgtaactttcaatgtgttgaagcatcttcttagttggttacaatgaacactgaaaaagctaaattgatatatccccaaagtcatgaaatggtatctcagacacagggatgaccttcagaggaaaaatgctccacattccccacatgcccaagaagcaaaaatggacagactgtttttgtactaaatgaaactgtggcgtccatccaaaatgtggacattgacatcggcgctgataagtccccttcaactttgcatttcctcctcgtctccaggcttcttcataactggaaattttgactctcacacaactcacttcaccttgtatgccccaggatgaggttgaggggggcccagacaacatcaccccatgaggggaaactgccccaaacaaatacaccaagtatcagcagtaggaatagccagggagaaaatataccctgctctaggctaatttgactatgaaaaagtttcatttttaggccagccattacccatggcttgggctgaatagtatagaactccataggtgttagaaattataaactctgtcctcctgatgctttcacccaaggctgtcccatcaggtgctcagagctgctgaaatttctccttaaaattctagcaccacaacattcaagtctaaaaagtggaggaattgagtttacattggtttgactggatattcaagccttcccgtactggacaaatgaaactcttctctaatttccataaagcttttgtttgtttgtttgtttgttttttgcggggggatgggggtggggagttggttgttttcttgagacagagccttgctatgttggccagcatggactcaaactcctgggcttaagcaaccctcctgcttcagcctccagagtacccggaattaaaggtgtgcaccactgtgcgagcttcattcaagttttagaacttcatccttaattttagacaaaaacagaggaaaccatctcatcaaatcactccacattttaaatagaaaagcagagttccagagaatgaaaaccactgtgggccggggcttgcacagtgggcaagagacgaagtgttgactgtaatgtgggtcacacaccctttgttcatttcagaccctgtgaggtctactggagataaaatatcatcagccgtatgggggttgcttcttagaaggagtaaggtaaggtagagtaaggtaagggatttagtggcccaataccagaaaggagtagtgtgtttttagaagacattctcccaaatcctgcctggccgagaagggtaagagtatggctgtggaggattaggagagtgggggagctgagagcatgaattgtagagccagatggactggattagaatcttgtcactcttgccttccccatatgcataatgagaaaagaggaataactattttgtagaagtgcaatgaggtctgagtgactgcaaaatgctgacgagtgtcaagtgtcaggcgtatttaaggtatttttaaattttttttttatttccataggttattggggaacaggtggtatttggttacatgagtaagttctttagtggtgatttgtgagattttggtgcacccatcacccgagcagtatacactgaacccaatttgtagccttttatccctcacccccttctcaccctttccccgaatccacaaagtccattatgtcattattatgcttttgcatcctcatagcttagctcccacttaggagtgagaatatatgatgtttagttttccattcctgagttacttcacttagaataatagtttctaatctcatccaggttgctgcaaatgccattaattcattcctttttatggctgaatagtattccatcatatatatatatatatatatatatatatatatatatacacacacatacatatatatatatggtattccatcatatacatatatgatagtccatatatatatatggtattccatcatatatatatgatagtccatatatatatatatatatgatggaataccatatatatatatgatggaatactatattatatataccatatatatatcacaatttctttatccactcattgactgatgatcatttgggttgattccacatttttacaattgtgaattgaggcacacataaggtctactaagttaaaacaatagcaatgaaaacctccacgtctatagtaccagaattgggattatcaacaaaggtgcagggtgccagcttccagaataccactgacccaagagaggcaaatcaacctgtgggagccattaaccttccactgttctagccacaaacacatcgtttgactgatcgactttgagtcaaaaggtttgggatgagaaaggggagtcacagtatcaaaacgatcaagtctccagagcctggtaggagttctgagtcactctcctttttaacttcctccttgcttatctgcagctgctctctgccgcctgacggccttttgcccaggaggtcagagaaggcaaagctgtctctcagtaattggagatgtctggctctgtgtgtgggaagttgaagggacacttggtggtgccttcctccctcaaagcgtcacagcaagtcctttcattgtggctaagcggaaatagccaaaagagaaagggaaaatatcgtctcttatgaagacaacaagaagaccaggggtgtggaatgggagaaggatgaccaggcacagcacagggtatttctaggactaggaaatcatggtataagataatgtaaaggtggatgcatgactttatgcatttgtcaaacaccacagcatatacaacagcaagagtaaaccccaatgtaaactatggattatagttaatagtaatgtatcgatagtaatccatcagttgtaacaaatgtatcacactaatgcaagataacagtaggggaaataccagggaggaggaagggagggcatgggaactcttcattttccactccaaatcatcatatggctgatgatattcagcatccaatagacctcacagggtctgaaatggaatgccttatcaggcccaaaactgctaaaaaaaaaaatagcctattattttctaaatctcagattgcttaatattcttatatacatgattaataatgtgtactattatgtatgtacatcataatataggtaatctcatgcataatatttaactaacgatgatacctgtaagaatttatcacttaattacaaaggctgtgttgagattaacagtccttcaaagaaggtggatgggttgagatgatgtggtagatcagaaagaaagcacaatttagaatcctatatagaagttttctgaaaaacagacacacagaaccgattgctttaattatcttaccatcatttggatagggtaaacacaccagtttgcatatactcttaagtaactttcatccaagtacagctgacatgaaggtagcttgcccaatagataaacgatgagagaaaagtagagaaaacatttactatcttttttattcataaattctaaccctcccccacaaaatgtgttggaactatgtgattaattctattaaaagtatgctcgttctgtctgtaaatctgtggagtaaaaaaaaaaaaaattcaggagtggttccccatcatcagaatctgggctcatcatttccttctttccctgagtttataaagtatctatcagcatagtgcctaagatgtaccagaacatttacagaaatcatgatttccttttgtttttgaagcctcatggacctgcaaggtaaagttttatttttctaatcattattttggagaagaaaagggcagggagataatggtgatggatgcagccgagagttgggattggaattggcgttggctcattcctcagcctctgattccaattggctgtaccacctaacatccatcatgtcgccttctcaccgaggccaacatttcagaaaatgccagtcctcatctctccaaccacgcttgtttaattaccattgagggaagcaactacaaatactcctagggccaaaccctggaagaatcccagcaacacacagaaatattgaacttacccaagaattttcctagatggccataaataccatgaaattctggacaactcaaatttacatctctagtcctgactgtttctgggccagagacttcagatgtccacctgcctgtttagtagctccccttgatataatctcacaggcttaaacttattatgcccaaaatgaattttaacagggcttccctttttcacacaaggaaaagcccggctgctcctcttccagtcgccttcacctaagtaactggcctttctccccactttcctaagaaactggcatcagaacggatgtttccatctccctcgcttcttgtatccaaccctggccaattttgcctcccatctcccgaaatccatccgcctcaccctgccttcactgcagcctcacctgagtgagctacccacctcttctgtctaaattagtgtgtttgttttggaaccagactcccgctttccattctcagccttcttcatcattccccaaaatatcttgtgtcaaatcattcccctccttacagcctctctggcttccatcactgcactttatacagaatataaaagacttgatcctctaaggccctgtcgccaggtgtcctgtcatgatacagcagcttcttaaacttctctataggtaccaaataattttccacctcagtgccattgtacgtgctcttctctttaactagaaaacccgactcttcagaagttcatatcctcagagaacttttgcaataattcatatctcctatctttcttagcatagtaccctattttctcaaaatcatgtaataccatgtgtattaactgagcaaacactgacttccttactttcttaagaccttctgtgtttagtgtactaattctgctccatgaaggcacggtctatatctgtatgagtagtaccttgcaatcttttgtcaaataaaacaacatctatacataatttacatgataatgctgcatattatgtgtatgagtatatatatatatatatggtcttgtatacattatatatatactatatatatagtatatgctgtatagtatatatatgtaccatatacatagtatacaatagtatagtatatatataagaccagtatacaagtatacaagaccataagtgaaaaaattccaacgacaggaattaatttgctttcttttttaactttcaaaaaaattattatttaattggcaaataaaaactatatataattattgtgcagaacatgctttaaaatatgtacacattgtggaatagttaaggtagttaacgtatgcattacttcacatattaatttttttgtggtgagaacactcaagatctactctttcagtgattttccggaatacaatacattattaactatagccaccatgttgtacaatagatttcttgaccttactcctcctaactgaaattttgtatcatttgaccaacatgtccccaaactacctccttcccaattttcttaaatttcattaaaaaatctcttcctggaagaaatcacagtagtagactgatgactggctttacatatacacacatgcacatacacacacacacacacacacacacagacacaaacacaccccagtcatgtttacaccacaccactcctctgaggtcagattgagttaacactggagcccactctgcatgcaatgggagcttgcaaacccacctttatggcagggagcatcaggccttcagtggcccctgcatgtgaactgcctccatggtctgatgctgaggacaccctgctggtaatgcagagaactgtgcatagaaatccctaatctgcctgtccagttccccctgaattggcttgaagcagtgggaagtcgaaccacacaagagagtttccttgtcaagtgaccggaggtcagtgttattatctctgtcagtggccaggggtgcactggttcccagcatatgagtctttcattgctaacaagctccactgcatttgagagagcccctgggataggagagcagggaggcttatctcctgtctcctggatgaggtactgagaaagagacaccctccgcactctgctcctcactgaccaatgaagggactcacgaatctgttaatttatcaactagggtgttcgacctgaacactagtgatatcctgattgtaacaggaaatctcatcaattagaggatgtctgatctaacagggcaggagaccataactgttacttgtattgtttcagggagcaaaaaacaagagtgaaagaaagcattaacaattaagaaagcattttcttaatttctccagagaaaataaaacccaggaaaataacaaaagcaataaggaaattaaaactttatccaaggagcatataactaaataaatgccatctaatattgggcatcatcaatgtactttcaactttatgtccgcacatcatagtataaaagagaactgtaaaaaaagacaactaagttttacattgaaatcatttgttatatcagatgtttttaaatataaacatatgaaggtgatataacaggatattaagatgaaacctgtattttaacattgttaatgtgtcaccataaatttaccttttggcattattttggtaaacagcactgaatgttccatgcacggcaaacaactaatttaatgtagcttttaaattggcaggccatactaaaatttagctattttctttgcttactgatgtcatctagaatgacgcttttgttgttcttttccacagacttacaagcaattttatgcaacatgacgctgcttccaaagcatccagaactatggaacttggcaggtttaccagtgtctgctcgccccaactacaacctttatggaaaaggaaggactcagtcagacagaactggagagtttttccaaatgccctcaaaaaaatgtaccctggcttgaacaagagagccagaacagcctggtgggacgtcagccttctagatttagcatgacatgggcagcagtgcagttctgaagaactcccctgcagcacacacagctcctgatttctatctgtgctcactggtctggattttgagagttttgagaaatgaattgtgcatcctgttatgcctcgaaacgttaactcaactcatatttttaagtggtcacgttaggtaagtatcccctcattagaacagagacaatgcttgattcattttccaggttgagttgtagttaacatgtgagtgggatcgaaccaccataggtacagatgcttagagaacaggaacaacagagaagggacagagacagtgaaggaggctgtattgtcttcacacctttacaggcagggcgacttcagcaagaagtaatttaccacccacactaagctctttatcccagatttgctttactgtctctctctacccaaggtgtcaaacactcactctgtcatcatgttgcaaatggcactagtaaaggaaacttccccagctcccaagaagggccttataaaccaagtgtaacaaccttttggcttctttctttacaatgagaaactcattagctggattattttttttctttttgacatagaaataatctgggactcctttcacttttatgtgatagaaagataagacgcagaatcaacatacaaatctgctataaagagtgcagaaagcacttcctcaaagtctcaactaacttttccccaaaaaactatgcttgataaattcatgttttttagaaatgggtaaaaaaatgcctacttagtctgttttgctgtttatgttagcgattctgtgatccagtgacgtcagacttataaaatcaacaagtttcacaaacagaataagaatcactccttaaaataacaaatgttacccgttgagtgatgtgattgctttatcgtctctttaaggcagggatgtccaatcttttggctttcccgggccacactggaagaagaagaattgtctttggccacacataaaatagactaacactaatcatagctgatgagcttaaaaaaaattgcaaaaaaactcacaatgttttaagaaagtttacaaatttgtgttgggccgcattcaaagccgtcctgggcctcatgcggcccaagggccatgggttggacacgcttgctttaagatcttagggaaacagaaggttaaaatgataagcatggaactgaagacttcataagaaaatgcacatgtcccattcatgtgaaattcgtaattcacacatgtaacttcctgactcacccctaaaatgtgggggaccccaggaaccacagagaagctccaaatggattttctcaagcaaactgtaatatataaatatatattttacctcctaaccaggtcttctctgccctgccttctgccctgtcttctttccacacaatcaacctcatgtaatgtaacagcaaatcctcatttccacagcccacttttggtggaagagtcatttttcccaaatatgatcgaaaatgcattatgtgagccagtgaaggaaatccagaaatagggtctagttcgtctgggctcctgtacatcctatacaagaaatgaactttgcaaaatcccaaagctgtgaatttggcacctctcaactagcacaaatttcctttcaaacattaggaagagaaagagaaaaagagactccaaagtattttgtaacataatgtattccacatttccataggcatcatttttaggccaaaacatatggtaatacataaactgatcatatgctgcctgccacgctcagcagagaaaggcagcatctcaaaggatttcctcaaatcctttactctaagaaaggcatggaaaccatttcatcagaaatcattccctccgtggcagtgtgcaaagacagtccacccagatgcataataaagcctcaggaaataatgacaacagcagcctctattgcaagtggagctgaaaaaagcggtgggtcttaaccactgatacaatgcaatcattaagatatttaaatataagaagaccatttcatgcgtctctaaagcttaatgctactatctcaacaatccagtgtagaaattgttaagaggggtctctctctgggtgccttaatttatatttcttttttttttttagtttttatttttattctaagttccagggtacatgtgcaggatgtgcaggtttgttacataggtaaatgtgtaccatggtgatttgctgaacgtatcgacccatcacctaggtattaagcccagcatgcattagctatttgtttggatgctctccctccccccaccccaccccccgacaggccccagtgtgtgttattcccttccctgtgtccatgtgttctcatcgttcagctcccacttatgactgagaatatgaggtgtttggttttctgttcctgcattagtttactgaggataatggcttccagctccattcatgtccctgcaaaggacatgattttttcatttttatggctgcatagtattctatgatatacatgtacattttctttatccggtgtatcatatattttttacttctgtaagcaaaatgtcattttgactgtttctcttttatctaacccaaatggccaactagccacctttatttgtagggccagcaaaaaactaaattttagtattgggttcctatatgtctcatttaatattatatactttgattttctctccaaattacctcatttggccaagataacataactaatgtgcaactacttaagcacatccctgagttttctttttaaagtggaagctaaaggaaaactaagacacatgcattatgttatctttatttgtataagctaatcagagtaaaatggtcttcccaaatatgaaaaataaaatgacttgatacatgtcaaaaaagggcacatcatctgtcaataagtcctgttgaagtgtgaggggaagggagtgaagttctgcttttctttaatgagatgtccccataaaaatatgatttgtgaatttgtaaggatccctaactgtcacataaagacctggactccacccatgtaacacggtcatggtctagccagttttcttttttaaatatattcattttttattgcaagggttcatcctacacattgttataacagacaaataaatcacttcacttttctcacctgtaataaacagagagcttctctgttttacagtgttacaaaattaaatgagacaatttatgacaaaccatttgtcgatcatggagtactccacaaacagctgagtactgttgctaataatatgacttcagtgacaatcataacctcagaaacttaagacagagcctgtctatggcaaagaaatctagaatctgtggtgtctcattcaaagaaatgtattttcatgagaatatcacttccctgctcccagtcctccttaacttttccctctcgcctgagaccacactgcctgatagaaccaaatgtcagcagtgacagtggggaatactctaagttggtgctgtccaatattgcagtttctagctacctaggacactcagcacgtgaaatgtgactagtgcagtttctcactctcgccactgttgacatattgggccgatggttccttgcgatggtggctgttctgtgcatggtaacactaccacgcagcgtgttgagctgcatccctgaccgcccccactagataccagtagcacctcttccctggtagtgacaactaaaaatgtctctcgacattgccagatatccccttgaggacaaaatcacctctggttgaaaaccactaggctacagagatggagaattttcattgtattcaatttaagtaaatgtaaacttaaatagtaaatgtggctgatgtctaccatactgaacggaattgctttaaaatttactgagattcaaaagataaatgttggacggatggatacccccttcttcatgatgtatttatttcacattgcatgactgtatcagaacatctcatgtaccccataaatatatacacctactatgtacccacacaaagttaaggaaattaaaatttaaaaagaaaatttactgagattatttttcgaaaacagatacaacagttaagaaatatgttggaaagtttagattacatacatatatatatatttttttcctctgaaagggctaagcatatgttaaacaatgtaagctttcattttatttacacataattatttatgtgctgcctttaactcagagcagtaagagagctcataacctagcaaggcataaaaaggtacaaaagtaataataaaatggaggagggggaaactaccacagtggttttatatccattcctgccacccagggagggaataatgagatgaacagatatcgatgggttgtagggtccagaactaaattaaaaaattaacagccataaccaccccaagctgttcctgctgggctcgccatgcttgccccacccaggcaaggtctggattgttcacaagcagcaggaatgacctgacccgcaagctctccacagacctgcgctgatggtttctcacttccctcattagacactgagccaaggcaaagaaacttttaaaaaagtgtttgcaagggttcatcctacacattgaacagtttagtaactatcactttcatttgaggagtgaaaacaatttcctatcataatgggacaactgtgttaggttagggaatcctatacgttacttaaagtcccaaagtgaatccaagttcaaagggaatattgtgtaaaacaaacaatatccctgagaatttcaaaggagattgaaccccaagtgcctagagattccaatgtcttcatttctggttctacatgtagggagatgatctgaaagaagcaatattcagtatgatgaaaaaattaaattttatatttcctttccaaatacttggagagagaatctactcagtttctgatgccaagaacagaaatttaaagtatgaagaaagaacatgggctttaaaaacaaaaagtcctgcaatgtagtccccaaatgacaaattttgggaaccttgtccattattccttctgaccctcagttgtctacattgtacaatgaggaaaatgacagctacttccttgggttattgggagaacttgaaagggcccctagaccaacctgtgtatgtcgcccatttcacattctctaaacttcaattccctttactgagcatggccaatcttagtgctcaaaggcacagaaaagaataaaagcttgctctgccttttaaggagttcacgtgagccccaacagttgtaatccacagcctcttttcccaaggagatgccaaacgatctggggagacagacacataaacaagttacccaaacactggagcagatgaaagaagtccatcatggaaacacacaccacttactgtgagagcacccaaactccacggctcatataatctacagagaaaatgttcccctaagtgaacaaccacccaaagagagcaaagtaaacaactttaattacaaaacagaaactgtcaggcatctgttaggttcaaggggcctttccaatggataaacagttataaaatcatgggttcatatatgtagttatccaactcaagagaccaagagactgaggatgataccatcctgccaaccttcagttcaacaactcagagtgaaaataataataataaaattaaaaatcggctttaagaggtaaagcatgctaagagaaataaggcagacacaacaggataaatatcctatgattccatttgtatgaggttctcagagtactcgaattcatagagaaggaaattagaatgatggttgtggaatggggggaatcaattaataattacattgattttctttacaagagtccctataagtaggcatattgagatccttaggcctctagagacacagagtcaaatgtttcacacttttaaattatttatgcttataatatccacctttagggatttcttgcaaaaaaaaaaaaaagtcttatcctgcaaaaaggttatttctacagtcaaattcataaaaaccgaaagtagactggtggttgccgggggctgagggagggggaaatgagaagttgttatttcatgagtatggagttttagtttggtaagatgaaaaagttccggagatctgttgcacaacaatgtgaatatacttaacactacttaactatacactcaaaaatagctctcacgctgggcgcggtggctcaccagttgcatttccaacaacgtctcaggtgatctgaggctgcagggtccataaaccacactttgagtagcaagagtctaaccaactaaattgtgaatactgaagctcagtaatcccagcactttgggaggcccaggtgagtggatcacttgaggtcaggagtttgagaccagcctggccaatgtggtgaaaccccatctctactaaaaatacaaaaattagcctggcatggtggtgtgtgcctgtaatcccaactactcgggaggctgaggcaggagaaagaattgcttgaacccaggaggcagaggttgcagtgagccaagatcgcaccactgcactccagcctgggtgacagaatgagactccatcaaaaaaaaaaaaaaaaaaaaaaaggctttcatggtaaatttttaatttttaaattatttatttatttattcttagagacagggtctcactctgtcacccaggctgggctgcaatgatgtgatcatagctctcagtggtaaattttatgttttgtgtgtgtgtgtatggtgtgatttttttaccacaataaaaaataaaaatgttacttttataataaaagaaaagctgtttattagaaagaagtaatagtcataaaacactaactttcttcaacatatttcaatgatatttcttcaaattaaatttccaaacagacaactgtaataaaaattttgaaccagggtgtttttgttggtgaggaaaagttttagagttgtcgatcagatgatatcccaggaagacataaggcaatctaatcaactgtgcttatttctcctattttatacaacttaagtgacatggaggcacctgctcatttcaccttccacactgagaacactgctctcagctcatgtccagtaatctccttcttcccgtcattctctcactctagcactgagcactaatcaactctcataatatgtgatcaggttatgtatggtacagattccctagttaagagtatcagaatatgccatcccaaaatatgctactttggcataaggattattttgagctgagagcaattgagaagcagtagatgcaggaagaactctctgccttccccatttctgcttaaaagcagacataaatttcccctttgtaaaggcaatgtaagtttccatttgtaaaaaggttcccttcttccataccaggaagagaaaaataactcatattatccgcataacaagccttagtaaacaagccttatctaccatacatttctaggtcactttcccacaatttactgcccggagcccaaaacccccttttctttgtctattctcctctccacaatgtattgcccttcattaaaatggtatataaacttctaggtctaaccacttctttgagtttttatttcttttctgtgaagtccctgtgcatgtgaaattattatcatcaaataagctttgtttgccttgttttcctgttaatgtcttttgtgcattaaatttataggccccaataacagaaccctgcaagggtaaaaggaaagcttttccattgctatactagtgtatttacctagatattttatatatgacaaagaaaactagtatcaatacaaaccagtaaaatgtgaagatgaatatttacgtgctttcaagagaatatagttacatctcgtttgagagattgcccagcctctcaaaacctgacttccctcttttttctcttcctcatggccacactaccaaaagaaaggagaaccatacccggaatgaaatttctccctttccacactttcctcaagtaacatgcagtctgccccctgtcttccaggctttcctaagactcctctttcaaagtctccaaggacatcaaggcccattctatggtccccacatcttattagccacaggactttgagagggtcactctgtccagcattttgcataataatcaaggaaagtgaatactttccattcccatctcagaaagatgctttaaaagcaaatggtattcatttatgtgacaattctttgcaaactgtaaatcctaaccaaatgtaagatattaagataatgaccaaagatcaagccaaagttactatcaacatatttggggagaaatccagaagtaataaaaatgtcaaattactcctaatgtaagataaggaagtgaaagaatcacactgattgggggtacacttctgagagcacagaatttaagatttctgattcagatgactgaatttatatccaatccactccccacacagcactccatcacccaaacgaacccttcgcaagcacggggtcaggcacatggatggcatatatttaaaacttaacaaatgaaaagtgagctaagaaggaggaatgggggtaatgagtttccaagactcaataatttcaggctctacctgcaaaaaatatgtaagcaaaaaactacaagtcatggctaacaggcaggaaggattaatcaattggtcctgggactaaaggaagataaatgtcagagaaagctacagagaagaaaaaaaaaaaaagtaagatctggcttttttcggaaaacgagaatttcaccacacacacacacacacacacacatacacaaaagggactggagcaacaggtaatgtaataagtgtaaagagaacaacaaagagatttaacacatgctatatggctgttcaagacccgtgggatgcattaagccgtttaatcatcacaagaatctatacagtggcccctactattatctgccccatttttcttcagatgacaaaatcgaggtacacaaaacaaaatcacttgctcaagatcacatagcccctaagtagagaggccataatgtgctgattaattcctgaactgaattttagtagtcacaggcttgccacttgctcttcatccccacgctgtattacctctccaaagtactacaagcaaaagcaaagaggtatgaaagaatgtggcatgctgaggagtctgggaaaattgtctaatgagaaagaaaaaaatgaaccctgagaaaatacacacacacaaaaaaaagcagagtcatctggaaagttagatggagactcaatataaaggatgctgaaaaatgtgccaaaaatttgatgtgatcctgtaggttagggctaccacggaccatcatctactggaatcctcttagaaatgcagactctcaggccccagcccagacacaccacatcagaatctatggaggtggggcccgggaatctgcatttgagcaagcccgccacgggattcttgagcatgctaaagtttgagaagcacaaactttaagaccttgggatctgtgaagagcaaaaatggagagaaaaattggggctatgggattaccacattttagggatagtaaatgcttcagtgatatcagaggggatagcaaaacagtttgagagatttatcagaaggactttgcaggcagctagatagaaaagtaaaggacgaggagcgatgaaggaggattttgagttttttagcttgggtgcttaagatatattaatcttttaattaatattaataattccagagagatatacaggtttggggagcactagtaagtaactcggcccaggtgatggagctagtgaatcccttcagcctttaacactggtgcccaaagaccaaactctattgtgcctctcactcaaacggcagaagatgtccatttaaatcaggacacatcaatgtcaaggatttagataggatcttaaatcagaaatagccagtaaaaagttgaatctagaaggacaggaatactgcaacggtctacatgtgttacagaaacaaggcaagtaaagaagaggtatttccttggccaaaaatagaattcttgctctgcctcccaaatatcagagagcaacgccattgcccccatttcctttagattatggtgattgtgaaagagaggcttcaattctattctttaaatcatcttagggcttgatttatgctgctgctgcgaatgcatgactgacattatcctgcaagtccaaacagaatgcaggcaaactagtgttgcctttgtccggatcaggaggtaacctctcagcagagtgacagctaatgttataacactggaggtttcagcacggtgcacgcaaaggctgggagatgtcacccttctgatctatgctactttttcctgacaaatactatgctaggactgcgcagaaaatgattcagaagaaatatagaaaatcctccccatgtacttattctatctgagctcatgtctgcttataacatggccattaccaaccagaaaacaaaagttctaaggaaggttattgcctttctgcctcaaaacaaactagggagacaggcagaggatgcacaggatgcatgtggggaatagggcaacattcagaaacgtgaaaacacagcagacaattgcacttgtggcaaatttgccttgggtcttggaactgctatctttgaagggccttcacaacagggcttcccggtcatcaggggactttttggtgctgcttcatccaagagggctaagatttacagttgattagcctgcatagttcagttgctttttcaaaagattctaggaagggattatttctgtgcccaaagagcccctagagaatagagaaggctgcttgccggccgtaatgtgaattccccagagtcggtacactgtgctcactgaagcagatgaagtaaagttaaagaagcatttagttcttcagaatgccagccttaataagtatctttttgtggaaggatttaggaggaggggagggttatccttagtgcaggcattatttcctcatacaaaaagggaaaatgtgcatacagttggatgtaaaaagccaacctcgaatgcctgccccccaccccccgccttccccgaggaaaagttgctgaacacacactcccaaacacgaaagcatgaatcttcacagcttaatagtcccgaagccattgtgaagtttctcttgggaaacactgttcattcatctgcgactgaccaagttcaaccattcagctgtgagaactcggagacttgcagccatcaaaagacccaccttcctcagcaagcggaagccagaggagctgcgtccccaaggaagatctcgggaactcgcttctcctctccacaaggatccgttccagccccacaagagaagtctgcagaaggctgaatctgggtgcatctgcaggcagctcaactcttaaatgatctctgcttgcacagttcaggggttgtcctggcccctgcggctctcacagttctccctgcaaacagtgctccttatgtggaatttgacacagaattagtcacttgcaatgagttaaaatgagtatgatttaattagacagtttcgcataagcccaattttctaaccaacagcaacattttcctatttaaaccctgcgttttcttcaacctgtcatcacacaggaatatacacattgacaccaactgagctattgctattaatataatgaacacagtatcgacagagtggccattccattatcgttaaataagccagaagccattcattatacctctctgtgcttaaaattttcagctggggctcctataacttaaggcagagagaaagtctttcatggaaaccaacataaacatttgccacccataagaatagagagaaaaagggacagagagggagggagggaacaattgaacagaaaaaagaaaagaagagaagagaagagaaagagaaagaaagagaaagagagagaaagagaggagaaggggaagaaagaaagaaggaaggaaggaaggaaggaaagaaagagaaagaaaggaagaaagaaagaaagaaagaaagaaagaaagaaagaaagaaagaaagaaagaaagaaagaaaaagaaaggaaggaaggagggaggaagggaaggaaggaaggaaaaagaaaggcaggagggaagaagagaaagaaagagtgcacgagcaagatttacaaagtgcacactttaagtcattttcccccacacaaatggaaaatgaacttacccacattggtagctatgctctgaaaagacccagttgagagaagtcctttctttattgtgtagttttaaagacgattctttgacctctgctatttatgacttgagatctgtgaaggcagggccaaacccctctggctcccatggcccacacaaacaaaagcgccccacctttgttccactaccacatttcccatcaggacaagtttctaccgcactccctgttttcataatttaagttgtgttctcttaaatttttcttgctcagttacagccattacctaatttacaagaggctcccattgctcttttccagtaaatcttttcccataatcatcacttctcagctgaaagaactttggtatgaatatagatgtcttgtcacttcattttgtttaaccatgaaattctggataaaagggttcaagagactaaacaactcatctggcaacatgcgcagccacagtatgatatccttctaccgatttattattttatggatgtgtgcatttatctatggcctttctcactcttaaaataattcaagacaatttacaaagctacatatgattacagctggaaagcacatcttaagtgagtgaaaaaaaaatgagataaagggaaattaaaatggggagaaaataaatactgtcaaggataaagcaagtttcctaaatacatatgatcaatttcagcacacttgttaaagacaggctgtttgatttaagttttagctttctaaagaccaattgtaagaggaaaacactattaactgcaaaatccacagtatccataggccaaaagtatctacccatttctcaaggaggcacaattagtactgataatgcaatcagaatgaatgtctctaggccaggcatggtggctcaggcctgtaatcccaacgctttgggggccaaggtgggcagatcacctcaggtcaggagttccagaccagcctggccaacatagcgaaacccccactctactaaaaaaatacaaaaattagccgggtgtggtggcaagcatctgtaatcccaactactcagaaggctgaggcaggggaattgcttgaacccaggaagtggaggttgcagtgagccaacatcgcgccactgcattccaccctgggagacagagccagacttcgtctcaaaaaaaaattaaataattaattaattaatatctctccaagtttcctccccaaaatggcatgacataagagaccaatgtcctcaacaactttcttagagcagccccaacgactaggtttgtaggacaatttctgaggttatcatccatattgcattgcagcaacttaccattcagcaaaagccatttgttaaaggaagatttgaaatggcaaagacatagcttagccgtgtaatcaaggcatagattctagagcacctggaagtgatacatccatcaggcaggtataaatactgtctctctccagtggcttttggtaccaccaggatacgatgagtttcatattctactacttggaaagttccagatgcctggtggctttgcttatacttcattgtcacttcatagctagcaaaactttcattagctctgacattcactgtgaaattaaaggtcctaacagacatttgtctaaaataaataaataaataaataaatacataaatattaaaaaaaaaagcaacccacttcctgcatagatatgcatcaaatagggagaagggagtatctgacaaaaatcctcctcagaaaacgtgatttcattttccaacccagaagaaaacagaaggtgtaatccagtaaacacacacacacacacacacacacacacacacacactgattacccaaagaacatcatgttttgagtagtgaatcttacaaggatattcttagacctaaattagttggaaaataaatatgccaaggtggttgaatgtcattatttatggggcaaggcaggttcttccccattgaatagataaaagatctcttgagaaaggcaaattgttttagtttcaaacaattagtctatattctctttttcaggcaagtgagacagcaagagtttctatgttcacccagttggtaaaaatcgagtttaaattaaaacctccatttattttcctacaatgactgctctttcagaaacacagagaaatgaaaagtttccaaagtagactacgcacaaacacaaattaggttttctaagaggaactcctatgtgtgattcgggagacaagtagacttgaacctcattccaacgattacgtataaggtggagtcaaaattatgaacatagaaaagcaaatgtggaccccccttaaattcaagtgagagttttctaccccagtagagaatattttgacagtgactgtcacggcagagataaagcaacatgatacaatctcatgttcaatgcccacaaatgctgatctaccagagactgaaatccaattctgtctcctttctcaaatataagggtccccaaacttcaatcagcattggtgcatttttccagttgccagaataaacctcaacatcttcaaacaagcggtgctcatccctgctctgcgtgctttctgatgaacacattacaacttcaaaacatctgtcagactgtaatcaccatgtaatgcatcttgactcagatggttttcatatgttcaaaacagattccctttctaaaggcagctttatggaactcgtcttcaactgtgaaccaaataagagatttcgtttgcattttctttcatcagatggaagaagaaattaatcgtaagagattagggaaagacttacacggaggtgcatttccccttccgcatgtttttcctttgaagtttatagcaggtggaagagtctttcacacccgtaaaattgacatggaaaagcagaaacacactgagctattaacttgtcacatattggatttaaatctaaataggaacccgttctttcccttatatattgattgtgtaccagcttagcaggaagctttgcatgttctttcagcagacaggctagtttctaggctaaaataacctggaatgtttcagctaccacaggctaatgatcacccaaatgcacactaatatgtttgataaaagttctcagcgtgagggcagaaaacgcttaccatgagaatgacagtggtcaggggaagcaaatcagtgacaccaactcatgccgccttcaatgctggaggctccaattagaactgtgagtctgcattccagggggcagtgacagatggaagtttgcagcaaatctctaattgtttaaatcattaactcatccatccacctgcattatcactagaagggaccctgctggaagccttcagtggtttctcaaaaatctcaggactatttcctggccatttaagaaatggtgttttgaaactagttgtttatgtagctatttgtgagttctttttttatctttttcccaggctctcatttttttctcttcttttttctttccatttctgcctttgcatcagagatgatagccactttaatgtccttctagagcaacaatggatgaattacttataaatcatgccacacgtccagccctaacttaattttcaattccatcaactcccttaagacagacttcaggccggtctccgtggctcatgcttgtaatcccagcactttggaaaggccgaggtgtacaagtggcttgagctcaggagttcaaaccagcctggacaacatagtgagatcttgtctctacaaataataataataataataataaattacccaggcatggtggcacatgcctgtagtcccagccactcaggaggctaaggcaagaggattacttgagcctgtgaagtcaaggatccagtgagccgagatggtgccactgcacttcagcctgggcaacagagcaagaccctgttgtcacacacatccgtgtgaagaaactaccaaacaggttctgtgtgagcaataaagctttaaaaaaaaaacaaaaaaaaaaaagagagagagagagaaagagagagagacttcatgtcttactaagcacaaaacgccaaggctacttataattatcttgtggcatcatgctataggacagttggagaaatttacatccagtggtttatattaatcatgctaatataatattgtacataagatggctttttcaaaagaacactagttgaaacctcacacacactaacaatttcttttcgcatgcattctacacaaatgttaagaccaaaatgttggtttaaggaaataatagaatatttctcttatctcttctaatgtttattctcacatcatatttattttctcctgaaaaataaagacatgatctcatgtaagtaaagacatgtacttgtggaaataataacattaatatccaaaatgaaggggaattaattatacccgacttgagacattttctgcacaaatctctctctttgaattacacaagcctgcacttctcctgaaatcattgtcaaacgtgatttggctgtgaagtcattgtttgctccaaaggagatcaataagttggacaacagatgcttggtgaacagcaacattattcttgaaatgtatcatatataaagtcaagagatattgtataagcatcagtaagtattgcaacaggtctaaagtatctaaacatttaaaattttgatccactacatattagaattgcaatcagataaaaaacgttcacctttggttcttgggtactggggcatggtgcattttcatgtatgtctgagttttcattttgctcctaagaaatgtcttccttgggctctatggatttacagtcattaccacataaatcacagaaagcatctcatacaaaacaaaaatttccacagtcatattcagatgtgtttcagaggtttggccctcactcgataaatttcacagatggcaaatgaagctgtccagatttttacacaagcaaaaccaatcttcctcacctctaaacgtggttctgaataaagctggaaaatcactaacagttaggagttgtacccttataagaactgaactcccactgagattaaagctgtaagccaaggcaccaagactgggccctaaattaccacttttcaacacatacactccaaaccaaatggggaacaaaagtcaagccagtgagttctggcactcaaaggcagaaagataagcatgcaggctccccacagataggtggttgttactaagtggcatgccattgtttgttagatgcaaggttttgaaacataactctgagctgaaagttaaaggagaaatcttttttttttttttttgagacagagtctcaatctgttgcccaggctggagtgcagtggagcgatctcagctcactgtaacctccacctcctgggttcaagtgattctcctacctcagcctcctgagtagctgggattacaggcgtgcaccaccacacccggctaatttttgtatttttagtagagacggggtttcaccatgttggccaggctggtcttgaactcttgacctcgtgatccacctgccttggactcccaaagtggagaaatattttataaagtgaagacaagactcatgcaaatatcagatggaaatgtaccaaagattttatttaactcaagaaatagtcatatgttacatttgattcaaaggaaaaatcccatagataaatagacaatagacagataaatgatagacagattaagatggatggatggatggatggatggatggacggatggatggatggatgaatagggtcaataaggaatgctggtgctgaaatggatttacaaatatatgcaaaatgttgtattcctggatgaagcatcaagtgcattccactagacaaaatgtatttgcattttcatggacaagagttattttcattatcaattttctaccatttgcagagtgggaaaatagttcaaagcactgaacactggacagaacttggagaagtgcaatacagagaaaaataatctttacttttgccaattttcaaatctttcacaatttttcttgactctgatcatcacattttaacactggattttcaaaaattagctgtgatttatttgaagtttttttttcactattgtttactattcattatttcaaatccctgcagtttgacaaacaatgttctataagctatgtcagaaactgtccatttttgtttgactttaaatattttaagatatgtctttgtattgtcagaagaatgcatttttattgttttgtttgggtttagttttgtctgtgtgaatgtaatgtcatagaagaggggttgacaaactacagcagcaggccaaatccaggttgccatctgtttttgtagaaccagtaagctaagaatggttctttcattttcaatggttggaaaaaaaataagtaaaatattataatgtaaaaattacaggaaattgaaattttactatctacaaaaaatgttttattggaacatagccactcttcttggtctatgtattttctactattgcttttgtgctgcaacaacagagttgagtagttgcaacagatactttatgggctgcaaagacaaagatggttactatctggtgtttttttagaagtcatttgctaacccttatcctagaacactgcatttaatgaaaagttacattgaaaaggatgatgggattcaggacacactactcaaaatacggcaccttggcatattaaaaaaacagaagcaggaaagtctctctgacctcccctcctcacccacacatatgcttctccccgatgcagggcatacagcttaggaaagcttttccaacattcccaagaagcaggtcagaagacactcatgtgagggcctcccgatccctggaagaaaggaacatgctcatctctgaagatgaagggtcacagagaggaacctgaacaaacaggccttgctaaattccccagtttatctacactagatcacaccctttttgtcctatcatatctctccatcagtattcactcttcatcaaagctactataaaaatacacagaattaaccatttactggagtcttcatttatttaggaagactcccacagcatgtaaatcttactaaataaatttgcaagtttttctcttcttagtctatcttgtgttaaaaggacctaagtcatgaacataggatgggtagagagaaggatatttgtcctcctctaccagaaaaagccactgggaaacatagatgttaacatggctcattacaatattttgactctgtgctatgactaaacaccagggcatcttgcccatgaatttgaatttcctgtcaaatgctccaaatcattcctaagtgggcttttagggaaattacatacaatgaaaaatagaatgtaagaataagcatttcctctgagctggaggctgtctttggctggatatatcattgcttcaggcctcaggttcctgaagcgcacaatgaaagaattgcactggatattcctaaatattctctctagctttagaattcttctctccatccttcatgcaaacaatgatctcagtggtctgtatcacctatgttcccttactgagaggagccatctaactcttaacatagtcagtcctaggatccatgtgtctgtggctcactcaaatagttttctctttcttcatcaaatatttccatcccagagtaccaaataagttacgaacatgagaattgagccttaagaccatgagcagagcctaacagaaactgggtaattcacatattaaccgttaatgggtgagtacagaggaacttcagaatgatggaaaagagttagaattgtgagattagcaaagagaaaaagcagaaatggattctaaaggtacacaaatgctctaatgggcaaagtaagggggagaaggtggttatgtccccattggtacagtaatggggactcataaggaatattgcatgaattttttttttttttttttttttttagacagagtctcactctgtcgccaggctggatctcagctccctgcaaacttcacctccagggttcaagcgactctcctttcgcagcctcccaagtagctgggactacaggtgtgcaccaccatgcccagataatttttgtatttttagtagagatggggttttaccatgttggccaggatggtctccatctcctgcccttgtcatctgcccacctcagcctcccaaagtgctgggattacaggcgtgggccaccgccccaggctggaatattgcatgaatttttaagaatggatgaagtaacaatatctgggaattttctcagtgagcaaaaaagtaaaaaattaatgcaaagaccaagttcacccttcatatcactttatcactagggcctagggcatagtagatgctcagtgagtatctactgaaatgggattaatcagactctattggaacgagcaaatgaaatgcatttaaagaaaatgttaaactagaaacataaataaaagggctgaacagccacaacattataatatatgggaaaaaataggatctgatttacattatatttggcatggagtaatttgttatttaagagaaaggttaatgaaaataggttcttaaagtaataggtcgggcatggtggctcacgcctgtaatcccagcactttgggaggccaaggtaggcgaatcacttgaggccaggagtttgatgccagcctggccaacatggagaaaccctgtctctactaaaaatacaaaaattagccaggcatggtggggggtacctgtaatcccagttactcaggaggctgaggctggagaatcacttgagcctggaaggcagagttgcagtgagccaaggctgtgccactgcactacagcctgggcaacaagagcgaaattccatctcaaataaaataaaataaaagtaatgtacattgttaagattggaccaacttaaaaatattattagaatggaaatatatcacgttttatcagtatgttttacattactatagtaatatttcattccaaaaagtatttagtgtggcttggactgaaaaaaaggaaattaagataaaaattgtttgcaaaacatatttagatagaatttttaaaatacattattttttatgccaaaggtgtatatttactttcttgattagaaataggtgatcttattacttacttactactaaaattgaactactaaaaataagtgattgtaaaggcatctttttaggatagatttgatatattttaaaaggcttggccaggcatggtgactcacgcctgtaatcccagcattttgggaggctgaggggggcagatcacttgaggccaggagtttgagaccagcctggccaacatgtcaaaaccccatctctactaaaaatacaaaaattagctgggcatggtggcaggtgcctgtaatcccagctactggggaggctgaggcacaagaactgcttgaccccaggaggcggaggttgcagtgagcagagatcatgccactgcactccagcttggcacacagagcgagattccgtctctaaattaataaataaatggtttgccctgaatcatccgagactgaaactgtgtttagatgtcagttttgcgaacagtttattctggagtggccaagggcataccacattcttatgggttaaatgttctctcaacataaaaaataaagaaaagaaaagaaaaatcaccttaacggaggaatatctaaggaatctatttctccgggaatctactatgtatccctaaatgaagctgaatcagaagagtaggccatctttaggctgtatctttctgacttcccaccagacaacaggaacataaaagcaagaaagagaaaatatggctcatttgctagaattgggtcacagttttgccaggaagttacactattcacagtagctataagggtggaaaaaaaaaaaaaaaaaaaacctagtgcatcaagacaatcaaccactaaattgagcaggagatctttcataacttttaaaaagttattctataagacttcatatgtgtgaggtatacaatgagaaaatcactggcttttaattccaccggaactcagttcaaatcctgtgtaggggatttactggtacttattagtaaagtgactttgtaagaaagtcacccaccttttctgagcatctatgacatgaaggtggtcattccaagatgaagccgagattaatttcactcacacacaattccatcttcatagaacaaaagaaatgtgaaataacagtaacttaagcaagatagaaaggtatttcctcttcatgtgcaaggctggtatggggccccacagtatcaaagagccaggttccttctatctttcttgtcagttattctcagcctggactccatcctcaaaagtacctcatggcccaagagagctgctggggcccctgccattggtatgccctctaagaagcagggaaagacaaggggaagagaacaaatgagtgcattttctagctaaatcagttccctttaaaagaggcattttgaaatttcttcacaatgattccacttgggcaagaaattagttactggccatatttagaagcaatggagcttggggaaatatagatgtttaacacaaggtgacaatgtgctcaggtgaggaatgagctttcgattagcagagaagaggagaaaccagattagcaggcaaagagcaatctctctcaccagtgttacagagtacatgatgacaatcagaattcctagacataatgagcccctaaaaaggtgcttggcacataccttgtactcagtaaactacacatttattttctttcataaataaagtaaaactgctgaggactatgctcttaatttcttttataacttcacaaatgtgtagaccagagtttgtcaatctcagcattactaatatttggagccagataatccttgctgtgggagggcttttctgtgcagtataggttctttattagcatccctggccttgacccactagatgccagtaactcctcactcccaactgtgacaatcaaaaatatttccagccattggcaattgttcctgggggaggaaattgcccttggttgagaaccactggcctagacctgtgctggacaataggcactcttctatattctctagggttgagtggtgcaggggctaaagacccttgagctcatagtgctgattccattatgtggaacccagcatacccgaagtcagatgaagcacagagacgaatctctacagttaaaatgttttcttccagcctggccaacatggagaaactccatctctactaaaaaatacaaaaattagccgggcatggtggcaggcgcctgtaatcccagctactcgggaggctgaggcaggagaattgcttgaatccgggaggcagaggttgcagtgacccaagattgcaccactgaactccaccctgggtgacagaacaagactccatctcgaaaaaccaacaaacaacaaaaacaacatcaaagttggggacagagcacaggcagtcaagagacagccagtgagaatcagaatagggctttggattttagtctgagtgagacggaaatgaatcattaggtttaaggtagacagcagtgtgatgccacttatatgtttgaagggtctttccagcagccatgaggaaatgtgattgtttggggtcagagtggaagctaggagacccatcgggttgctcttggattcatcccagacagagagaatggcaggttggaggtgggaagagtggttagatgagatctattccacaggggctctgaaggaggagctgacaggctttgcagatggtcaccagaagtgattaaaaagtgtgtggtttctagaaaacattatgcaaacctaatcttttaaaatacatcatcggaaaattgtagcattaacactgcttctgacttttctgagttttctgacttttctctccctatatttgtacaaactggtttctagagttgttggcctgtaagaaacacagtgtagaagacagggatgtatatgtctctactggtttgttgagtgattacagaaccatcatcaatatgcacatgcctgaattttcccatttgtaaaactgatgactatgtgactacggattaccagtaaccttattaacctacgcattaagagaaaaagcccacctagtacttcatgaatcccaaaagaaatgcaaattgtaattatctgcacaggtatccagtcatgctaacatccaaaggagtcaaactctgattaataagcaagattcattcccaaagattcccaaggatcccaagttaaagacaacccttcaatttctgtcagctttgtaatatattccagagtttcagttgggcttaattgtgacttattgattgatttttgctttctgacaaaaaggattgctttctttccttgtgaaattcaaagtccctcatggcagccttgattaatcatttgcaaaatatggtttaaccatctatgatccctagtgtacaaatttctttcactgcaataattttaaagtaattcaaataagcctgttctaatcaaattccttataagtctgcaaaagataatttcttgatggaatatggaaaaaatgagtgcttaaataagaagtattaccaatgtaacaaattatcattcctataatacacgattaatacgacactgcacaaaaagaatacttatgaaatttaatcagcctcatagcattatgtgctttatctggaatgatggcatgaaaaagttatctaaaattccagttgaagaccaattaatataatcaataccagaaaatgtctggacagaacaaatgcttaggacattacataaaaagagtaagtggaccgtaaccaggcatttcattcctgcctagtatctagacagtcagagataagcaaagcttatcttcatcaaattatttaacattcacgtaggaactctgttctattttaaagtaacactcatgtgtattcagtgagcatgattgtggaaatgcatcattagaacaaagtttttggtttaggaatattattctataataatttattgtatgtatttgaaagacctttcacaaaataatccttttcataaatatgctatttcaagattattatatattccttagattacttgttgtttataaaataaggtgtacttctattttaggactaaaagtaatatccatgaaatgaattttatgaaacactattatgatcccaaagttttgctccaatgtttttagcaaactttgtaaactttactcatttacataacctgattacgaaacctacttcagactggagctagagtaccatcatatatatatttaaaaaacaaagattttggtgtattgggattgaggtaagaattgtattatatcaaacatataaataagtaacataataaagtttatagtactttagtgtgcagcaaagaatactcaaaaatggaagagagactctttaatgaaaaaatcaaattatttaaccagcaattcctacaaagaaaccaaaatacatgcaaaataacataagtataaatagaatacattaaatcttctctggtctaaccagagggcattttcttcttaatgttttttaacagaaaattacaaacaacaataaaatacagtagtatatagaaccattgatacctgcatcttgatggcagtggtagctacgtaaatccaatcttacacatgataaatgtcacaaaatcatatacatacattgcatgcatatcaattttgtgcttttgatattgtttacaattacttaaagtgtaaccattggtggaaactgggcatatatgatttctctgtgctgtctttgcaacttactgtgaatctataattattccaaaattaaaagttttttgcaccattcatacaggtataggaaacgtaccttagaacattgcttgtgattctggcaccaaaccagggaaccattgttctgcaaaaagaaaaaggaaaaatattgatccattagaaagctacacatacacagatttctaatttaaaattataatttatgcatataatttttgaatatttgcattttaacaaatacccaatcttgcaaaacctgctgtccttcccttccaatgatagaaaatgtgtttgtaagtttcattttgttgtcgatttcatgatgtaaacaaagacatataaaatactaaagattctaagctgtctgaaatgaaaaagggtctgaggcaactttgatggtgtgttgagcagtgaagcaggtaaatgaacactagacgttccgccaatagtcagcagttttgagaaatttacaacttaagcattgtggatgcttttgatctcaaccaatttacagaaataagagtttgggattgggagaaagatcttgtattagtctgttcttacacttctataaagaactacctgaaactgggtaatttatgaagaaaagaggtttcattgactcacagttctgcaggcttaacaggaagtatggctggggaggctcaggaaacttacaatcatggcggaaggcaaaggggaagcaagcacatcttaccatggcagagcaggagagagagagagagagcaaaaagggaagtgccacacacttttaagccatcagatcttgtgagaactcactccctgtcatgagaacagccaggaggaaatccacctctatgatccaattacctctcaccaggcctgtccttccaatttgacataagatttgggcaggcacacaaatccaaactacatcagatcccacgtgaaaagccttctcttactctttcacaaaacatatgattacagacaagagacttaacatccccatgcctcagtttatccatcagtaaagcaagcctaacagcaatatctcatgcatcaggccactggggtaactaaatgaaacaatagatacactcaatatataacaaatatttggggccgggcgtggtggctcatgcctgtaatcccagcactttgggaggccaagacgggtggatcgcctgaggtcaggagttcgagaccagcctggccaacatggtgaaaccctgtctctactaaaaaatataaaattagctgggtgtggtggcacacgcctgtaatcccagctactggggaggctaaggcaggagaattgcttgaacctaggaggaggaggttgcagtgagctgaaatcacaccattgcactccagcctgggcaacaagaggaaaactccatctcaaaaaaataaataaataaataaaattgtactatgatttattatcctgaacattagaattgctgtattccacataactaagattttggtgatttttttttttctctggttgggatcttttaagtcaggttatgctaggccggaataggtagcaaagctagcagaaaccatcacccaatagctaaaatgtcatgacctctagttctctgaagttcaaggtggagatgaaacaaaatctcccatttcctatgtttgaacgtctaaacttttaatatgaaggataccagtattgacagagcaagatgatatatgtttgcagttatgagaaaagaaaattgaaccaaaaaatatcttttagaaaatacttttataacaagtttattgagatataattcacaaaattcactcatttaaattgtacaacttgagtatattcagaaagctatgcaaccaacaccactatttaattgtagaacattttcaccagcccaaaaagaaacctgtacctatttgtaatcactcccattctgtcttccccactacttgccttaccctggcaaacactaaatctgcttctgtctttatctatttgcctattctggacattttatataaatggaatcatacaatatgtgtctggcttcttgatgctaaatgctacagcaatcttgcttcatgtacattgtagtatatattggtacttcatctttttgactgtcagtttcagctacatggatataccacattttgcccatccactgccaataacatatctgaatatgtcccttcccagtaatagcttaattataggatcccccccaaaccactaaataaatctcagctgtataggattggcaatcttcttcttcaatgtgaagattattggcttaaaagatctcggtcccatatgaatgctttaactatgaaacctctctagcatatagccctactttttacttcttctcagccttaactcctaataattcctacacattcttaggattttagccagccttaactcccaataattcctacacattcttaggatttgagccaatctcctatgaacctacctaccacctactgagttccgtacgtccacatctgggccctcatctctccccccacatctatgtcccccatagagacagtaaggtctgaagctggagacgcatacgaacagcttagggtgaagttcgttatgatttttggcagggattacatcagataaataattagattgggcagaggccaatgccagacaaatgatgggcgtggttgaattaccggaaaatgagatgttaggagaaagcatgtaagagggcataacatacccttttataaaactgaaattttataaagggagccattggcttggttataagctaaaagttcagaggggccaggctgactaggggatggtcataaacagtgtgacaactgcaaaaagcaggggccaggcattgagcatgcagaagctgggggctggggcagggcagctttgaagaacttcctacatgacagccagcctcagcatgttgcacggtgtgtagattcatacaggattggctaaaatcctaggtatgtgaaggaattattgggagttaaggctgagaagaagtaaatattagggctatatgctagaggggtttcatagttaaagcttcccctgcttcccctgtgcagagttggctcctgccaggacttccaaggacgacacctgtctgagcacatcctggattcaacttgagtgttccaagctcctccccaaccagtgatgggaagcaatgaggcaccttctaaagagactcagggctgaagtggacagcctcagaccttggagactaggtcaaagccagttcctgaaggtctttttcagcaccatcttggttggaaggttttgagtcttcttgagtcaggtcagtggggttctgctccttggactagaatccttgacatgggcacaggtgagacctccttcccttctggatgtttcttttcctaggcagatgggcaggaccttatctctggatgagatcaggggaccctcagctatttctgcacttgctggattcctctttggagttttatcacaccctctcctgctgaatgatatgctttattttgtctgtgtcttggttgctcaactagatttttccctggggacaggattccatgtttcctctttacctgtctgtaagacattagcaagggagggcagctcttggtcctcacagagaaggcacatttctgaggccatgcaagagtgactggggttccaaaagtgggcatggcaactgttgcctggggttccaaaagtaggcacagaaactgttgtcaacaggttgacaaaaatatcactaacgcggcaatacacctttgactattattattattatagtggccaaatctatgtggcagaaatgtgccttgatgttttaatactcaccccatgtaatcatcccacaaaatgacataagcttcatttattcattttacagttaagaaacctgtagtcagggaaaccaagtaaaatatgcagagtgacaaagccagtgattaacctcaatggtaaacaacacaacaggaaaagccacaggtgaagaaaggaacaagatgcacactcgattttgaaggaatttccagatttataaccttaaaaggagagatgaagattggtccaacagtcctaaataccatatgttgaggtagcagcagttcagatggatggggtggagcagagaataggaggggagatcaggtaaatagaaagtagattgcaggattttcattacacaagattttatctctggaaataatatttttaatttagcaaatatcagagagttaattaaaacaaaaataaaggattagagtcctgagaagccctgtgcaggacacaccttgatatggtttggttgtgttcccacccaaatctcatcttgaattgtagctcccacaattcccatgtgatgtgagagggaccctaggagaggtaattgaatcatgggggcgggtttttcccatgttattctcgtgatagtaagtctcacaagatctgatgggtttataaagggcagttcccccgcacatgctctcttgcctgccaccatttaagacatggctttgctcctcctttgtcttccaccatgattgtgaggcctccccagccatgtggaactgtgagtccattaaatctctttttctttgtaaattacccagtctcaggtatgtcgttattagcagcatgagaacagactaatacacaccttgattagctttcttttgttcccttctactgtgtatgttgaatggccaaacttcaacaacaaaagcacaaaggatgcagcagagattgtcttcagctgcccaacctccccttcccaagtgtaaaccctcctgccctgccccacaccaactctccttctttcctgcaattcaatgctccccataccattggcttatacacacccatcaaaatgagaagaaagccaatagccacagagcctattttgaattgggaattaatatcaatacattgcgttgagcaaggcattttcatttcaagcaaaattttctactaatcacaaaatgaaaaactctgtcattacaaagaaatatttggggcaatggcaagcatgcataaacaattattatgattagaatgattttttaaaattagtgaggacagcatgtcataggctgcttgggatgattaaaaagataatccttgtaaagtatttatcaaaatgtttggctcaggatttttaaaaaatcctttgttattattgatgtgattttgttgtcatttgccattatattgtctttagcagtttgggagtaatcctagacttaatatctcccagctcacaacggataatactcaccctagactaactgattcagtcttattatagtgagactcaaaagtatttagtattgaaaatactaagatacagtattttagcaatactaaaatacaaataaaacttgcagtaaaaggatgcctttccattctgttttttccttgggtggaagcaatttttcaacatttgccaacaggatgagtgggcaatggtattggtatttttactttaatttcctgactggccatttattttcctttaccgtggatagtctgtctcttttaccttatctaattgcggattgttcaccatttttaaaatcaattttagcaactattagtatcacttaggttcaatgatcatttgtctattgcaaaaattctcaagcccctcattcatcttttgcatttatttgtgaggtttttccacaaggaaattttatatgcatgcacacacacagatgcacgcatccatgcattcacatatatatttgccctcaaaatgcatccatagttcctttttggattctgggtttcctgtttttcttaaaataattgcccccatgccaaggttttgcagccgttctgtgcttttacctgtatcagtcatcatgtgctgtgctatttatctctactaagaacttctaagaaccctgcccactagcatcagggatgccaataaacccccgattaatgctggccactttgtttaggccagatgctaccccatcacgatccacctatgttgcttacatatagtactctttgagcagaagagcaataaaaaaatacaagaatccagtatatttcaataccctgccccagcagaagtccttcgtcagattacaatagccttcaccagttaagccatttgacaacaaagataaaataacagtatttgcaataaagtcttgttctggcttaaagccaacaaagataaagagtcaaagtacattaggctagaaacacatttgcctctagaaccatcattgtaacctccaggtaggattagacagtgggacttttgtaattatataaagattacatcctgtattttattggtttaactagatcaaacatgaatgctagtcaatctggctttcaaagagtttatataagttcaatcaactgcacccagccgttatttcaatgacattttccaagtcttttcatttctagccttttgatttttccttaaagaaagataactcttcaaaagcttcaagtaaagaaaacacatcattcatgcaaagacaacacacacgggaagaataaagataaatggaaactagttctctagatcccaccatatgaaaagagaaaacaggaacagatctcactcatttccttcaacatagccaggtgtcggcatggaacagctaaggaactagtcagtctacaatttccaaaatacataccaaactagtgtctaacaatggaactgaacatttgaaatagaaatcagtcaggaaacccaccatagaccttaactttaccaatcaatgctttgacactgcaaataattagctgtgaccctgaatggacaattttgtgtcctgcttggtgtaagttattttaaagcaatagatgaaactatagatacaagtcattatatatttgtccaaacccatagaccatacaacaccaaaagtgaagcgtatgtaaactatggaccctgatgatgatgatgtgccaacgtaggttcatcccttgtcacaaatgtcccactctggtgggggatgttggtaatgggagaggctgtgcatggtgggggcagagagcatgtggatattctctgtaccttctgctcaattgctgtgaacctaaaactgctctacaaaataaaaagtctattgaaaaggttcaggaggagggctttctttatatatttgttgttcataagtaagatttctttcaaatgttatggaatatcctcagcagtcttttcattaaccaagaaaaaagtctctctgtattctacaaatatttcacatttaatggaattctacaggaaacaaatatttgaccatatagaaagaaatacacctgcctccagacacccagccttcccatactgtcctttcttcaaagaaaatgcgacttcaaccaggaagccttccctgacccccacgccctgacttccacagctctctctctctgttgcttgctctataacgttctgcacttctccccccaggcactctatcacacagtggacaagtgcaaattatgtgtgttgttttaatttaatgatcatatgccccccagcctggaaaagctttggcggtagtgtctatccctagcacatgtttgccattggctctctggcacatagcagcgtgcctgacacagagtaaatggtcttcacaaatggtactgattgaagaaataaatgaatggagtaggaggtcatacaaaggaatttaagctttagttattaggtcctgaggagctagaaagaatgatataaatagactgagctgatgaaatgtttcatcttctctggatggagcttttaagaagtaggctcattattttgtttcctatgatgtaaatgtccaagagatttggcatgatgacaccgaaaactgaacaaagacttgcatttgggatcaaatatacgttatttaataaataaaaatactaattatctttttatagggtgtagatacagtacctaaagaaaatatatagaacagcaaatgccagacttttcttcttctcatcattccctaaacaatacagtgtaacagctatttacatagcacttacacagtattaggtattataagtaatgtacagatgattttaaatatataggaggatatttgcaggttatatacaaataccacaccattttacttcaataacttgagcatcttcagatgtaggtgtctgccggggtggggaggggaggcagatcctgaaacccttagggtgcattataactttgatatacttttcctgaaactaatagaattgtgttcttcaagtatattcatccaagaagaacatactgttgtttcaatgtaaccagcagttattttccacctgtacttttaaaaccaactggccaggcatggtggcacacgcctgtaatcccagcactttgggaggctgaggcgggtggaccacgaggtcagtatttcaagaccagcctggccaacatggtgagaccccatctctactaaaaatacaaaaataatctgggcatgccagcacatgcctgtaatcccagctactcgggaggctgtggcaggagaattgcttgaatccaggaggcggaggttgcagtgagctgagatcacaccactgcattgcagcctgggtggcagagcgagactatgcctcaaaacaaaaacaaaaacaaaaaactttagggggaagctgagtgccagacagtttaaaggaacaatagaaatgcctaagaaactatcatcagagtgaacaggcaacctacagaatgggagaaaaattttgcaatctatccatctgacaaagggttagtatccagaatctacaaggaacttaaacaaatttactagaaaaaaatcaaacaaccccatcaaaaagtgggtgaaggatatgaacagcacttctcaaaagaagacatttatgtggccaacaaacatatgaaaaaagctcatcatcactggtcattagagaaatgcaaatcaaaaccacagtgagataccatctcacaccagttagaatggtgatcattaaaaagtcaggaaacaatagatgctggagaggatgtggagaaataggaatccttttacactgttggtgggagtgtaaattagttcaaccattgtggaagacagtgtggcaattcctcaaggatctagaaccagaaataccatttgacccagcaatcccattactgggtatatacccaaaggaatataaatcattctactataaagacacattcacacatatgtttattgtggcactattcacaatagcaaagacttggaaccaacccaaatgcccatcagtgatagactggataaagaaaatgtggcacatatacaccatggaatactatgcagccataaaaaaggatgagttcatgtcctctgcagggacatggatgaagctggaaacaatcattctcagcaaactaacacaggaacagaaaaccaaacaccgcaagttctcactcataagtgggagttgaacaatgagaacacatggacatagggaagggaacattacacaccagagcctgtcagggggtggggggtgaggggagggatagcattaggagaaatacctaatatagatagatgatgggttgatgggtgcagcaaactgccatggcatgtgtaaacctatgtaacaaacctgaaagttctgcacaggtatcccagaacttaaagtgtaattaaaaaaaaaaaaagaaagaaaaagcagtacatatacacagtggagtattattcaaccataaaaaaagaaatgtctttaagaaaacaaatgtcaatttcatttcaaagttcttgtgaataatgaaaatcatcaaaggagaaaattatgcaagaccaacacagagagaaaacaatattaaataactttacatgactttgaattacattgttttcttttcttttctttcttgagacagggtctcactctgtcacccaggctggagtgcagtggtgagatcacagctcactgcaaccttcgcctccagggacattcttcaccatggttatctgcaaagagtatgacatgatgcgaatatttatctggctatagtgtactttaggtgatacgtaataactagaagtgttttgaagccttcttaggtcttgtatttccttaactgttgtaggtgttgtgttcttaatataggatgttttataaataaatataactaaaaattcatcaagaaaaattttagcagaaactaaagttgcatagactaaaactatgacttgcgacatttcttagctacatcaggattcaaccttgtccaccctgggaaaggtagtgtgcaatagctgctcttatgcacaaatgattgaaaaccattatttgtgttatcttataatttttttttatttttttgagatggagtctcgctctgttgcccaggctggagtgcagcagtgcaatctccactcactgcaagctccgtctcctgggttcacgccattctccttcctcagcttcccaagtagctgggactgcaggtgcccgccaccacgcctggctaattttttgtatttttagtagagacggggtttcaccgtgctagccaggatggtctcgatctcctgacctcgtgatccacctgcctcggcctcccaaagtgctgggattacaagcgtgagccaccacgcccggccgtgttatcttataaatttatgagggcttttgaaattccgattttatagttaaccacatgagccacataggagtccagagctctctgagaacttctacctcaccagcagtccttctgtgcaaagtattttcatcaatgggcattccggtctctgtcaaagtgtaagatctatttgaatctgaccaagcctgttctctaaacacaaccaggataagaaaaaggacccaacaagtgattccaaatacccactcaaaatgtttgtaaatggtagcattctgactcagatgataccatatcattacaactcagagaagatctttgagggccattcaatccatcttcttggtgaaaacaagacaaatgtaactcgttaatgacatgtcattgtctcataatacagggaactttccaaggaaaagaggttacagtgtccctgtaacatgttactccgctatgctgacttttccatcctgaattcctagcgaaatctctcaaagccattcaagggaaaaggggtgaggagttgcaagtgatcaactttcagattttctgcctgctaatattttattctctgattaactaattcatctagtaactctctccaaaacatttaccatgccaaaggaaaacatcaaaaccagaagagaaaaacacaatgcagggaccatcctgcctgagtgtgaagaaggaagatcacacacatattactgaattccataatactcaagggcaggaccaagacgatgacacaaaccacatcatggaaatgagcatatagtggggaacttagaatttccactaatgtctgaggagaaaggaaaagcaaagaatggggttggaggagaaatctaagtgtccaataaacctcaaaattaccatgctgaagaggaatctaagtgtccaatgatagctctaaacctcaaaattaccatgcctaagactgtcccaaatcatcaggttagtcattgtcacacatcagaataacatgtgaaagccactggcaacagtggcaacacaagagtcagaggaaaattctacatcctgagaatggcaagttaatagcaattcaagttcaacagtctccctttgtagatgagtcaattggggctcaggaaggctaaaaaatgtatgaactattactgattcaaacacaaagaatattttaatagtaagcacaccttacttaaagtcaaaggctttatttcacatgccaggctactactcatccaccatgggtggtaagctctcagaaaaattaatgtcttcttttctcaaatgagatgaataatgtctttacaagataatcacagagatgtctatgaaaaccacctgtgaccatccaaggtcaaggctgtagtctagctggcaagatgccaagttcagtgatatgaccactttgcacacaaggagtgactttcaataacgtagaaggtctcagagagctctggggccccacctggaggttgattaatcccaattaatcatgcgattagccatggagaagtcagaattctaaaatccctcagtaagttttgatacaacagtaaagaaaatggtttccagtgccttataaataagagcagcctaattaatttctacattgtatggttgtttcaagtctttgcaaaggcataatatccatgtaaagaatagaatctatacagttgtttaatgcaaggtcacactaaattagattcacatatcaaaaccccacttgggagaacatgaaaatgcaatactgtcaagtgctattcttagtataatttcaaattcacattgaaatatatgactttgtttcctacggctgccatgacaaagtaccacaacccagggggctgaaagagcagaaatttattgtctctcggttctggaggctggaagtgtgagaccaagttatcgcaagaccatgctctctcagaaaggccataggggaagattggctccatgactttctttgagcttctggtagttccttggcttgtggcagcattccaaccttcacatccgtgtcctcacatctctgcatgtctgtgttaaaatttctcctttcagtaaggacaccagtcatattggattaggggcctaccctcctccagaatgactcatctcaattaatcacatctctaacgacgttatttccaaataaggccactttgtcactttctgaggaactgggggttaggacatcaacatatggagttagaggtgcattattcaatccggaagcgactaaaataaattaaagccatgggacaaatactacattgtttcagccacacttcaacctgcacctcagttaataatctatgtgttaatatgttcacgtattattttttcaatttgcttcaactcactatcaatgtttatttcttcactttggcctccttgccatctcccagcaaatgtcagaacatggtgttttgtaacaacccatctgtccatctcactgacaatggtttttcctttcataaagtacttcaatctgacagcaagtgggtgtatcataagaaggcatttgtaatccataatgtaaactgtttagaatcaagtagtccagttttggtgaaaattgattgcttgaataaacatggaagaaccacaccgtcataatgaggtgatttggccaagcacacaattctccccaggtgtaaccaatctacttttaaaatgttgcaccctctggtgagaccttcagctttatgttcctgatctttgttccatacctggaccttgattactaatgacccattctctcccaggagacccactctctctccctgaacacatatgttcagaggaattgacaatggcctcttcatctgtcaacaaggtggaatcaaaactcatgtttcaaaagacatggcagccagacagtgactccagccctctcatttgacaaatgagtctactgattctaagtgagcctataatgatgtttctgctgaggacaccaccactgacttctacttagtaagctcacacttaatcaattgtacataacctgaatcaaaaagggctgcccagaagaatgtccaagctgggggatggagaatggacagttccaaagctagaacttggcacctcttatcaagcaaagaaaggtaccagagagaagcccgacagcatgactgactgaagcagtgactttcaaagtgtggtactggaaccagtgatatcagcctcacctggaagcttttgcaaattctggtgatataccttacactcgtagaatcaaaactcctggggctggagagcagtcagctgttttacaagttgtccaaatatggctgatccccacgaaagcctgagatgcttactcttcctttgctttatgtgacttcacgaaatacactccaaatgtctcctttctttcttttttttttctttctttcttttttttttgagatggagtctcactctgtcacccaggctggagtgcaacgacgcgatctcagctcactgcaacctccgcctcccgggttcaagtgattctcctgcctcagcctcccaaggagctgggattacaggcgcccaccaccacgcctggctaatttttgtatttttagtagagacggggtttcaccagattggccaggctggtcttgaactcctgacctcaggtgatccacctgcctcggcctcccaaagtgctgggattacaggcatgagccaccgtgtccggcccaaatgtctctcttctctcccttccaagtgtcccaaataaatgactgagacccttattcagctcttacaggtatcttattggattcttgtcattgagaaagaacaaccctctttgtaaagcagtaagttgatctttgcatgtgctggtttctttttctccaagaccaagactcaaggtaacaacattcagggcggtctagacctctctggcctctgctgtcttggcctcatctcagtctctggccattttcatacagaacaactgtagaaacatgtaatttcttgctggggatgactgtgtggcaaaagcacaaagcagactttaaaggcactctcaaatcaccctattatttttcaaaatagatgcttggcagctgcaaagcttgacaggtgcaatatgttatacataacaagtcattcccacaaggcacattactgcctggaatctggcatgttgaccagcagaggttaaggattaatgttaagttatcaagctaattactcacatgcattaagagtaggtggagaggatatgcttccggataacatgagctgggaactattgctattatcactataaccattaaaaaaaaatctaattgaaaaaacgtaccgtgccccagagataaaaactattatttccatgtgcttccctactgaatattttagcaacacattttggaatatgcctggtaagtcctagaagttgttgttttaatggtaaagcaaaacccccatcttgctatacacatgtaaactaggagatgcaggacttagtagttgagcttcatttgtagtagggaacacccaagaaggggaaaaaaaatgactaaaaatacatgttttccccttctaattgactttactaagtgtcagatttttgtcacattgttttcttgtgatatatgctttttcattatgctaatttatgttattcattaaagagtgcagaataattcatcaaactaaaatagagtacctcatagtctattatgccctgacttatattctaacccattcatcatgattctgggttattttaatataaacttcaaaagacagtgtgttttaatgagggatcacttgagaaaacatgattaattaaatgtgatgcaagcgcaaagagcaataaccccaagaaaaaactgctttgcaaaaaaataaaactcattccaagaaaaatgtgttcattgcagaattagaaggatgtctgaaaagtcaggtatgttttcccagtagaatagatgacttggaattaaatgactttttttccttacacaatatttatccaggatttcaaatttcaatttaaaaatctacttaatcttatcctatgcatcatacggaaaggtgaaatatttctcttttttcagagacagggtctctctgtcacctaggctggagtgcagtggctcaatcatagctcactgtagcctcaacatcctgggctcaagcaatccttctgcctcagactcccaagtagcaaggacaagaggtatgcaccaccaagcctggctaattttttctttttcttttttttttttttggtagagatggggtctcactctgatgcccaggctggtctcaaattcccgaactcaagtgatcctcccatctcagcctcccaaagcactgggatgacaggcccaccatggccacccagaatgggaaatctttaagtaacaaaagcacacacgagagatctgcatgtcatgctctactgattgaactagatacttcaaaacaaactggaaagagtctcttaaattaaaaaattaagtttttaaatctcttttggaagtggaggggtctctcagaccagactgtagagcactggggatccagggttacatactattcattttattttagcgatagggtctcaccgtgttgcccaggctagactagaactcctaggctgtgatcgtccctcctcagtctctcaagcggctggggctacaggcatgcaccacactatttttgaatcccaggatcatcagcaccaggcactccctctgggcctaactcaacctgatgacagccagcgcgtctgtagagccaagtaagaggctctgttctgagtaaaatgcatggcatcccagaaaactcaatgaagcagcaccaccgtcaaaatggaggcaaagggcagtcgacggtctgagagagagggcagagacaacagtcttcagaaaggaaaagaagtttacttgcaaagaagtcccaaaaacagaagaccttaggaccagctcaccaacagaaataatgataatgtgaatttaaagaagaagatgcagcataactaagtttgcatgagtctgctcatagataaaaccatccatctacttatatgatcatgctcacatgccacgacacatcttcacaatcagggttgccaaagacgcaaggaaagtgaggttttcgtttaggagagagaaacttaacagaatgctacaaggtctcatttattcagaagatgaaaacttgtcaggctaaccctgtccttttgtggtcatctcagggcccaaaccttctcctctgactgtgaatggggatgtccatgtctcctcataagcgagagagttcacagcatcagttttgattccagaattacttacagcagagatgtaagcataggaagggacagaaccagggtagggcaccagcgatctggatccacagtgcactctggatcaccctgtaacccctcctcttgtggcctcccatctctgagctagtgacacctgacacctcatttgtgtctgtgcaccccagttccctgacacagtcctttgggaatgaaggcacgtgccttggtcatcttggcaacaccagcgcctagcaaagagcctgacacagcacagacccttagtgtttcctgagaacaagaagctaagccatgtcatgactgccaggatgtttgccatagagtggaagcaaaacatatacagatagagacagacacagagatagagacccagagacagagacagatggaatagatatggatatcccgatacaaatattcacatactgctatgtttggagacatcagttttgtcatgactgaaggtgggaggcatggtactggcattgagtagggagaggccagggatgctgtggaaccattaaaatgcaccagacagcccctccactcaacaaagaagaatctgctccaaaacgtccacagtgtcatagttgacaaaccctgaactagaaacgcatgcataatatacacacagacgaatatatggaaattaaattctagccctaatttcatgaggttatgtaaaaaagcaacctccatcttcttttcaaaattgtggagtaataaagtgaactagagtatgcaaatcttgccctattaaaaacaggtttaaaacattgcaaaaatctatggctcctggataatagaaaaatgaaaattacagatggtcgactagtctatatttgtttttctggtgattgtgatacataaccagagaatatattctatccagattttttttaaaaaatttctttgcagctgtgaaggcattagctcataactccggatacaaaaatgtggaaacaacaaaaacaaccaaaagatgttctctactttcttttaaattctggcccaatgggaaaaaaaaaaatacttcccagatgtaggccatttctggaatgatgaccactaggtttggctgtactgctttcaaaatggtacagccaaatgtcaaaatagaaagggagagggaagagggggaaagaaaagagagatcaggagagagcgagaagagagagacaatgcatttctactcaaagatatgatgggctgacctggcacagtggctcacacctgtaatcccagcactttgggaagcccagatgggaggatctcttgtggccagaagttcaagaccagcctgggcaacatagtgagaccctgtctctgttttcaaaaaataaaaactcaagcctaggcaatatagtgagaacttgtctctacaaactgttaaaaaattagccaagcgtggtggtacaggcctgtataccagctacttgaaaggctgaggtggagggatccttgagccagggagtttgaggctgcagtgagccatgattgcaccactgcactccagcctgggtgacagagtgagaccctgtctcaaaacgtaaataaataaaataaataaaaattcaaaatttaaaaaataaatgattaagcaaaagatatgatggcactatccatcaaggatatatgggacacatattttagattttaaaggcaaagttctagttccaaatgacttttctgttttgaggacacagtctcactcttgtcacccaactggagtgcagtggtgccactggagctcattgcagccttgaactcctggactcaagcgattctcccacctcagcctcccaaagcactgggaatacaggcgtgagctaccatgcctggccccaaatagctttagtagcccaaaacatggaaaagaaaatggggaacaaagtgcccaccttcaaacaattaatggtggacaccaccctaggtgacgtctttgtcccttcttgccacagatgaaatttaaaagaagcacagttgtcaaaacatgttcacaacaactggcctcccattttcttctcattctatctgaaaggagtcagtaacttctgcatgaacttggcattcatggcatcaacaggattggtttcaactctaggggccaggcgccaatgctgtggtgtggtttgtaattctgcctttatgtgggtcattcatatggcaggactgttgggcaggaataggtaacctctgatgtctggttgccatagcatctccttacagctacgtggttctctgctccttgttttaggcacaattacgcctctaggtgagcagaactctgtccactgggcagaaatgaccatcaagcgagggataaaacagcagttggcagagacaaaagtatctggccatgaagaagaaaaagtggaaatctcagcgctgcatcagaaattgttggtgcagagttctcagaaaatattcgtatacttccaattgtggggatgattctattatcactattcgttatgattgtaaaggatcttgcaatttgcattctgcgggagtcctatcagttggaaagcaaactaatgaccctgaaatgcaatcctccttggcatactggatttgttataacaacactctggacctgtccagttgatggggtgacacatgtcaatataagctgtgtattctgttaaaaatctctctcccgtattttaggcttacaggttttggtcaactttctttctggtatacacagtataacaaggagtctacatttcagaagagtgtcattacttccaacagtgtaggcatttaaagacaaggactgggatatttgtgtaagtctagatggactgtctcttgcaataatgccctattagagatttaaacaagagttaatcaactttccttgaatgaacccttcaaagaactcaacaggttctttgtcacccaggctggagtacagtggcacaatctcggcttactgcaacctccacctcccaagttccagggattcttctgcctcagcctccctagtagctgggactacaggtgcgcaccaccatgcctggctaatttttgtatttttagtagagatggggttttgccatgttggccaggctggtctcaaactcctaaactcaggcgatctgcccaccttggcctcccaaaatgctgggattacaagcgagagccaccgcacctggcccattatgtgactttttaaatggtaacaacatatctgcgttatctttataagaatcagggtaatgtgaaacacaaaattatatatttttgagctcactaagaaaatattttctgaagtattaacaacttgaaaagcaaaaaaaaaaccttatgaaaataaaaaagttataattcaaaacaaaagggtaaacagaatgtgaattaagagccttgattagttgccggattcttttcaagccttttgatgggtattgtttctcagactcccctgaggagaggttttaaagcttcggggattaaagaaccccaaaacttcacatctttaccatcttgttctcatgtgcagccttgagaattttcaaaattctttttttgaaagatttcctcattgcctaacttttatattttgcagagatgccggaaagaattataaagtgtaaacacacacacacataaccaaaacccaaacaaaaggcaatgaagcaagcatgtcaggcacactgagctcgtggaaatggctgtcacatacatgcaagctacaattaccatgcacaatgactccacacatgtcccaccaacatacacaacagcaacacagccaagaatgaggacaccgcaacttttgttgcaggcagcaaacatcccctgtgatgtcgaggactccagctgcttggaacgcttccccaagaatctcgataaaactctgctatttcattacatgcatggaaaattggataggcctaaaaaaaagcaattgacaaaaacaaaaaaagacattcttcatctgaaaaatatcaatatccatgatcatgagttaaattactatatgtaaggatttaaaagacgattcatggttttaatagtttctttcttcacgtcaacaacttgcagcaattttattaaatgtttgtccttctctccagtagaaaataattctcttggccaggtatggtggctcacacctgtgatctcagtactttgggaggctgatgcaacagaatcactggaggccaggagtttgaaactagcctgatcaacatagcaagaccccatctctggggaaaaacaaaaacaaaaacaaaaaacttaaaaaaaaagtagccaggtacgggggtgtaacacacctgtagtcccagttactcaggaggttgagggaggatttcttgagcctaggagtgcaaagctacagtgagatatgatcatggcactacactctagtctaggtgacagagggagaccttgtgtaaacaacaaacaaaaaatttgtaaagaaagtaattgttttggaggcaagaagcacatctcacatatgctggggcctcacaatctaagatacctgaaagacggttgtgttttgcagattcttattggttagaagaatgaattgggtgggtacgtgcaccaccagtcgggatggtgttgatggactgatatttttcaagccattttctatcacaccagcaacctttcaattgtcctcatctgtgcaactgtggtgcaaaactgcctccagaagccagtgagaaatcccgtcctagttcccttacaactgagtgtctctggatcataatataggtgctgtttcccctctgtcttctctcgctgttaacatactaagaagtggagtcattcagtacaaatatctaggaatgtgacaatgagggcttgagtttctgctatggatccttggttatctcattttcaggccttcagttttcttatctgtaaagaaaaataacattcctgacctcacagagtagttgtgatggtcaaatagatattttatgtgaaacaactgtgtcagctccaaaacactgtaaaatgcaatgctaaatgccttctgtcctgtggctcaggaattccggagagcttctaatttccactaattcagaagctgtgtccaaccgcaagccaagagatagcctccttttcctcccttcttctttcttaggctctttcttagaggtgtggccaaggatctccatagagatcaactgaaaagcattaagagttgaaattcaaccagattagcaagaaccagcaagacacacatccctaagtgttgtggcttgaatgtggcatcatgttacaatgggcatgctcttaacctgccttgcagaacaaagcacttgagctttgtggctatttattccttctctaacaagttcccaaagtctggctgctagctgggaggctgatgctatatcatggccatttaggttatggtccccaacaacagaccacactgttgcaagactctgtatttatacacatgctgttccaagctggaataactcagctagcagttatgagactttccctaaaaagataaacaccctccctcctctgagatctcatacaaaaaactccatctattgggctgaacttgtctgtttacaaacaagtcttagcctagaatagaccctaagttcctcatgtacagaggttttagctcatctttggaattgtaacaatccactgatattagctgaaataaatgcaacttattaaatcagtactttttaaaaaaatacatttctataggtttttggggagcaggtggtatttggttacacaagtaagttctttagtggtgacttgtgagattttggtgcacccatcacccaagcagtatacactgaacccagtgtgtagtcttttatcactcacccccttcccaccctttcccccggagtccccaaagtccattgtatcactcttaggactttgcatcctcatagcttagttcccacttacaagtgagaacatacaatgtttggttttccattcctgagttacttcacttacaataatggtctccaatcccatccaggttgctgcgaataccatcagttcattcctttttatgtctgagtggtactccattatgtgtgtacacacacacacacacacacacacacacacatacacaccacagtttctttatccactcattgattgatgggaatttgggctggttccacatttttgcaattgcgtgtgcaagtatcttttttcatataatgacttatttttctctgggtagatatccagtagtgggattgctggatcaaatggtagttctacttttagttctttaaggaacctccacactgttttactagtttacattcccaccagtggtgtagaagtgttcccttttcactgcatccatgtcaacatctattattttttgattttttgataatggccattcttgcgggagtaaggtggtaccacatcgtggttcgacaaagcaagcaaaaacataaagtgtggaaaggacaccctattcaacaaacggtgctgggataattggcaagccacatgtaggagaatgaaactggatcctcgtctctcatttatataaaaatcaactcaagatggatcaaggacttaaatctaagacctgaaactataaaaattctagaagataacattggaataaccctttgagacactggcttaggcaaagatttcatgaccaaatacccaaaaccaaacacaacaaaaacaaagataaataggtgggacttaattaaactgaagagcttttgcgcggcaaaaagaacagtcagcagagtaaacagacaacccacaaagtgggagaaaatcttcacaacctatacatctgacaaataactaatatccagaatctacaaggaactcaaacaaatcagcaagaagaaaaaacaagcaatcccatcaaaaagtaggctaaggacataaataaacaattctcaaaagaagatatacaactggccaacaaacgtatgaaaaacatgctcaacatcactagtgatcagggaaatgcaaataaatcagtactttttaaagaaagaaacagattcagcacctatgcagacagtgatttacatgaaaacaatctacaaatgctacatttgttcctttctgggcattttttacatattggctaataagtataactatttttatccaaccctctttaccatcagggaaaatgtctcccctcacctctttgaaaccatacacaaattacatttttaaaatatacaaaggattgcaggtcctggaggatgtagcttttttggggtgtagctccactagttgcatgctgagtaaatccaatgttggctgatacctgaactattggggctcccttgccttcttcctagacctgccatgtagtactgtcgttaatgatgtcctctcactccagctactgcccacttaccctacagctatttcaagcttgcctgaacagtgcatattttcacatttcattgaattctcaacaatgagggagcatgatgtgcttacctactaggtccaagaattgaaatctttttactgaagtcatcaggagctagaaactaaattcaagtaacagaaaatcttctgaatctgtttctttatttaaaatgatgtttaaactttgtataccctctcaattttttgaaggatagtaaatgaagtcttagctgagagtgtaaaagctaacttatatttttacttattctacctactagcttgaacaggtcatttctataagaaccgagttgtctgatcagaaaaaacaaaagtgttgaatggaaccacgtgtttctgaagggaggtgtcttagactgggtttcctagaagcagaggttgaaatggggtttctcggacatgaggtaatattggggcggagagaaaagctctcagtagaagagggaagagaggaagcaggagaaggcagagataagacctgtgtggggatgggctctcagccagagccctgcataagcctgatcccatgcgatgcttttgggcatgaattgcattacagagctgattccagcagggggctgacctcctatatcccctgagcagagagccaatcgccatggtctgcgcacatcaagggaggaggatgcatgaccttgcaagcaagatggtgcccatcggccaaaggttattcccttaaaaggaagcagctgtaagctattagcagctgatacaggagccgggggatggtggggtaagaggcaagaggtcaacaactgcatcgactggagaaggaattggtgtatatcacctcttttaaaatatttcagaaaactccccaaaatgacacattttcctaagatgatggtgcaaagagaactaaaatgtcataactattcattttatcaatcagctctggtcatgggggcaacctaatgctaatctaaagcttgaaagagttatggctatctttgattaatgtaaagaggaaaaactaggtcatacttaataaacgccatatgttgatagacaacctgctttcaaaatatggaggccagggtaagttaaatggaaaagttgaaaggtagctgacttcagaaccctaaggctctgtgagcttagatgatgcccagaaattatgttattctatactttacacaaggcactgcaaagagacattttcagttatttctattcctatttcataaataaaaatgccttttgataatatggatatgcttcattaattgctgtcccaaacctctcttccccccaaaatggtatgagagtcaggtttctggacagcaataccaagtaatccattggaacttctccatttctgacttaatacaagcagtaccccctaacactttcataagtctctctaccttaaccccaacattttatactcattcactgaaacatacctggtaggtgagaacatgaaaggtggtgaatttattttgaataaatatgataacctccaaatttatgattacatttttaaaagtgggaacacttgcaccaacaatattacctttttaatttaggtgtccaaatacacacatgtggataaataatattatatacagatatatatatatatacagatatatatatacagatatatatatacagatatacatatatacagatatatatatacagatatatatatacagatatatatatatacagatatatatatacagatatatatacagatatatatatatacagatatatatatacagatatatatatatacagatatatatatacagatatatatatatacagatatatatatacagatatatatatatacagatatatatatttgatatactgcataaagaaataaacaagttagtaagtgtattttctattgttttttaaatgttctattacagtcacaataaggtagagttttaaatcatgttcaaagagaaataccatattaaaaacacaaaaaattgcaatgaatagtataaggtttcttttgggtcaaattcagaacgtgttagaaacgcagccagagagccaataactcagaccaggaaacaccaagaccaaactgcatcgagtcgtggttctcccagcggctctctaaatgcctggccatcctgcaatataactgaaaactcagcacagagcaaagggacacatcgtaggctgggtatgagcaccacaaaatccattcctctgaaatctgtgagcctggggctgatttgtagctgctggggttttgatgcgctaattgtttgtttactttgccttggaggagaggctggccctctaagtggaatgatctcatcaccagcttcattctcctttttgccaaaacaaacagcttccaattactgctaggaagagcctctgatctctaatcagctaccaaagggagcctatcggtggtactttatagggcgaataacgtcccattaaggaagaatctcttaacatcagtacaattctggaaccctagggccaagctgccagcaacctgctattagtcttccagcaggatcccatccactttctccctgggcattctgaaatctggcaaagacacagacacacatacacacacatcccgcctcacttgcccacggactactacttttcctcaaaccctactgttttgagcctccattgagaaaacacaggcagacaaagagcaggtcccaggcctgccaatgctgagattgccaatggcaggtcccaagcctgcccatgcttagggaactgattatgtttagagcttaagactcagctacacctgtgccatcatgggcagacccagaggaggtcagaggagcaggagtgtccaagatgaagcatagggcatgaagtcactctcaaatgcatcaagagtcacctataaagagacagggcttatctcaggcaccacctccctcctttccttcttctttaatcttctagagaagttgagaacataagaggagagatgtttctccctaagtgagcatatgtcagcatcgtaccctttaacattacaggtgaccctatgaggaaccgccactccaaagtaggtttaaactttcccagatggctgaatctttgacatacaaacaaagcaaattaggtcagtttcacagacgtatgaacagtgcagtccactatatgctcacaagaggacctaggcttggggtatgctctgcaatggccatgctgaaattctttgagtttgagttttgtatgtaagagtcaatagcacactgcagtactcactggagagtggacatgtcagctcagaaccaatcctgactcccaccgcaccctcacctctccaggacaggttctcaccgcccattcccccatcacctggcacctcaggccccactggccttctgctccccacctcccatcacatgatccctgcccactatggtccctgcagggaccgggcatgggtgtagggaagatcagggttggccatatgcatgtcatacagtgtcccatggtatggttgtgtctgtccccattccatgctagtagcatgatggtgtgtttggtgggtggccagcacgattctgagacactggaatggcacatccactgaggaggatgcaataaacctgggagctgcccatctgctgggggcaggagcagctggcctatgaaggggaggcacctggctcaatttccagaggacctgtgccaggcaagagtacaatccccgggtgcagcagcaggcaaaagaggggacctggccagcatcatgcctgagcacatgtgtctgagcccaaggccctaggtgcctgtgagacatgagtgttccctgggcacaccccaaagccttgggggagccttctcttcctccttccaccattcccgagtctggcctgttggaccctctggccatttcagggctccctccaggaattaagtgctctgatatttacatgtaaagctggcattgcacaatataaagaagaagagttagcgtcatgctaaaattaaactttaaaattttcttcactgagaacaacatggataggaaatttaaaacaccatgacaagttaacagaagcaagtggcagaagaaaggaaaacgttttatatcttatttcctttaacaaacactttttttcttgctaagaggccccacgtttttattttgcaccagggcctgaaaattaggtagtcagtcctgaagtaaattatccagctaaccaacaaaatcttaaaaatagaaacaaaaccaaaagctagaagccatcctcactattaacccggctaaatcgtcaatgaactgtgtgatgagccaacttttcaagacctctgagttcttccctaatttagtagctgcctcctaggagtgttgtggggattaaaagagtagtacttgtaaaatacccagaagagtggctgctccttagtaatcttccgggtagtgctagctgctgtattaccatcacctgcatcaccccaacatgttttgcatcctgattgcatcttgcagggcaggtgcttctctcccccactgggcatatgaagggttaacattcaggaaggtgatgtgatgcacccaagctacccattcgcgacgctacagagcctgggtgtagagcaggtctgcacagccccaaagcccacttccctgttccatacctcacagacccacagctcctcttcactctgctaaccgcacatatgtattctacttgtgagcctgaaatagctccatgccaaatgacctggacaaagcatcctggagccagatactaatatttcaggaggtgctaacatgcactgtttcttttcgtgaatgaagggcagcattcagtagtgaaatgatggggtttccatcccatcttcctttcttcctttccaggtcagagcagtgttggattactcaggtatccctggtctgcattcccacccccatgcctcagtactgagtcccttgtgtttttgggcgtggttgacagccactttgtgcaggtggggcagaaacagcctgcagacctggaggtgtcaggtgtgcacatctacccactgcttttctgtcttgttgctgaagggctgggcagtggaggacagtggggacaactggggcacagactatgagacgacagcttcctctgcaggccgacgacagcaggtcactgccccagggaatctgtgtcactgcctacaccatgagtgcataggttgcgctctcctgaggcaaggcctgacagctttcataattgagagtccacatacctggcgggcatccaggctggaggccaggcaagcttctcccatccttaaacatggcctgaaaccgtgcaagagaagatggaaacaggcacctgctccagagacagctttatgggtgggctcatttgcaggagttgggggcgggggtgaccctgtaggaaagcaatcttcttaagacttcccgtagcccagtcatgagttgtctgcagactgattgctccaccttccttcctttttttttttttttttttttttttttgagacagtcttgctctgtcacccaggctggagtgcagtggtgtgatctcggctcactgcaaccgctgcctcccgggttcaaggattctcctccctcagcctcctgagtagctgggactacagcatgcaccactacaccaggctaatttttgtattttttgtagagacgggatttcaagttggccaggctggtctcaaactcctgacctcaaatgatctgcccgccttggcctcccaaagtgcagggattagaggcatgagccactgcgcccggcccatcttccttctaattattaaaaaaaaaaaaaaaaaaaaaaaaaaaggaaggcaagcggtggggaacagggaagcttggggttttataaggagaatgtgttgctggcttttcagatcttaaaaacacttaatccctgcaatttagataaatcagataggcattaccaggttagggttaaggctcccagaatggctttgcaattgattacaaacacagcacttattaagtcttaactgagtaatttgcagcttatttcacccccagctaattaaaatgtaatcaggattgtctagcaatgtgcattctgtcagcagtttttcttccaaagagaaatcatgccaaggagaccacaagaaaagcctttcacgggaactggcttcatctaagctggtgctttagccactgaaactgtaaaacaaataaattacagcactgacaattcaagaaaaagaaaaaaaaaaggtactctttctccctgggaataggctgctccgttttgttttgttttctgttgtttcaaacaatagtgtggcatcttaggagagtgactttcagggtaggactcggagggctggaaaccaggtgcctggggatcggccctctcctggctctgtccaggatgtctgggtaatttcaccacaggaggtgagcactgggtcttccattccctgaagacgcagaaggactacagagcgtgcccatttctctgacacccacgagacgctgcttctacgacttagaacaaactcaactgcacactcgcgaacgcgccagcttcaccagccggttcaagatcatccccgagggtaaggggaatcacttccacattccacccttattaatatggcctcctctggcagcttaattcccagggcctctagggggacccccccccccaccccttgacccagctctggcaggaggggcgcccagtttaagagccaagggtttggcttccagttcccgcccagccaggggaacccctccccccagcccccatttctccttttggtccctccagagtttccctgaagcgagaaattgggaacttggaacaggtgggcacctagggatagaggcgagaagaagaaggagagaaggatgagagaagagaaaaataagcggaggatttcagagctcgcacgctcgacagggctggtacaggcagcagctgcactcgctcgcgctgagtccggaacctgctctcgtgcgcccacccgcacccggagcctcgcgcaagtcccgcgggggtccgcgccacagggcagagtcccggcaacccgctggagccaagcgcgcggctcccggagcctcccacacaagcgcgcgcgcacacacacatactccccaccctcaggctgaaagaacctacgttcggggtttgggggacggttcccccgggactcgttgaggagtatccgaatacggccccgccaaatcccctgtccccggcacttcttccctgacgctctacgctagtccagggcaagaccttgaatctttggggttccgaattgaggcgcgcacagccactcgcacccccaacacgcgcatacacgcaccctggaacacgacttggcacaagtaccctggctggggctccaagggtgggcagcgagctctgagccctcagagagtgaaaaccatctttcaaaagagacaaagtgtcggcccgcgggcacctgcggggctggggctcgaggtgaggtccccaggcgcagccggacgcgcctcccagactccctcccagtgccccggagcgcctgggactttgcgggagtcgccgcccgcccggagtctcgcgcactccaattcccgggaaaccgccacatccacacacccactcccagcatccacgactctccctccccagggaaatcgcctttggtttcctgctgggaaggagggagttggggcaagatgtctcgggcttctttttcttttcaggagccgggaagaggctggaaaggagagttccagcaccccgactgtaagatccacgcccaggggaagccaggatcagccggcggcgctggccgagaactttgcgagcccaggctgggaggcgcgcgccccggtgcgcccacgccgcggccgcagccccagaaagaacccgggcgggggcctccccgtacctggaagtgctggaagaaggcggagatgcgagtgatctgcaggctcaggcacctggaggcgcagcgagcgcgctggacgctcccggcagacagcgactcgtccagccgccgcgcagcagccgcgccggggccggccgccaggcagccgctggaggccgccagccagaggcagagggtcaggaccgcgccgggcaccccgggcaccatggctgcgggtcgagggcgagggcgagggcgccgggcgcgggccgaggctccctgctccgcgccggggctgcactgctgaggaccaggcagacgccgcgactgagccggaaagttcaatccttcaactccggccggaccctcctcgccgac

SEQ ID NO: 1241 - DNA, 14867 bp, Homo sapiens
cacagaacacggggtgcctggaaggggaacagatgtgttgtggggcacagggcaggctgggaggggaacaaaggtccactccatgggtaaccagacccttccgccagggctggccacttctgcctttggaaaatgtttcacaacgccccatgttgtgtgtgtgtgtgaatcggccgatgtgaaccgaatgttgatgtaagaggcagggcactcggctgcggatgggtaacagggcgtgggctggcacacttacttgcaccagtgcccagagagggggtgcaggctgaggagctgcccagagcaccgctcacactcccagagtacctgaagtcggcatttcaatgacaggtgagtagtggcccctagggacagagcctgattggggggtggagtggaggagatcactaggctggtggagacttgaggaagcaagaaagcccttggtcccctgtggaagcctctggtcccccgtgggagtcctagtctagaacacagttctggacaccagactcaatctcactgggtggagtccttcacacccctaagcggtctacctttcctttgtctgaagtccgtggatcaaagcccctggagctttctgggctgccggagaaggtgaggggtccagccaaggggcagacatgtggcctcagcttgcccttcttagagcctagggtctctctgcattctctgtggcaggagatctgcctctgggcatctgtcctcacatgagaggacagtaattctgaagctgccatgtcccacacatctggaatgtttgtttgagaggtggaggtgatggacccaagatgggggccagggaccttagtttctccacttttccgggaggaggagggaaaggatcaggcggctttaactctgggccaccagaaagaggcaggacactcaccatgcttcatgggcccccacaggtgacaagggtccccaaaggctaagcgggtccagctatggttccatctccagcccgaccagcccgaccagcccagggccacagcaagcacctcccagagagacctacctgagtgagaagatccccatcccagacacaaaaccggtgggatgctggaaacttcctgggggcttgcaagattgacaggatcctgaaggatcccatgggctggagaatggggtctccttatgatcatgggtggcaagtcccttccaggtctgagcagcagtggtggacagtggcaactgccccttcctgcttccgtccccagtgcttagctggggtgcttcagtatttgtctaaaagcgattaaatgactttctcaatgaatctcagctttcctatgaaggaaaagaggcccagggggaattgggattggagccttgaggacatgttatagcatttaggaaagggcatagggagaagtgaaggaggctgcaggctggcatctagcatctaggatgctgtcacctgcatttccagtatcttctctttttttggagatggagtctcgctctgtagcccaggctggagtgcagtggcgcgatctcagctcactgcaacctccgcttcccaagtttaagcgattctcctgccccggcctcccgagtagctgggattacaggcatgcaccaccatgccaggctaatttttgtatttttactagagacagggtttcaccatgttggccaggctggtctcaaactccttagctcaagtgatccacccacctcggccttccaaagtgctgggattacagacacgagccaacgctcccagcctccaatatcttcagcagatttctaagtcaatatgccatgctctggaacagggtggggggaccatagcctcagcggaccacagagaggaggccccgtggtctgaaaaggagctggcaagggaggagctgggctagggaagcttggccccctcacccccttagacagccccctgtgaggtctctgaggacctgacaagtcagggcttgaggggcaggcagttcaggtgcaagccggctgctgagcttaacagatccagaaaaagatcctctgtgactcatcagagcatgctgcttcctccacccatgccctccccatcccttgggtggcagacccaggaatgggccatggagggcagggctgggctgatgagcctgttggggctcctctaggggatggccaaggccagctgccaccatccctatacccaggaccccctcactctactcctcccaccccccaacagggcaccttcagcctgcggaagctatgggccttcacggggcctggcttcctcatgagcattgctttcctggacccaggaaacatcgagtcagatcttcaggctggcgccgtggcgggattcaaagtaactaagtcgggacctgagtggggacactttcgagagggaggtgaccaggctaagtgttgaaggcccctgctggccatgtttctccaatgtggcctgggagctggtgttaagttcaaatgggcccgaaaagggtccccagggcagccctgccagaaggtggggcatttgtgtggggggtaggggactggactcctctctttaaaatatatatatgtatatttatttatttatttatttaattttattttttgagactcagtctcactcggtcacccaggctggagtgcagtggcacaatctcggctcactgcaacctctgcctcccgggttcaagtgattctcctgcctcagcctcctgagtagtgcatgccaccacgcctggctaatttttgtatttttagtagagatggggtttcactgtgtgggccaggctggtcttgaactcctgacctcaagtgatccaccgcctcggcctcccaaagtgctgggataacaggtgtgagccaccttgcctggcgtaatttatttatttatttagagatgggggtctcactatgttgctcaggctgctcttgaactcctggactcaagcaatcctcccaccttagccttttaaagtgctgggattacagggtgagctaccagcgcccagccaggatgggactccatctctcccaccccctccccgaggagtatgcttggttagagggtaccacgagctcaggggctttctgaggctggcctctctggctgaaggcctctccctgcctcctcacagcttctctgggtgctgctctgggccaccgtgttgggcttgctctgccagcgactggctgcacgtctgggcgtggtgacaggcaaggacttgggcgaggtctgccatctctactaccctaaggtgagcttggggggcctggacagggagaaccactggccccaaaccccaaacagccattttcagcttccacgatcaaataaatacatcatctcacatggggcatcccaagtctgtttgtttttgttgttgtttgtttgtttttcagtcggagtctcgctccgtcgcccagtcaggagtgcaatggtgcgatgtcagctcactgcaacctctacctcccaggtacaagtgattctcctgactcagcctctcaagtagctgggattacaggcgcccaccaccatcatcggctaatttttgtatttttagtagagctggggtttcaccatgttggccaggctggtctcaaactcctgacctcagatgatccacccacctcagtctcccaaagtgctgggattacaggcatgagccactgcatccggccccaattccatttgatagatggaaagactgaggctcaaactgatagcacatagcctagagggacatgagaggcatgtcatttcacagaaggggtaattaaaatttgggaaagagacttgcccaagacaaaaaatggggaggcatcagctcaggaatggtcactggttggggtggaccctggggacttcgttgttgtgagtgtccagtttggaaaacagaaattacagcactggacatttcaaaggtattgaatgcagggattgaaaggtttgggagggcttgaggggcaagggaagagggtgttacaaaaagatcagaaagctgctacacctctggcacaagccccagagccatcctttgctgctgagctcctggaagcattattgatgctgatgaaatggccactagtgctgccagagtccgggttgcctggtgccactgccagaaatacaagaagcagggggagaaaatggtttatctcagcctggggcggtggctcacgcctgtaatcccagcactttgggaggccaaggcgggtggatcacctgaggtcgggagttcgagaccagcctgaccaacatggagaaaccccgtctctactaaaaatacaaaactagccgggcatggtggcacatgcctgtaatcccagctactcgggaggctgaggcaggagaatcgcttgaacacgggaggcggagattgtggtgagccgagatcatgccattgcactccagcctgggcaacaagagcaaaactctatttcgaaaaaaaaaaaaaaagtttatctctgcctttccatctcctgtatgctcttcctacataaggtaggaagcccattggccagactgtctagtaaatgtagtctgagacgacagacaaatgtagtctgagacgacaggcaaataaccggcccacccttaatgaaggatcatctcctccccataggtgccccgcaccgtcctctggctgaccatcgagctagccattgtgggctccgacatgcaggaagtcatcggcacggccattgcattcaatctgctctcagctggacggtaccaccccagtgtaccccaactcttcaggccaggcagagaacagctgctgctacttccccccctaaccagtccctcccagagtctattttatcctgctgtcccctctgaagcagggctgctgccctgttttccagaaatgtaaagtgacttgtctaaagtcacacagatgtgagtcatgcaggactttgggactgcagccccaaactccctgctgcgccgggtgccaggtctctcctctagctctgccctgcctcgactgttctatgccacactcccactccccttgccctagctgtctgggggcgcttagggtcctgctcccaggaggccagattcctgtctccagccctgaggctccgtaggagttagagacccctggaccaggctgggctgacccgggccactctggtttcagaatcccactctggggtggcgtcctcatcaccatcgtggacaccttcttcttcctcttcctcgataactacggtgggtgcacaccccacctcataggggagtggtggtggtgagggtgctgtactgggagaagggctctgacatcgaacagcctgggagcgcacctgagctccctcactctccctgggtggcctctagcgagttacttggacgtgcctctcttcacctgtaacatggggaaataatagcacagacttcagagggtggttgtgaagactgagtgaggtaacatatgttaagcacttggcactgtgcctagaagcgctcgtagtattagccattacgaattgttgatgtcacagatttttttcgttggtttgtttagtttgtttgttctgctccgtagggctgcggaagctggaagctttttttggactccttataaccattatggccttgacctttggctatgaggtaggaagccagtgctgcaaccccactgtggacctcccaagatcattcctctcccttccctctggccgcgggctgcggggggctggggtgggatggaggctgagaaatggtgaccgcggcgtggttgcgaggggcggggcttgtcctgaccaggctcctccctgcagtatgtggtggcgcgtcctgagcagggagcgcttcttcggggcctgttcctgccctcgtgcccgggctgcggccaccccgagctgctgcaggcggtgggcattgttggcgccatcatcatgccccacaacatctacctgcactcggccctggtcaaggtgagcagaggggaggggaaaggagaccccctcactcagtcggagccatgctggctccgcctccaagcctggagcccctcccctctggctccttccctcaggatttgcggagcctgtaataattgagggacaggcggggcgccatggctcacgcctgtaatcccagcactttgggaggcggaggcgggcggatcacgaggtcaagagatcgacaccatcctggtcaacatggcgaaaccccgtctctactaaaaatacaaaaactagctgggcgtggtggcgcgcgcctgtagtcccagcggctcgggaggctgaggcaggagaatcgcttgaacccgggaggcagaggttgcggtgagccgagatcttgccactgcaccactccagcctggcgacagagcgagactctgtctcaaaaaaaaaaaaaaaagaaaagaaaaagtgtctactgtgcgctgggaggaacagaccgtcaaggcctctgcccttctagagtttccgtgctagtggggtagacggatgacaagcaagtaaaccaacaaaggaaagaattataggccgggcgcagtggctcacgcctgtaatcccagcacttcaggaggccgaggcgggcgggcggatcacgaggtcaggagtttgagacctcaacagcctggccaacatggtgaaatcccgtctgtactaaaaatacagaaaattagccggaagtggtggcgcgtgcctgtaatcccagctactcgggaggctgaggcaggagaatcgcttgaagccagtaggcggaagttgcagtgaggggagatggtgacattgcactccagcctgagtgacaaagcaagactccgtctcaaaaaaagaaaaagaacaagaactatagagctgggcgaggtggctcacgcctgtaatcccggcacttcaggaggcagaggcaggtggatcgcttgagcccaggagttcgagaccaccctgggcaacatgataaaaccctgtctctaccaacaaaaaataaaaaataaaataaattagttgggtgttgtgcacacctgtagtcctagttactcaggaggttgaggcttgagccctggaggtcgaggctgcagtgagctgagatcccaccactgcactctcagtgacacagtgagaccctgtcaaaataataataataataataataataattgcgaaagggactctgaagtaaacaaaacagagaaatatgatagagaatgactgaaagttggggaagtagatcagggaaaagatattacaagcggagggaaagcaagtgcaaaggccactggcagaagtgaacaaggcttgggtccctaacagcttaacagtggctcacacctgtaatctcagcattttaagaggccaagacaggagaatgcttgagcccaggagttcaaggctagcctagcaagaccctgtctctgcagaaaatttaaaaattagcgggttgtagtggtgtgtgtctgtggtcccagctacttaggaggctggggcaggaggatcacttgggcccatgagttggaggctgcagtgagccatgcattgcaccacggcactccagtctgggtgacagaacaaaacctgtctctaaaaaataaaataaagtaagctggacacgtctgaggatggaacaaggtgagtgaaggagcgtgtcaggacctgaggtagccagggacctcaaaggccagccttgcttcacccacacagtggcttacagtggtaaggcctctgtggcaagaacagagatgtaggaaaccatcggctgacctgaacctgccccagactgccacgcaggggacttaagaaggtactgggctttggggagaacatagaagtgtgagggtgggggacactgtggtggctctgagggactttggcacttccctctccctttgatcttcgtagtctcgagagatagaccgggcccgccgagcagacatcagagaagccaacatgtacttcctgattgaggccaccatcgccctgtccgtctcctttatcatcaacctctttgtcatggctgtctttgggcaggccttctaccagaaaaccaaccaggctgcggtgagacacactttcccccgcacctgaggccacacacgtactcatgtcctgtaagccttgccgaggaccctaggcaatgcagctgagcccttctgagtctctgccctgatgatcttccctgttggcagatatcattcattcagcaaataatcattgagcatttgttatataccaagcacatcctagaccctggggatacagcagtcaatgctacaaagacccagctctctgcagcttaaatagggagggaggtgagcagacaggaatgaatacccaagggaagtacagagtgggaagaaataaagggggtgaagaagcatagttgggggtatgggggtggggtctgcattagcccaggtggtcaggaaaggcttcttggaagagatgacatttgtgctaatactggaaaaggaactagccagctcctccctgactctctgggatctgggacctgtgtctgtctccccttctgagtggatctcagtcatgaggctctaacaactgcagccagggttgggggcttcctgaatgctgagccctgtgggagaaggggtggccaggcctccaaggacctgggcactgccactgccttgctctgtgaccttgggaggtcacactcctccctgggtctcactctgttccttggcacaaggagggagatcaacatcaggactgcaaacccttgtcttcaagaccaggcaggcgcagagttgtgggaagtggacagtgtgaagagggcatggcagccagctgtctctgtggtgatgccagctcttacgaacctaaaagaagctggaaactgggttcttatgccaggccttctcaattttaaatgttggcaacaaatccacattaaagaaaaaaaaaacccggccgggtgcggtggctcacgcctgtaatcccagcactttgggaggctgaggcagatggctcgcttgagcccgggagttcaagaccaacctgggcaacatgacaagacccccatcgctacaaaacgtaaaagtaaaacaaaacaaaacccaacttattttgttagccaaacaaaatatgtctggccagattcagccttgggccaccagttttggaaccctggtcagtgctaggcagtccagtttcccaaggctgagcgtgctcctcacatcttccttctactgccctggtacccacagttcaacatctgtgccaacagcagcctccacgactacgccaagatcttccccatgaacaacgccaccgtggccgtggacatttaccagggggtgagcgcgggtgggtggggagggcgtgacccagagaggctccccgcctcgggcagggccaccggtcctaccacactcgtccctgcagggcgtgatcctgggctgcctgttcggccccgcggccctctacatctgggccataggtctcctggcggctgggcagagctccaccatgacgggcacctacgcgggacagttcgtgatggaggtagggcagggggcgggcccaggagggcaaggggtccaaggacagcaggcacactactgggggctagaactccgagccttgtgggtcctcttttcttttctttcttttcttcctttttttttgtttttgtttttgttgttgttgttgagacggagtctcgctcttgtcgcccaggctggagtgcagtggcgcgatctcggctcactgcaacctccccctcccaggttcaagcttctcctgcttcagcctcctcagtagctgggatttcaggcacctgccaccaggcctggctaatttttgtacttttagtagagacagggtttcgccatgttggccaggctagtcttgaactcttgacctcaagtgatccgcctgccttggcctcccaaagtgctggaattacaggtgtgaaccaccgcacccggccaatttttgtatttttagtagagacgcagttttgctgtgttggccaggctggtctcaaactcttgacctcgtgatccgcccgccttggactcctgaagtgctgggattataggcgtgagccactgcgtccggccttttcttttctttctttctttccttttttttgagacggcgtttcgctcttattgcccaggctggagtgcaatggcgcgatctccggctcaccgcaacctccacctcctgggttcaagcaattctcctgcctcagcctcctgaccagctgggattacaggccaccacacccagctaattttgtattttcagtaaagacggggtttctccatgttggtcagggtggtctcgaactcccagcctcaggtgatctgccctcctcagcctcccaaagtgctgggattacaggcgtgagccaccgcgcccggctctttctttcttttttgagacaggatttcactctgttgctcaggctggagtgcaatggcgccatcacagctcgctgcagcctcaacttcagcctcccgagtcattgggactacaggctcatgccaccacaccaggctaatttttaaaattatttgtagagatgtggtcttcctatgtttcccaggctggtctcgaactcctgggctcaagtgatcttcccgccttggcttcccaaagtgctgggattacagacgtgagccaccccactcagctttgtttccttcatgtagcccagagggcgacactataagccccattttacagatgagaaaacagatcctgacagatgaggtgacttgctggaagctgcagacccaggactaacagaagccttttccccaaaactgtttagtcttcagcaaccagctatgggatgggagctccccatttctccccacccatcccctcttgccacctagggacagagctgtcccagttcaacagtggaaaaacagagcatgcccccagggataaatcggttgagggactacagaggatctctcctctggaatccccagtcctgtctactcctcaccaaggagttcacccccaccccagggcttcctgaggctgcggtggtcacgcttcgcccgtgtcctcctcacccgctcctgcgccatcctgcccaccgtgctcgtggctgtcttccgggacctgagggacttgtcgggcctcaatgatctgctcaacgtgctgcagagcctgctggtgagatgcgccaaccccaccagccctgcccactgctgagcgaaacaggacctccagcaacccccacgctgagccttgcatgggcctgccaggccctgtcccaggcacatcttgcctacaaggcttccattgtccccacagccaccctggggggcaggagggtaggaatcaccattatccttcccccctcccaccccccagatggtctccctctgtcacctaggctggagtgcagtggttcaatcatggctcactgcagcctgccctccctgtctctagcaatcttcccacctcaggctcccgagtagcagggactataggtgcatgccatcacacccagctaatttttttttttttttttttgagacggagtttcactcttgttacccaggctagagtgcagtggtgagatcttggctcactgcaacctctgcctcccaggttcaagcgattcttctgcctcagcctcctaagtagctgagattacaagcgcccaccatcacacccagctaattttttgtatttttagtagagacagggtttcatcatgttggccaggctagtctcaaactcctgacctcaggtgatccacccgccttggcctcccaaagtgcaaggattacaggcatgagccactgaggcaggtctaatttttttttttttttaagtagagacaaaagctcattatgtttgttgcccaggctcattattccattttacagatgggaaaactgatgcactcagttaagttactagtggcagggcttggattcaaaccgaagcaacctggtgccagagcccccaaacactttctcctgctttggagcccacaacctgataaggcaggagacggggaagtaggctcagtgtggttagggcagttgagctcacacccacacagagggtgtcaagccacgcccatcttgcccccacccttgccatattctgaggcagaattcctcagcctaggctcctgctgctctccccagctcccgttcgccgtgctgcccatcctcacgttcaccagcatgcccaccctcatgcaggagtttgccaatggcctgtgagtaccccctttcccaagtgctggattgcatcaccacatttcatcctcacagccacccagaggtacgagctacaattctccccattatcccaatgaagccacagaggctgagagaggttaagggacttacccaggttcacacagctagcaagttgaggagccaagactggaatccagggaagagggctgtttctagagcctgagcgcctcactctcgcctcagactcagctcttgccaaatcccgccagtgtgtagcctggagggcccaggaggcaggaggtggggagggggtctgtctgctccaggtcccacagaccagagaagcggcctcagtgtatccccacccccagtgtgggcgctgggagatgaagaggagttgatgcaggtgggccagcagcaaccagccagtcctgagcctctctcgtgtcccccaggctgaacaaggtcgtcacctcttccatcatggtgctagtctgcgccatcaacctctacttcgtggtcagctatctgcccagcctgccccaccctgcctacttcggccttgcagccttgctggccgcagcctacctgggcctcagcacctacctggtacagtagggccaggggatgccttgggaatggatgagggaaggacaagaggcaaccaatggggagggtttggggggacacaatggggcttccccagaggtcttggcatctccccaattcatggttgcccctcccccaggtctggacctgttgccttgcccacggagccacctttctggcccacagctcccaccaccacttcctgtatgggctccttgaagaggaccagaaaggggagacctctggctaggcccacaccagggcctggctgggagtggcatgtatgacgtgactggcctgctggatgtggagggggcgcgtgcaggcagcaggatagagtgggacagttcctgagaccagccaacctgggggctttagggacctgctgtttcctagcgcagccatgtgattaccctctgggtctcagtgtcctcatctgtaaaatggagacaccaccacccttgccatggaggttaagcactttaacacagtgtctggcacttgggacaaaaacaaacaaacgaaaaacatttcaaaaggtatttattgagcacctgcaggcgtgacctgacagcccaagggtgggtggggtgagggcttgaggacttgggcgggacacaggctccaaactggagcttgaaatagtgtctgatgaatgttaaattatctatctatctatttatttatttatttgagacagggaaagggtctccctctgttgccaaggctggagtgcagtggcgcaatcttaactcattgcaacctccaccttctgggttcaagcgattctctttattcagccccgggagtggcgcgcgccaccacgcccagctaatttgtgtattttcagcagagacggggtttgccatgctggccaggctggtctcgaactgctggattcaagtgatccgcccatctccgtctcccaaagtgctgggaattacaggcgtgagccaccaaacccggcctgattaaagttaaataaatactagttcccttctcgtccaaaggagcagggaatgggaaccgggaaggcacgaagtctctaaagcatccagaagacccctacaccagggtctggtccgctcctattcgccgcagcctttctgttccgcctgcaacccattttccagacagtaaaacggcggcgcacttctttctccgtcaggcaccaggtcataaggaacccaagagtctgtgcctctgaggcccaaattatttgctgtttcctcaggggagccggcggccgcgactcccacgccgcgccgttaccgctccctctctgctgactgctccccctaggggcagagacggtcccgacgcccgccatcccgccccggcctcacccctccccgccaggcggaacgacgcggggaggcgggcgctcggggctcgcgccaggggccccagaatccttcggggagagtgggtgggaggaagctgtgtgggcggggagccccctctgccttagggagcggctgggcacccattcgccccattcaggggctgcactttatagacgttccctaggctgtttctaggctcccccaagtccctcctccagcctcgtcgggtccctcagaccccagcccaggacctgcggagggccgcagcgaggagaggccaacaggcctttccctagagttgaacctgggccgggtgttgcacctggaagaacccccgatttcctggggacccagcagggcaggcggcctggctccgcgctcaggtccggacgcttgtttatgagaagaatttcctctttcttaaaagggcaacgatgcgagtgggtccctcaaggagagaagagatgggaccggtctggtgcgacctgggcaagcgctgcagagggtacctgggcaagagggccgcccgcctcctctgggtttggcactggagaagatgggtccatgccagctgaaggaggagatggatgggggacgtttagcgaagaaaggcatctcccagatcctttagcctcctggaagtgcccccgttgtaccccctacacacccctcttggcattgagtgccagtcctctgccaggctctgtgttacaagttggggagggcggcaaagtcccgaattaaagatgtcagttctcaagga

SEQ ID NO: 1242 - DNA, 49872 bp, Homo sapiens
tttggttttatttctttttattcttgatgggcaaaaagcctcctttaaaaaacattattcttaagaaacctgggagagaaaaaaatgccagtgagaggaagacaaagaaaaattagaggcagtacattccatatttcagaactttagctttccagacagtccaattttgttttgtttacaaattcatcttgcagtacaaggtgaagccaaatggtacaaagtccacagaattgaaaagccattcatatttatcattcaattttttgatcttcaaatgttatgaattctccaaaaaggtaacagggaacagatatccctttggtctcactttatagacagggaaattaccaaaagaaaaatcttggctctaccatctctacttacagaaggtaaaacacttaacagagacagatttctgttggagttagactagatttcttttcacagcccttaatctcacgaggtgagaaggagtggaagttgccaagttgttggctaccagacccatcagtctgtttaactctggctaaaagcagagaataatgggcaagttaccaagtttcccccttcagctctggcgtgcattctgaaattgtggaagatcctcatgtaacacacacgctgcaacctgcatttgccacacagtccagggcatatagagcattgtgattcttcacagtccgcagagacaagaccaaaaatgaggactaaaaactaaaggtagctgagtttttcagatggattttcactctggcaaactcagtagttcactccctcccacccctcaaatcatttaagtaaaatgttcttccaataaacataaattgagctcttcctctgttatccatcacattctgccagttctttaaaactggaatatggtactaggtacagaaggctaaaggggtaggaaagccccaaatactataaagatgcacttataagcagtgtggggttatcaccactgtctacttactctcccattctaggacacagggtgaagagaccacctgggttccctctaaagccctgaacattaggaccactgaggaggaaatatttgtccttaaaaataaatgtaggttccctggattgttctctttggctgccacatttggagcctgagtggaggcccttcaaattaacactggttctgtagggactgcccagtcagggtgcaatgggatcagacacaggatcaaatcagccaggggcagaagggcatggtggccctacgggtagaatgcactgtattgttagttaactttctaaattgttctctatttagcttcagcctgagtcaggtctacaatggccactatttagaaaataatttaaatcagtgaggtaagcacgccgatttgaaatatatccaaacatcattaagcctctgggtcataaaacttggtccctgaactaacaggagtatcttactcattaatgactaggtttgttccaaacggcccctgctgacacacatgatccttttgtgtggcacaataaatctggtaatagcagaacaatagcatggcttttaaatagggtaattttataattccttaagatgctggtttgcttcttataatgtgttgtgtggattacagtacttagacaaggttcacatttactttaaaagacttctatattttaatgcaaatctaaggatcatcccctttcttagtttatagaagattcaaactttgtaaaacataaataacctagtactctaaacatctgaagccctttgtaatactcactgttttttcctaatttgaaaataacttatttatatatcaaacattagagcggagtgtaaacatggatgtcaatcacccttttagtttcataaatttgcttttagctttcatcaacaggcatattttcttaacctaccatgatctcaaatgagataaaatatccttcttcaaaaattgttaagaatatttattaaaaagtgcaattcaaaagttagctgggcaagcacatcattgcaaatcacaaaaaagggtgaaaaaaccaaaacccccaaataaaaccacatgaaatacaaacaaaacaaaacaaaaaggtttaaaaaaaaagtgtgctgaggaatgcacccaaaaagacaaggaaatgagaagtcaaagctagaactctatccagatgttgctgttctttccaagtgcaaaagaaggtggtgaggagagaccagcagcctccaccaccgagttctggctctgggtccaaatactactttaatatcagattattcatcagggaagttataaaaatatcctatatacatgtgcacatttgaggcattttaaaaagtcatcagaaggttaaagtttagtgtctcagcagtttcagctacttaaactcaattaaagcatctatcatttaaatttggattggctcagttatttgactgcagatgataaaatcaagctgtcatcttagggaaaaaaaagaaccaagtttacctacacatccttgccattacccacagagtaagagaagtctggcccagagctaaccttttatgtcattacgtttcttaataaatgtaataaatgtactaaccactcccaaccccaacccccagtgtagagtgccctaagagtaaaagaactgtaatgaggacaatctggtatccaaattcattcaagtgtgttactgagctgtttagcaacaacatatgtagcaatcaccctcaaaacgcaagctgcacctctggggaggaagccctggtacagcaacatcaagtcggcaaggatcaggagctgacctgtggcgacatcattaacccttccctaagctatgccaatgcagaaccctcttgctctttttaattgctcctgtcagttaaagccacaagttgttagcacccccaaaccccagggtgtttcattattttccattagttattcttaccacaaaaaaaaatgacctggaaaagcaattttatcttagcatttatccctgaaaaatgaaacactgcattttctgtcacaaactgtttctgagccttctgtcctcaataatcatcagctctcaggggataagaaatgctacagcaatgggaaacgaaacatacccagaagctcgtattcctgacaggtttctttagatgggacagcggtgcactgtctgagcacggggaagggtctgagcagaagaaaagagctgccaaagatgcatggaatgagcaacagcaaaacaccagtggagtctgtaagtccctcctcagcaaacgaggtcccggaaggcaaggcagcagctagttctcctccgaactggacaggcggcatggggcttctgttgtccagctgcagccaggagtgcagacatctatttcctcttcccactggcccttccagcgctgggatggaggagccatgtcaattgtggggtcacacggagaaaagtcagtgcagcagtatgtttccaggataggaatgtgagtagacggcaatgtcacacgtgctcagcttctcctcctcccctcggttcatatgcaggaggaactcgcacccagaggccccgccgtcacagcactaagaagaggatgagcacaaccaacaggactgcaaagaggatggctatggcacaccattggcgccgatctggaaggcaggacatggggattagctctcacagggactccacattccccaagatacagttatatggaatttatggcaccctttgaagcagaaaaggggcagaacgtgcaaatgacggggccatgatcttacacctgcctaggtgcctgatgctctaatgctgctctgttcttggcctgcacttcgcatgcagtcacaactttgccagtcccctgaaaatgtctcgtaataattacatgctttgtgtctcaagtctttaattaaaatctgcggatcttagctttctgctggtagttagcatatcctcaaaaaaggtgttggcaatggtgttacagatcaaagcctgcctgctttaatctcccataaaagtcaagtcatttaattaaacaataatcacattcttttctcaatgagcacaacgggaggagggaaaggagatgaaagctactgctggtcacttcaggaaatatacagctgaaaaagcaagctccagtgagacagcatgattaatttcacaccacacctagtcaagtaagattacttaactagtaactgtgttaaagtaccttgtacagctcctctgtaaatgaaagtggaattttttttctgaaactttctgccctaccaacaatttggaacagcaggcacaggaaacaacttgactagagtccatccaaatggctgagagcagggaggccctgtgagacagaagggcccagacaggccctgggggagccctgctgcagctcacaatcctgtggtcccaactctacaacagctgccccgcagggctgttgtgagaattaaacaacacaaccctgtcatacacacactgtgcaatacccaaacctagggcacagaggatgctgtcaacatcaggatgcttccttaatttggagacatgtagaaaaaatgagcagtccttccactgatgagttttggcatcttccacaaagggcccgactgataacagaattcactagcgtatgaaaatgcagtacaaccactaggaataagagttccatttaaatagaaatataaagacatattgattcactaaagtttctttgaaagcccactgattttagcacactatagttattgagaatcacgttgcaaaaagatctcaatctatgaaaataaactgctaaactctccacaaggcaaaacatgtacttaaaattattttaaatattatggatatcaaagtcttagaactggacaagagaactgccaccaaattataagtaaagcaagtaccttctaagtggtgatcaccttggtctacctcagacatactagaaactcatttagttaactctgagcaggacaaagaccccaggtccatcactcgttgttctcaggtaggactgttccaaaggtctagggaaggcagagatggcctactgcaggtcacactttgacctgtttaactattacttcaatggtcaagaaaacttttataactggcattctctcatctgattaaaaatgttaaatttttaatttccagccaagtatgtaagaagcttagaagtcatcactctgtcgtaacaagtaaaaagctgaacaaactgaaaaagcaaaactcttcttagatccatcagagaagtgaggtcacatggtaaactgctgcccctaaaactgcagaaacctacagatgcatacagagaatcacagcttatcagagcagaaacccacgaagcaacaaactccataggaaccagtgttctggtaggaaaaccttagctttaattgatgagtcgctgaaggctcagtgtggacaagtctgagatgaaaaacaaacaaacaaaaacactccaggtggacccaggcgaaggggacccccacacttctgtgggttttacctccaggagcttgaccaggttctcagcgaatattgggaaaaatcccctcatgcttccagcaggcggaggggaaaaagaatcactacgaaatactccagagcactctgttctaaacaaagtctgccctcaaaagaaactaaccagagtctgactaacctgggggaaggaaaatacccaactccagtcttctctagccatccagttccacctaacagtagaaaaactgggaagcactagtgaagttcacgggccaggggcacaggctcaccagaggctaagacctaatcacaggactagaaaatgccaccccccggcctcaccaccccatctatggtaaaggtctatttaccacagttccttttacccagtatatcatgtccacttttcaacaaaaaggtaaaaggcacactaaaggaaaaagcaacagtaggaagaaactgcatatgcatcagaaccagagtcagatacagcaggaatgttggaattatcagaagaggaatttttaaaactatgattaatatgctacaggctttaatggaaaaagtaaacaacatgcaagaacacatggataatgtaggcagagacatggaaattctagaatgaaaaaaatagagatcaaaaagactacacaaatgaagaatgcccctaatgggctcattagtaggctaaacacagctaaggaaaggatctctgagcttcacaatttgtcaacagaaacctgaaaaaagaaaaaaagactgaaaaaaaacctggcacagaatattccagaaatgtggaacaactataagacttaccataacatcaatcaagataatgtagtattaggaaaatagacaagcagatcaatggaacagacagtccagaaataggctgacataaatacagtcaactgatctttcacaaaggagcaagtgcaatacaacagagcaaagagagtcttttcaacaaatggtgctgaaacaactggacatccatgccaaaaaaatgaagttggaggcagactttacaccttaacaaaaattaactcaaaatgtatccacagacctaaatgtaaaatgcaaaattatcaaactcctggaagaaaacacaggagaaaacctagatgaccttgggtatggcaatgactttttagatgcaacaccaaagacactatatatccatgaaataaataattgaaattgggatgtcattaaaattaaaaacttatgctctgtgaagtcactgtcaaaagaatgagaagacaagccacagattggggtagaatatttgcaaaagattcatctgataaaggactgttgtccagaatgtattatacaaagaatttttaaaactcaccagtatgaaaactaacagcttgattttaaaaatgggcaaaagacctgaacagacacctcatcaaaaaagagatggggctgggcaaggtggctcacacctgtaatctcagcactttgagaagccatggcaggcagatcacttgaggttaggagttcaagaccagcctggccaacatggtgaaaccctgtctctactaaaaatacaaaaattagctgggcgtggtggcgcaggcctgtaatcccagctacttgaaaggctgaagcacaagaaccacttgagcctggaaggcaaaagttgcagtgagctgagatcgcacctctgcactctagcataggtgacagagtcagactctgtctcaaaaaaaaaaaaaaaaacaccatgaaagagctgccagggaagcatacgaaaagatgttcaacattagatgtcactggggaaaggcaaattaaaacaagaaacaatacacacctattagaatggtcaaaaccccaaacagtgacaacaccatatgctagcaaggatgtggagcaatattaactcctagtgggaattcaaactggtacagccactttggtagacaggttggcagtttcttacaaaacccaaacatactcttaccataaccattcagcaaccacataccttgttacttatccaaatgaacttaaaaacttatgtccatataaaaacctgcactttttttttttttttttttttttttttgagacagagtctccctctgtcacccaggctagagtgcagtggtgtgatctcggctcactgcaacctctgcctcctgggttcaagcgattctcctgcctcagcctcccaagtagctggggttataggcgcacgccaccacgcctggctaatttgcacatgggtgtttataacagctttattcatcattgccaaaacttggaagcaaccaaggcgtccttcagtaggtaaatggataaattgtggtacatccagacaatagaatattattcagtgttaaaacagaaataagctatcaagccatgaaaaagcacagtggaaacttagatgcacactgctaagtgagagaagccaatctgaaaaggatctgtgatatatgattccaaccatatgcaagctggaaaagcaaaactatggagacagtcaaaggatcagtagtttgggggttgggggaagggagggataaacaggtggaacacaggattttttagggcagtgaaacagctctgtgtgatgctacaatgatggatacatgtcatttatacatttgttcaaacccagagaatgtacaataccaagagtgaatcctaaggtaaacaacggtctttgcggatgattaatgatgtgttagcgtaggctgattgtaacaaacgtaccaccgtgatgcttgatgtcaatagtcagggaagttatgcatgggggaagggggctatatgggaactctctgtacttcctgctcaattttgctaggaacctaaaactgttctaaaaatagtttattaattttttaaaaagattaaaatgcttacaataatttaaaaccactttgctaaaatgattagttgcgattctttcaggacaaaaacggagaaagtattccttctccaaccccgccctcaacctcacacactcctatgtttacccccttccctcaggcatctcgctattctcagcaccagatttccaacactgaaccagatttccattttttggctttccatcagcctctactcatgcctcctaccaccctccaatcaccttctcttccacaactgtattaagtaggaattttcaccaaggagaagcatataccacacaagccagcacaacccgaggatgttcttttaaagccgttttcctctgaagtggctaagctgcctctacgaagcatgaactaggtaaccccagggagctgttaccccagcagacttctcagcacttcccgcagaggcttcatgcatagaaggaacgggtactaaccacaggggctcttgtgacctcaagtggaaagttttaagcagcattgcaagctcaggacctgcctcaaaaagtcagagcggaacaaaagaactccaatggtagttttttctctctctcaaaatatttttctcccctaaagagaaaagattaatggaatgttggaaagtaagagggaaaaaaatctcagtatctacttaaaataaaatacttctgtgggtaggagaatacaattagtgtctctcttgggtcattcaaaaaagtaaatgtggagtcttggttggtttctccccatgaagcagacagccacggggagcggagatggtccgcctgtgtgcctgtaactacttaatcacacttcgctgtgcctccataggcttcctttatgtacaggtttgattactaaagcagtgaacttctgcaaaaattatggaggagagcagagacgaatacaaattgcttgtttgtcaaattgaagcagaaagcaccaagcaggaagaggtccttagggagtatttctttgggtagcaagcaaagattaaaatgaaaacacaagcaacctgtcaaaagtgaagcaccgttcaggataaatgctctgtttcctggctctttttcctatacaaatataaccaaagttattacattgcttccccaatttttcttttgggaaaaagtagaataaagcataagcaaacttcagtgctatttatacacactgggtcgcttctcacaatgcaagtacttttctaaattattcatacccagaatgctgggaaacaaagacagtgcatctttgttcacttgctcttccccaaacagaactggtgctgaagtagctacttgactttgcaactactacatacatgagtgagaggcctggagtttaaactggttatacaattcttcattaaaacaccttttttttgtttattgttttgtttttaagtagaggggagaaggcagaagagagaacagagggaatcagaaaagactttgcaaacctttctctaaatgtgtgacagatgaactaagctggtgcctgcttcccatatatgcacagtttcaggcaatgaagagcccgctagaaacaaagatacttgtccctaaagagaaagaagaaaatgactctagataggagcttctctttgttttggatgtaataggtccattgcgccttggggccattacaatttttgttgccttacaatttcttaaaaacatttactaagtaccaataaataaatggtaaacgcagttaagcacttctactttactggtatttcatttaatcctcacaattacctggagaggtaggactcaacatatttttacagataagaaactgagccccagagaactgttatgtaacctatgagttaaacttctgaaaagtaaacctgcatatgtatttaaatattgcttcaaaaagctaacctattagaccttataacatgtacctgacagtaggaaaccaacagaagaaaaggtgtcaagaaacagggcatgttctaacacaagggaggtgctctacagtcagggaacattcagattacctcaaggagcatctcagtttctccttccaccaagcaacccccaccagataaagaagagatactggattttttaaaatttaaaatatattatttcccatgtaaagagtcactggaacatatcttatacagtaactattatgaaaattgtttattcatcctcatcctggtgcaaatttgctgaaatatttcagtattgatttaaacataacaatttaaaatagatccacacatgccatcttattctgaagtagtaggtatttttctatcaatgaaagaatgttcaggagaaacagtaactggcttaactgttgttttacataagttccctattttggcaaggaaatcttaaaaaaccagtaaaataaagaaggattttgtaactgcaaagaaagttattctactgggctgggcgcggtggctcacgcctgtaatcccagcactttgggaggccgaggcgggcagatcacgaggtcaggagatcgagaccatcctggctaacacggtgaaactccatctctactaaaaatacaaaaaattagctgggcatggtggcgggcgcctgtagtcccagctacttgggaggctgaggcaggagaatggcgtgaacctgggaggtagagcttgcagtgagccgagattacgccactgcactccagcctgggcaacagagtgaggctccatctcaaaaaaaaaaaaaaaaaaaaaaaaaaacacaacgaaagtgactctactgggaaaaaaaccaaacacggtgggggatcacaaagccttaacttttcccaagttaaagctacaaggagaagataaagactgcacatacaagtcttccattctctgattctaaggcatcacaaaaaaaaaaaatgtgccataagaaagggatcagctaggcacggtggctcacgcctataatctcagcattttgggaagctgacacgggcggatcacctgaggtcaggagttcgagactagcctagccaacatggtgaaaccatgtctctactaaaaatacaaaaattagctgggtgtggtggcacgcacctgtaatcccagctactcaggaggtcaaggcatgagaatcgcttgaacccaggaggcagtggaggttgcagttagctgagatggcaccactgcactccagcctgggtgaaagagtgagactctgtctcaaaaaaaagagaaagggatctgtaaaaaataagaaagggatctggatgggcataactatgagacaacacccccaagacagagttctagaattaagtacaaatgcttaagctttaaacgccatacataccactggtcatatgagatacttttgcaagtttcttcatcacattgtccagccgggactgagtgctctccaattcgtgagagaaatcttccaacatactagagagaagcagacacagaaggtcgctggtaagcacaaagccttggcagtgcacttgcactgggttaaaaggaccaggcctccattttagcaaacaaaataggcaacactgggtttcaggacctcactctgttatccaaaatccttgggacaagataggattttgattttggaattctcaggattaaaaaaagcctaaattacatatcctttgtattagtcgacaccactaggaggacaccaccaggagggtctggggcagtccccgtaatcagatacttaatatttctgcagagaaaactatgaggaatcacagttggagtcagttcaggtaaggtttttctgtaacatgagcttgcggcaaatttaaagaaaaaaaaaacaacgagatttctttagagcttcctagatttcagaactgcaagactatagacctgtctatacaataacacaaactcagtggcagtgcaatgtggtagaaacaatgctatctgaggcagacaaccaggctttgccacttgtttacattgctaccttcgacaacatactctataactctttgggactgtttcctcacctgtaaaatagggcaatcctatcagctcaacttccctcacagggctcttgtgagaaccaggtaataaacaaaagcactttatgtcaatatgagttaaggaatgtactttaataaaataacctcctataaggcactacgtgctttattataaacccagaaggcctcaggactaacatccctgatggggtgtgtgacagtgtgtctgtgcatgcacacgcgcatttccccatctgtcctcacagagaaaccagtatttcccactaggaaaactgactccagcaggcttacactatttgctgtccaatgtgcagctgggaaagaaaaccccaaaatactatttcagcagtgcctatttcataagtcactaaatattccagacttttcaacttttgattagtaaatgattattctgaggctagaatgtaatatgccaattagtactaacagtcttactaaaaaggctgtattaactctgacagcatcaatggcagttagaaactcctggtcttgatctgtgcccacaatagacacctgacagccttgcaggattcagggcaaccaactcttcattaaatcaactgttacatatatgttgacaactaaaataagtctttgtcccttacctaaattttcaaattaaaaaatatttaactcattttagatcctggcagcatcttggcgctgcagctggcaggcctatccaggcagggccaaactctaaaaagcaagagctacctttctgcgctaggtatgacttttcatactgaagacaaaacaggcacatcatcaggcacatcatccgaccttcagtccatggacactcaccaaccaagttgctagcccaaatctatctcagtaccatccaacaaaaatatgagtcacatatgccattttacattttctagtagccatgtttgtaaaaatttcaaaagaaacaggtgaaattaattctgttgtatttagtttaatatagccaaaatactgtaatttcaacatgtaatataaaaattattaataagctattttatatttttctatatgaagtcttcaaaatccagtaagcattttacctctggagcacatctcaattcagactggccacataacacttactcaacagccacatgtggctagtagctattatactggatggcacaggtctaagtccaaatcccatgctttttcccatttatctgttatttctatttttttagagacagggtctcctctgtcacccaggttggagtacagtggtgccatcatagctcactgcagcctcaaacacctgggctcaaacaatcctcccacctcagcctccttccctagtacttgggactacaggtgtgaaccaccatgcccagcggtttcatgcccttaaaaacaaacccctttactattgttctagtgagctgtggagagggagtggaggtaggggtgtgtcaatgcaccatctttaactggaagtccctctgactctattacccactgcccagccaggctgcctcatcaacagagaagctcaggccattagtcctttcccctcctcaaactgaactttagggtcaggacccattttagatagacatgaaacagattctggctactccagcttcctacctggtctccctacctgactccactgcagcacatcatctaaatcacacctgatcacaccatcactcctcacctcacctccactggtctctcattatgctgagaataagtagtcgtacctccttaccatgctgacaaggccttccctggtttgttctctgcctccagacacatggaacctctctgctccatgcacgtgtgcacctctccatcttcacaggtgcattttcttcctcctggtctacacaccccacaccacctgcctccacaccaactctcacctcacctggctagcatccacacatccttcagatttcagttaaacccctcttcctcagggaccttgggctaagtcagggctctccaggcagcatgcactggccccatcacaggggccctcccacttcactgccatcacctaatgacccctcgccacttacccaatatccgttctaccctgcaagcggcaaactctttggcagagatgggttgtcttgtctgctctgttcccttctatatcccttggcttccagaaggcccggtgtagaacacgggcccactaagaattcataatcaatcaatgtgtcatgataaacgtaatatcgagacaggaaagtttctgaaatatcctggtggactgttttttcatttttctctttcaaaagatttacaaaatgatgtggcagcatttaagaatgcagtttttgccatcgaacttctgggtgcaaaagggattgttcataaggaaaaacaaactgaggttatgttttgtttttatttatttttctgagaggaaagagtttttattaactggcgttaaatttgtaagttttttttaaaaaaaaaaaacaaagttacaataatttaagattcaaagcaaaacgtgtctgttcaatatagcaggagagtcatgggatgataaagtcagctcatgtcctatcctctctggaacaaaaattcccacaggttacagaggcttctctgtttcatattcccattcataactatacttcgagtatctgctcagagacatctgtgtctgtttttggaggtgtttaaaaataataacaacttcacctaaagcctgtagtaaaatttacgaagtagaattgcttcttttggggaggctaatctgtaaaacagaataaaaatgcagctatgaataaaatagcttttgattttaccagccacgtagctgccaggctttttaggggtgtcataggatggctctgcccctcaatttcactgaagcgagaggggtgtctcaatactcacactgcctgttcctccagctcccctccgatgcgctgggacatgttcttcagcaccccgatgctgccagagaccagctccaactgctcatcctgctgttccacgatcaactggtgccagagaaatgggaaataagcaattaaaatccatcttacctggttccaagcccagcactctagcagctgctagtttctttgccaacttgggacaattcacattcagaagcaaagcccagaaatcaaaggaccagaccgttgcctctgagaacacactgctcaaaaggctggattgttaagctactgatatctcctgctgatccaacttgtgaacagtcagcggggcttgaaaccaccaagagagatttactctggttggctgacgtccaataatggagcagacaatggttgaaagcacacgtgcagatgaccattgagacatggggatgtttgggaggaggaagcccattgccaagatcaaggtctcaatccacaacagactgccacagcttaaatacaagagagtctggcaaatctctggatgtggggaaactatgcagtctttcctctctcttcaaggacaaacgaaaggattccctgtggcaataagttacctcaaggacaactactgactgacaaatatttacttttagttgtgttgcattcttctcactttctatagaaaaaaaatttcctgggtttaatagcaatttaagtagacaactggttaagcagacatactaatgtaaagaacaaaagaacatataaactacatgtatacataaaacacaatatttaagaatcaatagtttcaatgggtacatgctcctcaaatccccagacacattatcattagcttgcttttattaatacagctacatatcaaaggcatcaacagacataatcaatttcattttccttctaccccttaacctacacaaaagcagtcatctttacatataacaaaaccaaccaataggccgggcgcggtggctcatgcctgtaatcctagtactttgggaggctgagtcaggtggattgcctgagctcaagagttcgagaccagcctgagaaacaaggtgaaaccccgtctctactaaaatacaaaaaaaaaattagctgggcgtggtggcgtgcacctgtagtcccagctactcaggaggctgaggcaggagaactgcttgaactcgggaggcggaggttgccgtgagccgagatggtgccactgcactccagcctgggtgacagagtgagactccgtctcacaaaaaaaaaaaaaaaaaagaaaccaatcaataattttcgaagaaaaaaatgagagatctttctgaaagtgtctttgctgagatggacaaaggtctgttttttctaagagaactaactgagcttggttctttatttttttagagaaagggtcttgctctgtcacccaggctagaatgcaatggcatgatcgaagctcactgtagccttgaactcctgggctcaaggatcctccagcctcagcctcctcagtagctaggactaaaggtgtgagccaccacgcctggctgagcttggttctcttgaagcagtcacactgtgaagattttgaaaccctttacatatgcaattattaaacacaatcaacacaggacaagctctggcttaccctccttgtcactaagccacaagaccccatggctggcaaaggaactaagggggtgtcttgtttcccactggcccgtcctaagtctggggtccttggggtacctgctgctgtgcctgctgctcctcaatgaaatgagaattggctctctggagctctcggtccagacgcccatatttatctgttgttccagtgctccagttctggctgccactgtctcccagcagtgcctgtgtgagaagaacaaccagaggagtcaggagaaacaaacaattactatctctgaacaagtgatgcatcaagagtgatataaagagttttcacatttcttgtctattttcccctgggcaaggcttttatgtagtggtgtaggttggtgcctgggtggtactatttaaggaattccaggaagggccctctatgtctttaagctctcccaataggcctcacaatgggctttgtccccttaaagtgcaaataaacgtctgctaaatcaacaaacacccatctatatactgtgttataattgaaaagcattcaatctcttgtaaaagagctcttcctggtacctgtggaacttcagcaacccataggttccagtcaacctgattccgaagatctagagtacttttttaaaaaaagtgtgacccaggggaagttgtgggtttttttggtggggggaaagggagagttccctggaatgacaagaaggtaagccatagcccttcacacacaaaggcacaagaaccatcaatgtctgttaagtttaacccatgaatagaatccagggtccttcaggctttccagatgacaactgggggttactttacaggcaggtatgaccacaaggaatgcctgaccctggcaaccgaggcaagggctgccctaaagtcagagttctccaccagggctcccagacacaagggtcgggtttcccaagtatgaattcaaggaagtttgcagccataaatgggtatgtcttcctcacatgaagaagacaggcaggaatgtgagagttccatctcagcagttggttctgaccagatccccacaagccttcctgactggtcaaagtaactgctcacaccagccccgcaggcaagagccagaagacgctagcaactaagactctttttccttgtagagttgccaaattttcctatcgggtaatttaaaaaaaatctcaggcactattaaaagcctgcctggttacttggttctgtctgaaaacccttccaacagccccatgaccttcctccatactgacactgacctcttctcagactgcgaggggtgaactccatcaaatggccagacttcaggggctaggatcagggaagctcagttattagaagcttttcttacaagagcttccaggggcccagagcttcagtccagctggatggtgactgtctctggtgtaaagcagatccaaggctttttgtgggtggctctgccctgacctggtcttagggctatcaagactgaaaagatcctgctcattatgatccacactctaaggacctctatggaagacatgaggaaatagtgacaatttttttagggtcagaaaaatgctataatgcatcactggcctaaggacagagaactgggacaccaccagggccttgtgtgctcctgaggtcacagggctatttttcctacgttttccatggtgtacacttaggtagagctaagtatagggcaaatcatccacgttttattgtgaaatagcttaaagttcatcagtctgatcccaaatgtttgtgataataggatagagattgagagagggcccaaggactggaagatgcacctgtgtgtgggtgccagagcaggggtgctggtgaggcaaggagcagcacagagcctggcacctggcacaacgtggcaaggcccatgcctgctggagtgcttagagagccctgatcctgctattccttgaaaatttgcaacttgacatttcactcatagcctaaaacaaaattccaagccataactagataggcaatatataaatacatacatgtatatatactttatataaaatatatttaaatttatatatatatatttataaatatataaatataaattttatttacgttagcccaactatactatctagagaataaaacattcaaattaagagtaacagcataggtgttactgacctcactgtcacaactacttcagttacttccacttcctataagctcaagtgcaaatgagaagagaactccaaaactagccaacttgagggcattcactagcttctttcaagagagggagccagatggaatggaccagctagtggcttttcctagctatattgctcaaaaagaaagcaaaggaggcaaataagattaaaaagccaaaaacaaaacaatgacttgaaaaatggaatgcaagaaaaggaaacaggaaaattaagttaggtgatatttatagaaccctgccccttcttcaagcttccataatatttgttttcaaaattaagtgtcttgacaaatacccacaggtatgaagtactgattgctagttagtataaatagtgaaatttctcaagagcctactaaatggacaattcataactttctggaatcttaataaaatgagactaaggtaagtcatttaaagcaaatagtatcatttttcatgaagtcttttttacttctaaggaaaatggatatccacagaatttaaaaaactacttctgtcaaaaaaattacctaacagtttagcaacaggcaaaaacattctatcccaccaaaaaaagtctaaatcaaatctcaatctaaatgaaagtccaaattctagatgatcattctacattttttaaaaggactgtattttaacaattagaaaggagcttctatcaatatgccaaagtatgtaattcttttaaaactacttaaaacaaagagaaacttaatttaacacacaagtttaaggttcctctaatgtctttacatcaaatgtcaatccttagatgtctaatgtgttccatgggtaggcaatgtagtaactgctagagagctcaaaacaaacaaacaaacaagaaacaaaaaaccatgacacacatctctcctcactgtcaaagggcctggagcccagcagagagaaagacagtaattatagcccttcaaagagcctggcacacaaaatgtgttcaataggtacagaataaacacattaaaaaagtaaaagtactctgtgataagtgctatagtaagggtaggcaaaaggtgctatggagcccagagaagaagaccagagggtaagaggaggggagggaaatgttgacagggtgctgggacaggctgcctggactgtcacaaaacctcccatggtcacaccagggcctgcaagcagaagtcttcctcttgattacatgatccatggatggtcagcatttttaaattccaaatatctaactgtatgctttctgtcattgataattatattctgatgttttctcacctgtctattttttctttcagctaatgcctgcacagatgaagttgacatctgatctttcatgtcctaatgagaaagaagatacgaaaacaaatgaaaaatatccttaaacaaaatcacagttaacatttcatacattagcaaaacacacaatttattattactttttaaaaagaagaccgcatttcttggctttattttcagtctcaaaaataaagaaaataaaataaaaagaaagatggtcccttaaaaagaagtaacctggatactaatttgaataggaggaaagagaaaggaattaacatttaccaggtacctaccacaggtcagaaacagtgctaaacacatacacacattatcactgaattttcacaaggaccctgtgaagctggtactatttccattttaaggttgaggagacctaggtccaaaaagacgatgatactttctcaaagtcacatcactaataaagaacatccctggggtacaaacacaaaagcacgtgttcaagggcttgcatcttttttacaatatatgtaaaaaaccatgtgcttttagtataaagtatatttaccattaaacaccaaagaatacttccaaatagtggtacaacaggtcacttattttatttctgagttggattcatgaaaggtatagactattcctaacatcagagtgaatttccagagtggtgtcaaaaataattttgtatggaatgaaaagtgaatagatccattactttatctgaagcaaaacactttattaaatatgagtcattctgcttatttagctacaatccaatctactatagaatgatttgaactgaatacatgactgcaacaacagtttttaaaaggtcgtcaaaatataatttatgcaaacatcaaagtgtaagacttttagaaacttctttaaagacccatgacaagtaaacagatgagacagtgccaccgcttttacaatcccagaactgtggtaaatgtgagtgagaaccacctgattcaactttcaaaccactcatctatccatttagcaaacactcactgatgtctactatgtggccaggcatacagcagtgaatgatactagctaggcccctgcccacatggagttcacatcatgatgacatgcctgagtcagtcacgtgagtgttgttaaagatgcagttcccctggatgtcactatgctcagtgaaataagccaggcacagaaagacaaatactgcatgttctcactcataagtggatgagatttcactcacggtggatttcatgaagacaaagaatagataggtggttacctgaggccagaagagtgcagggggaaaggaggatgaagagaggttgattaatgggtaaaaaatacagttagaagaaataagacctagtgctcaatagatcagtagggtgactatagttcaacaataatctatcgtatatttcaaaatagcaagaagagaataattcaaatgtttgcagcataaatgtttaaaatgatggatattccaattaccttcatttgatcattacgcattatatacatgtatcaaaatatcacatgtaccctaaaaatatgcacaaccatatgtatcaagaaatttaaaaaaaaatttttttttttttttgagacagtctcactctgtcaccaggctggaatgcagtgacgtaatctcggctcactgcaacctccgcctcctgggttcaagtgattctcctgcctcagcctcctgaatagctgggactacaggcacgcaccaccacacccagctcattttcctatttttagtagagacagggtttcagtatgttggccaggatggtctcgatctcttgatcttgtgatctgcccacctcggccgcccaaagtgctgggattacaggcatgagccaccatgcctggcctaaaaatattttttaaatgtagttccctaggcccctatgagacctacgaagtcagactcttgacggcacatttttaacaagccccctccccatccccattccttgtcttacaatggaaatctagaagccttcaagagaaactgatcactatgctagtatctcctggactgcaggattcgttttctgattatcaatcagagtttaagatgacattctgacagtcaatccaacagcccgatttatttaatattattaaaaactacgcagagcaacattcactagggggataatacatgcctttaaaaatatactcagctgggcactatggcttgcgcctatagtcccagcactttgggaagccaaggcagtcggaacgcttgaggccaggagttgcagaccagcctgggcaacatagcaaaaccccatctctacaaaattaataaaataaaaatatagtcagtgcattttataatagtgtttttttaaaacaacacattacttgcataataaaaatatcaacatgcaagtatgggaaagtgacatgttagcctttgaacattacatgtacaacatacttttgctgttagaagtcagtgcagtggggggtagagacattggctaaaaaggagcacaggcaccttctgggggtgctggtaacaccctgcaatgcttctgggtgctgttgacatggctgtgttcagtttataaatttattaagctatatgtttaggttaattacacttttctgtaccgttatattttagtaaatatatgtatttttaatactactggtcccaaacaatggctggatggtaaactagaacagcactttgaaaataaatttgtcattctgtaccatgagtctcaaaatattcactgccttgacccagtaattccactaacaggaatttattttaaggagataacataaaatagatacaaaaaaagacatgcagagatgtgtactgcagtattatttataataagaaaaaaagtagaaataagcagcaagcccaaataagggaacagcaacacaatccacacaatgcagtattatatactaggcattatgtactaggcattgtgcttatgaagagagttcagtgaacagacaattcacaaaaaccccacaaatgatcaaacatgaatagatgcaataacccactggtaatcaaagaagtgtagctaagagacattttctccaattagaccaagaaagatgaaaaagattgataatacttagtgaaggtatattctgatactctatcagaaatatgactgataaggtctttttgtaggatactttgaaaacaatttttttttttttgagacaggatttcactctgatgcccaggcatcatcagtacggtggtgccatcacagctcactgcagcctcaacctctcaggctcaaacaatcctcccacctcagcctcccaagtagctgggactacaggcacgtgccaccatgcctatttattttttaaatttttggtagagatgaggtctcactatgttgcccaagctggtcttgaactcctgaattcaactgatcttcctgctttggcctcccaaagtcctaggattacaggcatgagccatcatgactggcaatgaatatttaaaatgtgtattctcattgaattttttacgaaacaattatgtaagttatgctcacaaagatggtcactgaagcatggtttgcaatttccactaataaacaataaccaaaatatctactggtaggtcaatgattaaataaatcataacagagccacattaaaggagagggaaacagcatgatctttcatgtcaaagacctaggtttaagacttagttatgctttttaatagctgcactaagtttctatttcttctgtacatttagaataatatcttttagaatcattgtagggattaatagaggtaacacatgaagcctgattaacagtagccaacaatatagtaagcactcaataaacattatcagcaaataaacgtatgcaactattaaaaaggatagtctgctcctgggtaatacaggacccactagctactgagcacttaaaatgtggtcagtgcaaccgaggaactgaattttactttaattaattgatactcagttattagaaaactttgaagtatgtctagaaaaaattgggtttgtgactctactttttcaattgtaagttctgtaaactctaaatacagatcaagtatttccaatgaaaatttcacatctgaattgagatatgcttgagtgtaaaatacatgccagatttattacaaaaacagtttaaaaaatttaaatctctcattaatatctcttatattgactacatatttaaatgatcatgttttggatatatcaggttaaataaaatatattaagctcacctatttttactcttttaatgtggcaactagaaaactaaaaatgaccaagaggttcccattttattactactgaacagcacttctctagatttatctgtgtcattgtaagactatgtccacaatgtaatttttcatagaaaaaaagttacagattatcatgccactgctttttaaaagtttgcatatttcaatgtccataaaatggctgtgaaaaataaaattgttgacactaattatttctagggagtgaaattggagaacgaagaggcattttctcttcaaagttttttcatcaggattatttgcattttataaataccaagtacagattatttttaacctaagaaaataaaatgctatgattgcataacagtatgatcacaactatgtaaaaatacaactgccctgcattgggaggaaaattatgaagaaaatgcaaagtcttgtgctatgtattattctgagtttagattccttttcctacttttacttcttgaaaattttctctaattttctttgagcttgcattatcataattaaatgtgtattctaaagttgcagtttttaaagttttatgcttaataaaaaccatgtggggttatgtgtgtgcctgcatgggtgttagccctgatgaggcagattcctccaatagccctgtgggtaggcatcctgtatgtgaccaccaccaccgcgggtaaggatctaaggatctatggctttcacttcttttttttttcttttttcttttgaggagtctcactctgtctcacaggctggagtgcagtggcacaatctcagttcactgcaacctctgtctccggttcaaacaattctcccacctctgtctcccaagtagctgggactataggcagctgccaccacacccagctaatttttgtatttttagtagagacagagtttcaccatgttggccagggtggtctcaaactcctgccctcaagtgatctgcccgcctcagcctcccaaagtgctgggattataggcatgagccaccacaccccgccagctttcacttctaagatggcactttatccatgtaggtcaaaagttagcagataccacacaacaccttcatattggaattcgggatcttaaactatgttactaaatagttttaaacattttataacaatctatcatgccaaaaacataattactcatcttctttctaacacatgacgtttagaaccagcagtcaagcaacaagtcccaataaaatatggttcatctgccaaaggaacaacaaatgtcctggttatttatgcttctgttcccatttcacactgtcttccaagctgaatgaatgagacatcataaaccccagtgcttcccactcataattcttacatttcaaggtcatctgtgctcacactggatacttcaccctttttgattaaccaaagccatttccatcttgacttacaattgactgtaaacaattcttacattggagcaggttcggttttttcatggagagggtaatagttctaacttttaaagtcagagaatgttagtgaggattatttcatagataaaactgagatccagggaggttgaatgacttaccatggttaagatttattaaggtcacagcttagcctagaactcaggttcccttaccccttatattcaccattattctgccatatactgcaaaacctcttgatcctaaagtaaaaccaaagtcacttctaggatatatttctaaaacacaaaaatttcacatgtggaatctttgatgtataggtgactccacaagagtaaaaatgattacctcaaaaatatgaaagctatttacacaaaaatgtgagtattttggttcttcactaaaaactgccagcaaaactggatttgtacagacttaaaagatgcttggaaaaacatacacaaaactctaaacaaggaaagcttactaaaggcataaccaatggacattaatcaagaagaaacaggcgatttacttcttcaggttgaagcaaataaagaaaaaaaaaaccacaaaatgcatagagtatcactgactcccctgcctacaaaagagaaagcataagtagaatacactgtttgaaagataaagtcaatcaaaattttggagcaatattaaatgaaagcccactagtaatagtaacagaagaactaacataaatttgtacaaattcctaatttgaacttcatttcatctcattttccaaatctgctaaccctctgctccctctctatcgagctcttccacccagaacccagaaatctctacatacaaacactgtttagctaaatgtggtaatgtggaattatacaaggtatattttatttttaatcgagttagcaccattgctatttcctcctcttctataggactttcaactagaatttattacaatcagatcagcaaaagctcagttaggtactgttagcctaccactggtaaatactaacagcttcccccaaaggggtcataaatttaaacaagaatgatttaaaaccctaaaatattcaggtggatcacatagttgagtatggtttagatctcaactctaaaaggacagtaagattttgaagtactgacttgatttggaatacctctcattactctgttctcacattgctataaagaactgcccgagactgggtaatttataagagaaagaggtttaattgactcacagttcagcatggctggggaagcctcaggaaacttacaatcatggcagaaggagaagcaaggcaacttcttcacaaggcagcagggaagagtgacagagcaaagtgggaagagccccttataaaaccatcagctatcatgagactcactcactatcatgagaacagcatgtgggaaactgcccccatgattcaattacctccacctggtctctcctttgacacatggggattatggggattacaattcaagatgagattttgggtggggaaacagctaaatcatatcaacctctttctaagaatgtactttaaaaagcttttcagatattagaaaatgaactttggattcttctttccattataccaatgaacttaatttttaatatacgaacctctaaatttcaatttgcaaacttcctaagtctaccttgcagaaataaatataatgattaaggttaaggacatatgcttcactgcaaggccccacttaaatattaacgtctataggagtatccttcaaaaaacctactactacaaaaaaaaaaaaaaaaaagcttatacaaaataattggggatttacttatcttacaaaaaatatgtcacctaacaacaaggcttcctcatcagaacagtattttgaactggctagaaattaagaatgtccaatccaaacactcactgtggatggggcatctgaggtccagaaaggtttctccctcattaaaatgtgggtttatctataaacaatttacgtatatgtatatagaaaggcaactaatgaataaaacaagtaacaagaatatataaagttcagtgataatctaccatttgaaataatttcaaaaggaaatcacatgatataaagactttggcaaacacaaactaaggttcctgcctaagatgactcttaaaaagccgtatgttagcactggtatgatcccaagtctttttattcaaggaagctgctttctagtacatatgttaaagacagctggttctcttacatctagttatgctaatcaaatggcttagccatatagtttcaaaatatgaaacattttaatgacacaagattgtacttaatattttttctcagattctttaataatgggtattattctaaataacttagaactaaagatttgttcacttggatcaattttttacactctgatagatgcttgtttgctctggataactctggaacggctgtcaagtagttacatatggaaatgtcagtatcttgggttgcaagagttccagaagcaattcagatggcggaagaggccgctatccaaacccactaagagtcactcttcaacaatgcgaagtgattaccaatcaatcaaaaaaccaaatggtttctacaatagcaattgttttgttcgtcaagaaatagagtacactaagaaataaaaagtgagaaagataactagcttgaagaaactagaggtatggacaagggtctaatcattcaggatgacaccatttgaatgtaccctgcccaaagccagcagattactgtctcatttttgctctcggaaataagcctgacaggctgggcatggtggctcacgccagtaatcccagtactttgagaggctgaggcaggcaaactacttgagttcaggagttcaagaccagcctgagcaacatggtgaaccctgtctctacaaaaaattagcctggtgtggtggtgcacgcctgtagtcccagctatttgggaggcagaggttgtagtcagccaagatcatgccactacatttcagcctggtcaacacagtgagaccttgtgtcaaaaaaagaaagattaaaaacagatttctttttcttcaatcacggaaatttttttttttttttaaggtacagtgacgtgatcatagctctcagcctcaacctgatcctcccacctcagcctcccatcttggtcttccatgtagttgagacaacaggtgtgcaccaccatgcccagctaatttttatattttttttttgtagagacagggtttcatcatgttgcccggactggtttcaaacccctgggctcaagtgatccacccacctccacctcccaaagtgctgagattacaggcatgagccaccatgcgcagccaatcagagaaattatatatggggaagctcacatttaattcatatttaaaaagtggtttcagaggtgacctattagtttacaattaagggaaagagctctaagaagtctggctatttcttatacagataacacaataagatcatattccttaccctgacaacttgccgagtacttgtaatgaaggcttttcttatactcaattcagttgcatcaaggttaaattttctaggatttgcttcaactatgcgtaggtcaaaaagtcaaggtaaaacaatttcatcatcaaagcctgacaacatcctgttaactcactgaatctctcacatgcaaacaaataaaatctggctcaaactttctgaaaacacagtcagctggacaccaatcattctcagacttcctctgcccacagccacaggagggaggatccctttgctccaagacagagatgatctgtctggttaggaagcatagcccctgctgatgagcttcactgcaaacacttagggctatctgaccacaggtgagctgggctcttcctgtttgccaacacttgtgtctatccttttttgactcctgatcacctttactaagacagcttttgcaagcctttttctcctgccattccaaaccacttcccattatgccaagatgctaaccctacttcttaatctagagagatcgggccttcttcagagaagctgccctcattcccttaccctctagcctggtccgacgcaccatgtcagacacttgcatagctctctatacttctcgttcatagtctgcaggtatctatttgtgttattacttgattaccatctgtcccccatccctatccactcaaagttctgtgagggctggtatagtgtttattaatctaatctctgtaaccaacaaaatgcctggcacatagtatactcaataaacacttgctggttgaatgatgagtatctattaaaacttttgtttttttaatctcacattttctctatctcccctaactttttttccttccctcctttctcaagggaagaattatctccctgtaactgtgcttttgatcctgccccctcacatatttgccactaattttagagaacatacttgccttttaataatgtaaaaggtaccagggtcatcatgaataacaaaaattatttactccatgtatcaactgcatacgaacctgtgctaactataaggtgatcctgacagaagctggtttccttatgttttatctcacttagggaaaaaacaaaacagaactcagaacatgcaagtggcatatcttccatctaaagttttggttaagtgggatttccagttggaaaaaaaggctatataatgaagtttttacagttctccagtgcatgagtcagatcagtggacttacttcacatcaataccatgaattagcagagcagatctgcttttactaaatgcagtttcatggaacaagacatctcttcaatggacggtagcactgtaacatcacttcttaaacatgaagacagtctacaaaaagattttttgatctctaattaccgaagtgtaacactggcctgtatggacctctatatgataatgactgctaacactattacataagctgtgtgccaggtgccattctaaactctttacctgtataatcccaataatcctatgagctaggtactcttgttatcctaactttccactaaagaggaaacggaagcacaggaggttaagtgatgagcccaagtcacatggtaactggttgtgatactgtaataaatgcaaattcggtctctgccccctcatttctggcacacagctccttgatcccttggaatctccagatgagtatcttttgtatgttaatgggataattgatggctgggggtttctagatagcctcaggacgaggggctggtccccagagaaaccaaccatgtgattagacagttgaagctttcagccccctgcttaaccccaccccaggggaaaggggctgaaggctgagctgatcaccaatggccaactgatgtgatcaatcatgcctgcgaaatgaatcctccacaaacaccaaaaggacagagttcaggaagcttccagataggtgaacatgtggaggttcctggaggcacctgaagagggcctggaagtgctgcaccttttctcccataccttgcatgcatctcttccatctggtcattcatctgtatcctttgtaatatcctttacaacaaatggataaacctaaggaaactgtttcccggagttctgtgagctgctcttgcaaattaaattaattcgatctatggagggggtcgtgggaactccaatttatacgtggtcagttggaagcgctggtcacaacctagggcttgcaactggcatctgaagtgggggcagtcttgtgggactgagctcttaacctgtggacctgatgctatctccaagtagacagtgtcagaaatatcatactgacttgagtgtgagggtagagacttaaaaaaaaaagaaaaaaagggttttttttttttccctttacattggtggaggcaggacttgaacaccagaaatctgactccagggtccacagtcataatcattacactatgctgcctttatatatatatatacatttatagtacaggatttgtcacacactgtataagaatttggctactgtaccttaagttactgggcaaatactttaaacatgtcatggtacaagtaagagcaacaaacattaatcgattataaaatgtttcatctacatactggaaacaactggagaaaaacttgtccatttgtctatttatcccgaatggcacagacaccacagaaaaggatattgatggtttcatcaaggtcctctagatcccactctatgctccggaggttatttctcagctcgttggtggtccagtcgatttcttcccttgttgctgtggaggggtcctggaggagctctgtccatctctgaaacaatccctgggcagtgttgactgctttctgtacctctctgtaatcaagatgaggcaaaggagagaaatcacagacaacattccatggtcaagttactgcatgatttaggttaacatttatgatcatacaccatcctcagcaaccaccattcccacagaaggctcttcacagacaaatatcaaagttcaaaactttgatacacagtctgagtattatgttctcagctgatgcttggaatacaatagccattatttaagcagctacaatatcaagtttgttggggaaggacaaatttaatatttttctctgaacagactatacgtaaaagtataatgaagcaatcctacaaattaactaaagggcaatgagcattcccacatgcttccacttggtgtgacagtattaataatttatactcagatgataagtcctaatatggcctttcttttcttggtgtgggaggaatgagaatgctggagggaaggttactcttacatagctaccattttattataggttaagtattttaatccgagaaattcttaaacccaaaatctcattcaatttccaaacattattagctttaaatatacctactttccttaattaagcaataccatataccagattagtgtttgtttttgttttgtttttgagagggagtcttactcttttgcacaggctggagcgaaatggtgcgatcttggctcactgcaacctccacctcccgggttcaagtgactcttctgccttagcctcccgagtagctgggattacaggtgcccgccaccacgcctggctaatttttgtatttttagtagagacggggttttgccagattggccaggctggtcttgaactcctgatctcaggtgatccacctgcctcagcctcccaaagtgctaggattacaggcatgagccaccacgcccagccacattagtgtttttcttgtttagagaatgagactaggccattaagtgctatgatctagcatgcctttagattagatatagtcacaagattttaagaacttttacccccaccattgggccaatatccactatttaaatgttataatctaatactatcacatataaaagccaaaaaggagtcattttataatcatatggtctctcatgttcaaagatgataatcccactgctcctgaactataagaactgttttgatccttctatgatttcttctggaacaaagaccacaaaaacgtgttctagctgattagggtgtttgttgtctatggctttaaaacagaattcacacgcatcctataccctctgacgtttcaagtattggaaaaaagaaagcgctaacaaaaatgaaaaaaagcaccttacaatatttaggtctatggcatactgatgagagctaagaggcggaacgttaaacagagaatacagcttctaggtgcaggctgagtaaataagcaaactatatggacaacaaatctaccaacgtctattcatctagtttaaggcttaggcaagtcacctcattgttcctttcatgtcagcctttagactttcagtgctaatgagaaaccctatttaagataaaatggggaagaattaagtgaggtgaaaatctactttctttactctttatgggatctgggtgatttagtggagaaagagctatgtatcattccttaatgcaaagtaagtcatcctttggtatccttaggggattggttccaggacctccacaggataccaaatctgcagatgctgaagtccttacataaagtggcatagtatttgcatataacctacgcacatcctcctacatactttaaatcatctctagattatttataatacctaatgtaatttaaatgctatgtaaattgctgttatactgtattgtttagggaacaagaaaaaaaagtctgtacatgttcagtagggatgcaaccattctttttttactgaatacattcaatcctgagttggctgaatccacagatttggaacccacagagatggagggctgattgcattggtttatttgtaagtactgagtatcatttatgataatggaagacagagttgaagaggttatctgtaaagacatcttttaaagaatataaaatatatcaattctgtaaagtaaatatgaattccttcttgagaactagaagcctcaaaccaagaagccttgggctagggcttaggtttgttctccaccaccagtacacaatgatgatgctggaattaaattctaagtagcaatctatgaacttttttggtctcaggagactcctttgaactcttcaaaattactgaagaccccgaagagctcagagttatgtatactatgtatctaatctatttactatattaggaattcaaacagacattttaaaaatatttgtcaactttaaaatgtgagcttacatgttaacaatgtttttattttaaaaattctaaaacaaaaaaaatgtagtgagaatggcattgttttgcatttgtgcaaatctcttcaataaatgtggattctcatatccacttctaccatcagtctgtggacatacattttggtagaagcatatgatgagaatccagcctcatacagatacatacttggaaaagggaggagaattttaatagtcttttcggacaattgtggatgtacttttttgatagtataccaaaacttgacaactggctgttaaaggttagctgcaatgtggatcctaaaactgtattaaagaactttttagattttcttattttacagtaataattttcttgtttttcttagcttaccaagtaaaatgggaaggagtatctcagtcattagggcgctttgtttcccttatactacgatccattggtcaatcttgtacaggctgagattccgttatccaaaatgcttgggaccagaaatgtttgggattttttcagatttagaatattggcattgtacttaccagttgagcaccccaatctgaaaatccaaaatccaaaatgcccccagtgagcatttcttttgagcatcttgttggtgcttaaaaagttttggattttggaacatttcacatttgagatgctcaacctgtaatttggatcttttacttttggatgattttataacatcaaatagtggtcattaggaaagtattagtctactgagtattgcagaacctccaaatgccagctcatttcaatacacagtatccaaaatcatatttgttattatcaccaccagtttcatcagaaaaacttaagtgttggaaatctgtaagagcatagtagttgatataagctttccaaaattgttttttttttttttttttttttaaacaaaaggctctaattttatcactggtaaaaatactgtcatttattttccatgaagtgacaggttcacctcactcatttgtgagaaaatatctcgagaattttttagataaatttgagatttgagaaagcctgcaagtctgagaaaccagtttgtcattctctccagtaaaaatgagattttgctcggggcggggggaaaacagctatttcaactcacaactcaatcacataagtgcttttcctagagacaaccattttatttaacaatacatcacaaaaatgcttcacgcaaacttccattttgccagtggaatattaaaatatatactaagggagaagatatttacaaattatatatctgattaatgacatatccagaatatatatttttttaaactctcaaaacttaataagaaaaacccaattaaacaaagccagctgcagtggctcatgcctgtaatcacagcatgttgggaggccaaggcaggtggatcacttgaggtcaggagttcaagaccagcctgaccaacatggtaaaaccccatctctactaaaaatacaaaaaaattagccgggcatggtggtgggtgcctgtaatcccagctactcaggaggctgaggcagcagaatcacttgatcctgggaggcagaggttgcagtgaaccgagatcgtgccattgcactccaatctgggtgacagagcaagactgttgtttccaaaaaaaaaaaaaaaaaagcaaaagatttgaccagtcacttcaccaaagacatacatatgacaaatagcacaggaaaagatgcccaatatcattaatgacatgcaaattaaatcttcaattacatactactacatatttagaatggattaaaatgaaaacaaaatgacaatgcaacatgctggaaaggtggtggggtaactggaattctcataccttactggtggaaagcacaatagtacagccatttggaagagagtttggttgtttcttgaacatatatttaccataccccaaagtcccactcctaagtgaaatgaaaacttatgttcacacagccaaaaattgtaaacaacccacatgtccttcaactaatgagtggataaactgtagtatatatgtataacagaatactattcagcaataaaaaggaacaaactacagctacatacaacaacatagatgaatctcaaatgcattaggctaagtgaaaaaagctagattcagaaggccacgtactatacgatttcactgacataacattccggaaaaggcaaaattataagaacagaaaacagttcagtgtttgccaggtgctcgacatgggggaaggaccagaaggcatacagagaaacgttttggggtgatggatctgtgctatatcctgcttgtggaagtgatgattacacaactatatgaattagtcaatttcacagaagtgtacaccaaaaaggttgctttttattgtaggtaaattataactttaaaaaaatgagaaaaattatacttgagggtcaagattttataaaattattaatttttactgtttcatgaagaatattcttttttttgagacagaatctcactctgtcacccagactggagtgcagtggtgccatttcagctcactgcaacctccacctcccgggttcaatcgattctcctgcctcagcctcccgagtagctgatattatgggtatgcgccaccacactcagctaattttcatatttttagtagaaacagagtttcactatgttggccaggctggtctcaaactcctgacctcaagtgatccaaccggctcagcctcctaatgtgctaggattacaggtgtgagcctccgcgcccggcctcatgaagaatattcttaggggaatatgactcttttttttctttttttttactgttagtacaagctgatgaggaataccacagaaagcatggcacgacaccactgccttgatttttggtaaggcaccaggagttttagccaccacagctttttttggcaccatcagtgcaaatgtcaacatggtgaaaaaggcagataatatctgaatattatcatgaaaagagttttgagctagtggatctttctgtgaaaggatcttggggatcccttgtgatttacaggccatgctttcagaactacaatgtcttaagacactgttagactgaagttgaggagtgtgcatgggtggattctagtagcactgagtgtgaagccaaggaatccttaagtatgcaagaagcaaagcatgtcctgaggaaaaaaatgaaagaaatggcaggaattagaaaaatgctacaaagcagttgcagaataaagctcagcaccctacaggcctgaccagcaacttggcttattccattctaaagctcttatttttaaaaagaggattcatgtttagttttcatttagtaacacagacataagaaaggtaaactagtcgttattttacatttttaagatggatgttttaagggatcacaaaggtggaaactgccagcaatggctcagatcttgaaagacagccagaatctgcagtgtatcagggaatcccatctcaatagcaagcaaagaggtctctctaagtggaaaacctcccaactgttcttccaatatcatttcagtgttagcctgaaaaagaaggcatgaactggaagcagaaaacaatgttggtcacaagtcttatttggaagccaactattaatggtaaccagaattttctaaagcatgtgggatttctaacagcttcaagagccacaagacacacctaataatgtacaaatctaaccagggagacaaccctctcaatccagaaccacttgtaagtacttgcaactaaaaactgaagattacttggcattccaagtaagtcaattcataaaacagtaacatataatcatgtcacctatttgagatttgtgagggtttttataagagaagtgcccatctacttgatttcacatttctttctcaggaaaggcaagggagttgtttcagtatcagttggctagtgaggcatgacccacaaatgtctacccaccactgttgtccgttctacacaactagcccgtgtgagcacttcactttgggaggagcacttcactttgaggagcacttcccgttgagtgagcagatacaactgctgactgctcaggcaacagagatccatttttgtctgtctccagaaaggtgacaatcacagatagtgcttctttatcccttatctttatgtctgatttagctatttttttcctcaactatgtaatcagaaaaattaaagtttgatacccagaactttccatgagagagtatataccatgaagcagtatataccttgaagcaggtataccttgaattgtcagagttcttcagcttagcaaacttcttggtaaataacaatctgctcacccacagcttggagaatcacatctggcagcatttcactgaaaacttgctgatgactttcctaggaattatagttttagctgctgacccagagaagcctttttcaaatccttgaaagagaaagacggctatctccacacatcaagcaaatcttgcgctatccgtcacacatgctgcccaaatcagtttcatctgatacaggtagcatttcgtagataccaagagccagtgttggcaattctagggatgtggcttttcctccctgctgtctacaaaacagcccatcaaaatcatggaacctgtcatcttctcaaggattaaactccctacagacaccagaatgaaggctcttcatggcaagtcaccacaatgcccacaggaccacttgcaatgcagaactttcccagtaagtagctgtcaaaaatggaaacactgcccacatctttgaagaatgcatcttttgggaaaaacaaaataaagtcatctgagcattcagattcttccattctttttttttttttttttttgagatggaatttcactcttgttgccctggctggagtacaatggcacaatctcagctcaccacaacctccgcctcccaggttcaagcaattaccccgcttcagcctcctgagtagctgggattacaggcatgcaccaccacgcccggctaattttgtatttttagtagagacggggtttctccatgttggtcaggctggtctcaaactcctgacttcaggtgatccacccacattgacctcccaaagtattggtattacaggcatgagccaccgcgcccagccaattcttccattcttcataaataaaaagttgattctggcaaaccaacctcatttatttttgaagttagcccaacattgatccctcgtcagatagttgagcctcttccatacaacctcccaatatggtacatcaccaaactagcctctggggccacaagtaatacattcagtccaaatacagtccaaaaaaaaaaaaaatcacaaagttttcttacttgcatctaaccaagtttgccaagtaaaatgagaagaaagagtatctcagccattagggagctttgttccccagtatttgtcattcagttgtaccaacaaattgcgtaagtgtagccacaacccccatcatcctttttcctgttgtggttgagacagggtctcactgtcaaccaggctggagtgcagtggtgcaatcacagctcactgtaatctcgaattcctgggttcaaaggattcttccgtctcagcctcccaagttgctaggactacaggtgcacactaccacgccaagctaattttttttatttattgtagaaacagggtctcgctgttgcccaggctgatctcaaactcctggcctcaagtgatcctcctgccttggcctcccccttcatcgttttgatttatcctttcttctttgcccatgctggcagactctgaattggcatgttctagttatcgtggttgtttaacaatgaccccaaaatttagtggtgtaaaacaaccatttatcatgtcatggagtctgtagatcaggaatcagacacagcagagctgacttgtccctgttccacaatgtctgggacctcagctgaaaatattaaacaggctggggctgtaaaggcatcacatctctctatctctccacagtctgcacacatgctctaacagagtggcttcaatgtaactggacttgttacatgttagctcagggtagcctatacttgtgttccaagatgaaagatgcagatggaaggtatagtggttgtcttttatgacttaagcttcaggagtcaagcagcgtcacttctgcttcaatctgctagtcaaagcagtttataaaggtctgcccaggttcaaaggaagggaatacaaactccagtttgataaaagaatgccagcttcacaatttaataaaaacaaacagccgggcgtggtggctcacgcctgtaatcccagcactttgggaagccgaggtgggtggatcaccaggtcaggagttcgagaccagcctggccaatacagtcaaaccgtctctactaaaaatacaaaaattagccgggtgtggtggcatgcacctgtaaacccagctactcagaaggctgaggcagaagaatcgcttgaacccaggaggcgaaggttgcagtaagccgagattgcaccactgcactccagcttgggagacagagcaagactccatctcaaaaaaaaaaaagaaaaaaaaagaaagaaaagcaacacaggacagaacatttattggtgcagccatcaatggaaaaaatacaatctgccacaactcttttatctgggacagcacctactctgcaagtctttacagagggatccccatttcatcaatacagtaaaagaggctagtcaaggctgaaagtttccattctagtaatgaaacatgaaaaattcaggttgagtgagcctctgcaacacatcagactcccactcctcactcttctccaactggttcctgccccataccccacaaacctggtttcaccactcatctctccagaaagagaggaactctttttattgcttgacttctacattcacatcgtttgtatttgaaaggaaacacatgcacaccctttacttgactttattgccatttccaaattcaaccacactgtgacatattttgtaattactcttgtgaaaatgaaacatcatttttactcagttacctacaattatatacaatttttgaccctaacttactgctgcttccacaactccaccaatgacactgcaggtcaaagtcacgagtgaatttaacttgtcctcatttttggtgcacttgacactatggcccattatatctatttgcttgaaactctcactttctctgtctctgtgacattgtgctgttctagttttctaccagttttctccttcctcttcctccactggatcccaatgtttctcagtactctttgtggcctctatgtgctcatcagcattcacaagttcaaagcacccctcttaagctgatgactcccccactatacttccaaccctaaccactcagccaggcttaattcctatatttttagctgcctataggatcattccatttgcctaaaaccaaattaatcatatcctccctacaaaacataatgtattcaaaacaaacaaaatagaaaaatctgcttccctttctagcttcctcattttagccaatagtgccaccattttccaagtttcaacacttgtctagacaagagtcatttttgactcctcctcctccttaccttgcacaacctctacttaaatccaatcactgaattttcagatctggaaagaactttcaagataatctagtttgtgctccttaaacataaataagagaccttggggctcagacatattggctgcttgcctcaagttcttccaaccctgattataagacactttctattaccaagacttatttaattgcatttttccaaaacttccacacaaatctttttttttttttttgagagggagttttgcactgtcaccagggctggagtgcagtggcgtgatctcagctcactgcaaaagagggttcaagcaattctcctgcctcagcctcccaagtagctgggactacaggtgcccaccaccacacccagctaattttttgtatctttggtagagatggggtttcaccatgttggccaggctggtctcgaattcctgacctcatgattcgcctgccttggcctcccaaagtgctgggattacaggcatgagccatcgcacctggcccacaaatctgttttctttgtagaatcagaagatctgggtttgaacccttaaaagctgactataagcaagtgaatagtaactgctagtttaaaaactgcctcctgatttagaatttatgatagaaatcagattaaatttaaactcctcaggcaggtattcaaaccctctcccactcctcctcctaacccaaactggctgactttagtatcaagcatggtttctcactgaacaaattctgtttcagttggcaggtcttcttcccatctttatctttctcattcctggttcttgacttccactcagttgtttccccagcctagaagagccttacacctcagcagacacttcctttaaggcccagattgaccagcattcccagcatgggtctttctttttttttcaatctccacagcatctcaactctactgcaaaatcttacacaatatatctttcacttatctgcatagtgttctccaaactaaggagctaaataatattaaacactcaaatttataataaaggcttgcaaatttgttcttacaacgaaacactggattctgctttttagaaagtattaaatttgatttacattcaattttactaggccaaaattaacaaacaagggttatttttttcacagtgactataccaatacagtttttcaacagtgaatagaatgcgtgatgccctcgaggagctcataatctagtgttaataaagctagatatgcagacagagaaggttaaagaacacaacataacatataccatcttactcatcagcttacttatgtcattatttcaacatcaatccacagccaaaaacctggaaataaaactgttatcatgctgggtgcggtggctcatgcctgtaatccaagcactttgggaggccgaggcgggcagatcacctgaggtcaggagttcaagaccagcctggtaaacacagtgaaaccctgtctctactaaaaatacaaaaactatccgggcgtgatggcgggctactcgggaggcagaggcagggagaagtgcttgaacccgggaggcggaggttgcagtgagccaagacgcgccactgcactccagcctgggtgacagaatgagactctgtctcaaaaacaaacaaacaaacaaaaaaaccatcctcggctgggcgcagtggctcatgcctgtaatcccagcactttgggaggccgaggtgggaggatcacgaggtcaggagatcgagaccatcctggctaacacagtgaaaccccgtatctactgaaaatacaaaaaaaaaaaaattagctgggcgtggtggcgggcacctgtagtcccagctactcaggaggctgaggcaggagaatggcgtgaacccgggaggcggagcttgcagtgagccgagatcgcgccactgcactccagcctgggcaacagagtgagactccgtctcaaaaaaacaaacaaacaaacaaacaaaaaactatcctcatcagacacacaaaacctccacagcaataaaatagcaaagagccatggtatttgtaccttttatccacaggagtggctcacttatactctgtctccacatgctcagttacatggttttcttcagggtttgtctgattagaaggtgcaaattctaaaaggaggctaattctaaaaacttgccaacaagggaggaaaaaaactacagaactaaacaatcaaaatgggttcactcaacaaacactgagtacatccttactgaatacaaagatgaagactacaagatttaaatatgatattttcacccggagattagtaaagatttttttaatgaaaatcccagtactggaatcaagggaattgggtccctcaaacactttgaggggcaagggggaatattctggaggacaacgtggtagtatgcatcaaacgctttgctgtgcctgccctctgaattagcaattatgctccaggaatacaggctatgaaaatcagaagcagcaatacagacctatgacaagtaggcttatcaccacattaattgtagtgtgatcataaatataatgtatcttccaggatgaacatttatatgacaaaatacaatgcagtcattaaaagctgccacccagaagtctgaaggatataaagaaatacagatgaaaacgtcataaaacaggccaggcgcggtggctcatgcctataatcccaacactttgggaagccaaggtgtgtggatcacctgaggtcaaagttcaagaccagcctggctaacagggtgaaatgccatctctactaaaaatacaaaattagccaggcatagtggcgcacattggtagtcccagctacttgggagggtgtggcaggagaatcgcttgaacccaagaggtagaggttgcagtgagctgagatcacgccatcgccattgcactccagcctgggcgacagagtaagactctgtcccaaaaaaaaaaaaaaaaaaaaaaaaaagaaaagaaaaagtgataaaaccatatataacgtataatcccaatttttaaaatgaccatattatatatataatatatatttgtaataaatatataaatcctggcccttctacgtacaagcttataaagttgaagttttttactaagtttcattttcctttttgtgaaatgatgacaataataatacctacttcataaggataaaagagcaatccctgttgtgggattctgttccgaacaggacattgacaatgtcaaaacctcccaaaaggagcttcaaacttccaagcactaaccactgcatgtataagttacaacagctttctaactggtctcctttttcatctttcctcacactgatgcatccaacactaccaccaaatcaatattcctaaaatcctaatttcatgtcatttccttgctttaaaaatctgtaatggcctcaagatgagattctccttaggccaacataacttgaccctattttacctgcactgggaagtattgacagtagtgtgaaatcaggttgttctaatttgaagcctgagtacaccacttattagctgtgtgaccctaggcaagtaagttaacccctctaacacttcctcagcttctcatctctaaaatgtggctagtattcatcatatgggtgtttttacagagtgaaaattcatataaagtgcttacttagcactttacatgtatgcctggcactggagatgcatcctttaaatgtgagctgttactacttccctaaactgtctactccacctgggctgctcttccagatcatttctaacacacattgcccaacttaggcctttggctggtggtgttctcacccatgaggcaccattccatcacaatcaccaccatcaacaaagagtatgtgttcaacatttacactatatattcaaggtgtaggctggaaatacagaggaaaaaaaaaaaaaaaacagtcccaaacctcagagctcatagtctaataatgaaagagagacagaggaagaggtccaataattaggggtgacaaaggaagcacttcctggaggcaagggagatgcttacactgactccagaaagctgcgtgggtgaatcaggcagtgtgggtgcatgtagagtaagagcatccagtacagcaatcacagtcactgtattgagtctggcactgctggagtactaaggctaagggagagcagaggctagatcagtgaggtcaggaagtgttggcactttattctgcaggccagcagcagccactgaataatattaagtagggtacacctgtctaggactctagaaaagcttacactgtgctgtccaacacggaagccacatacaactactgactggaaatgtggctagtgtgacagaaattaaattttaattaatgtaaacttggtaactgatagcaattcagttatcaaaaaccttttatgtatgtttggaacaattaaagagtatgtaggccgggcgcggtggctcacgcctgtaatcacagcactttgggaggccgagacaggtggatcacaaggtcaggagatcgagaccatcctggctaacatggtgaaaccccgtctctactaaaaaatacaaaaaattagccgggcgtggtggcgggtgccctgcccatagtcctaaaaatacaaaaattagccaggtgaggtggtacacacctatagtcccagctactcaggaggctgaggtgcaagaatcgcttgaacctgggaggcagaggttgcagtgagccgtgattgcaccactgcactccagtctgggcaacagaacaagactctgtctcaaaaaaaaaaaatgtatttaatgaactttaaatacagatcaattatttctgatgaaaatttaatgtccaaatttaaatgtgcagtaagtgtaaaatatgtatcagatttagaagacttagtacaaaagtaaaatatctcatcaataatctttaatcacatgttgaatattttgaatgtattagagattacattagaattaatttcacctgttcctttatattttactgcggctactagaaaatgtaaaatgacatacatggctggcattatacttctattggacagcaatgatccaatagatcccaggacagctgaaagaggaaatgagaccagaagcaggaagaacaattaaaaagactctgataagcatccaggtaagagagacaggcctgattatctaaattctgcccatcttcaaaacctaattcaagatacactactgcctccaaaagctctcctaatcctaacaattcccaaggagttacctttctctgaactcctgaggcacttatctgtagcattcacttcaacactcattcatttgccacctgtcatttctatttaattttggggtaatttgtttctcagattagaccagaagctcctaggctaagggccataatttaggcacctttaatttttgcatgctgtgtaatgcatttttgatacttttaataaacacaggtacatgactccccaaaaatctggatacaccttcatgggtgactttacctttccacagcagaaggaactgagaatctcttttccttcaagaaccttaaagataggagctaaaatgatgtaaaaatcaatcaaaactccctccaagccaatgttccgataaagtagtgatatttaatcagtgagcaagcattagtagactgtataggataccatcaagaaaaaaaaatgccaagacagaagaatttaggcttttgacaaattccataaaaagtcaaacaaaaaatttctgatcatctctgatctctaccgccagagataacctttgccaacctaagcattaagaactttcaatcaaggaaaaaacatctattttaaaaattaacccctaaatcaatccttctaataaatatcacattttctaggtagggatacacatattaccagtaaatttacaactcagcattttcccatctaaattagagtaaggtgaagaaaaaaaactttccagggaaatattaagaagtagtataaatgtattttactgcataatcgataaagtatttcacctaaaataccatttaaattttctacaacacttgactatacaacggccagcttgcaccactacagaaataggaagctagcagcaactagtaaaaagcaagggacattctgtggtgatcagtactgacctgggaactttgcagttttcagatttttcatgtttgacatttaaaacagaaaactgacaagtttctaataagaaactaaaagttacatcagaattgatcttcttgcatgtgtttaatggctacgaagtggatattacaaagtgcagttgaagactctatctccaaagaaacaatcgagcaatcaaagatgagctaggatagcttgtaagggaacagaaggcagtcctttctattctgaaaggcagaagaaataggagaaacctgtcaaacaacctggatgaaatcaaggagttaacaagcaacactcatttcctttagcactgtgagaaaattccggttgctaatagaaagctgaggaaagtttggtttggcttgtttcattttgttttccttccaaatcatcactgagtatgaacgactgctttcctctcctcacattactcagtaaaaactcccccattgaattgtcttccggtgccctgctccccagcctcccagaacggcccccgcccccgcctccctcccagcaaacgtgctcagacgcctctgggcttgttgtggtctcgccagtctgcggacaagcgctccaaactcaatggacaatggagctcacccccgtcaacgcgaactacaaagctcaggagggccatttcccttttcctgcccagatgctgttttcgctccttcgaagcaagatcccatgctcgactagacggccagtgtgcgccaggacccgcgtgtctccttccccacctgcagagctgctgagcccctcggcccccaaataaattgtaccgcagcacacaggccaaaaagggccccccaccaccaggggcttggctggggacagtggcttcacggtccaggtagggatggagggaacgtctcttgacgcttggtcatggccctcaagactaagccgtctccactgttccccctccccagctccaacttgcctcccctccccccactgcgagaagacctaggaggtgcgggcaggcagcaccgccacctcttcctccggtggagcgctcggccgacactcaccctttcaccacaaagaaggggtcctccatggacatggcgtcccggccccggccgccttcacctcctccgcgcacagggcgcccgtgcctcccggtctccctccgcccaccccgcctgttcccgcagctgcccgcgccttagtctgggtgaagccgagcagcgggcacgcgcacaggccaggtgcacaggacggccgctggtccagcactcgctcagcaccactggccgaatcccggactcgggcgccggccccctcggcagcctccagtccc

SEQ ID NO: 1243 - DNA, 28515 bp, Homo sapiens
cagaatcttctgtaggcctttctcttgccttcttttattcagtaagtgttttgagcttattgtgctgggtgctagagtagcagggaggacagacctaagttgaagattacgggacaatctaagtgacacctgctatctcagacagagacttcagcatcatagggagccagagcagggagttccaagccgtgggaactgtgactctttcttactgacccttaagcaaaattctaagctccagggaagcagaggcagcagcttgagctccctgattgaccagatatgattaatctttgtttctctgtgctttgaacatgactatgctccataaatatttaaaaattgggaatagggtgaagatagatacaccaaaaggagcaagcagtgtctgaaaccagcaaagacttaaaagttaccgaagaaggtgttcatgctttcattttatcttttttttttaacctagcaactgatgacactgcatatcttcccctgttcttattgggagaaggccttgtgtgtcaccaagaggttctcagaagggacctgtcagtttttggttaaaagaacccggaaagagaaggactatgggggaactgatggcgttcctgttacctctcatcattgtgttaatggtgaagcacagcgattcccgtgagtatcccacgtcctcttctctcctaactccaaagtcgaggcagcctagaaggcacagcttttcttcctaaaacttgtggtgaaaaatatagaagccaggggcagaaacgtgtatgtattacactcagactccaggagcaatggattgcctgaacagtttcccagttcatatttgtaggattttgatgtcaccaccttctgagggagggggagccgttctagaaagactctggaacttcctcactttccctctgagcatggcctcctttcttttctgctcatattttttcttttacttttgtttctcctcttttctaacttccagagtctcatgaggatgtagtcagagtttcaggggcattaacagtggagtagatccattgttcaggtttatttatgtttttcctcaacacaagccctacctgtaataaaagatccaagaaagataaaaccatggctctgggtttgtttactgactgtgagaagtattaatcaagtagaagggagagtttttcattattcggggagctcaagtcactggggaagcaaatgccttctgttgcctcaaataggggaaagggcccatgggctagaaccaccaggcttctctgccctaatcacttgctccctgggctgaggactggtactggtgggcagtgtccagaacttagacttggccaccaccataggtgtgactgatgaacatgagaggaaggagttctttcaaatcacccatgcacatagagagtggaatgactgaccatggagatttggaagggcgaggggggtggatgattagaaattacttaatgggtacaatgtgtgttacttgggtgatggataccttaaagccccaacttgaccactacacaatctatgctataacaaaattgcatgtgtacatcataaatttatacaaataaaaaaattttaaatcatatggctgggagtggtggctcacacctgtaatcctagcacgttgagaggccgaggcagacggatcgcttgaggtcaggagtttgaaaccagcttggccatcatagtgaaaccccatctcactaaaaatacaaaaaattagctcggcacacccatctctactaaaaatacaaaaaattagctgtgcacagtgcgcacctgtgatcccagctactcgggagactgaggcaggagaatcacttgaacccaggaggcggaggttgcagtgagccgagatcatgccactgcactctagcctgggtgacagagtgagactccatctcaaaaaaaaaaaatccatatattaattgttcaaatattgattgatggcctactatgtgccaggcactttgggggatatggcagcgaacaagacaaacatagtctctgcttccatgaaaatttaatccagaaagtgtcatcatttatgggaaagattgggggtgagggtaagaggcagaagatgaaagaggaaaggaggagagaggcaaagggtgatatttttggaaataataaagcttatatattacctgcatgtgattctcaaagaactctccaataatatggaataatattccttaaacatattatctcctatgacaatctcactgactatttgtagtaggtgaagaaaatatccccatttaaagatgaggcctagatttttctctaggcctagagagtgaccacgctcacataaggagcaacctgaaggagactgcagatcttctggccctcggtccagggctgttccacaatgtcattgctcctttgggtgtgaagacttgtcactttgataattggggggacaggaaataaaacaagtaagttataaaggcaagggaaggtcacttggtgctggctgttctccttctgactccttagagtgcatccttctctgttctgttctgtgtccttgaggctgactgctagactgcatcacctagactctcttgcaagctgatttctgcttgggttcatacaatgggagacactgaaaggagagatgtcagagagcagggaggaaagagaggctgggatacatctttcttgctccttccccactttctgtgatgtctttggcagtagctatgttcttctgtaatgctgtcttccctgaataaccccttcttcatggttctagctcccattgggcttcagtaacggtatttgctattcttatctcttaagccctaggggtgataatggcttcccatagttgttagcctgcagatgcccatcatccttgtttgttccgttaaccttgaccatatctctgcaaggagtcccttcattaaggtctcctcacatgacccatctggcttgaaggctgtttcctgctaggaccctaactgaacattcctgggctttgagggatattggctggaaaaggatatgagattatgaaagaagactcagtctacttgatatttatgcctagtgctagccctgagtgggagctatataccagtaatagatggggaaacacggggaagagatactgcagggttgtgggtcattactccaggaaatgtcaacataactccaatatcactttcagtgtgttgctttcatcaactccacagcctgcagttgactcctccttcctttgtgctcccatggctcctgttcacagttctgtaattttccatttacaaaaatcttctctttgaggctctccttaaagacagaaagagatatcttcatttttttcttatttctctggtatacctagtgcccaacaggcacttagtaaatgtttgctgagtgaatttatgttcggaggtaatgtccctaagaaatcacagttatttgactgggagccatagagagctcgggcagtaataacgactgcaaattcaaaactgtggcttactgtagttgcaggatttgtattaaaaaggtgtttcatgcttttacaactcatcttgttcttcatttcagcctgtgtgaaactgtgaattggcgatatgggtgggtgtaatcagactgggggctggcatgagatttctcatgcattgccatatgtgatttgtatgtttcatctcgacataaccaaggtcagtctcttgatattactcataattttatggctgtataaatctgctatatcaatctacttcatgaatggtggagtccttcacaggcgaggtctgatgatggataagctccctaagctgccaactgggttactgttaaaaaacagacttgcatattatctgcttagaagtgaccttgagttcaaagagttaacatgagaaaatatgggctttttctttagactttattagatagacttcagtctgtttccatggagctgttgccaaggtatatgccatagaaatttctccaagacaatgtttcactcccctaaggccctcttcttaattggcattgaatctatctaaacttgagaaattcaactaatttgtagatttttcttttgactagttgaaatatctgtctattctcacttgaccccaatcctcttaccccacagtattgctaagagctggaggaaaggagcctaagttaaagatcaaacacatgactctttgaacacttattttagggaactcaaattgagaaagatgacaaaggatgttttttctgatgtatgaatttatatttatcggggaaaatctttcaagagtatacatattaagtcacattttgttataacttcaaaggatcattttagaaaaataaaatttataaaatcgggattttctgggaaacataagacatatagtcatcattgtgtacagagagtactgagggaaaaaagacaccagagctcattcattcgttttccaaaactccacatagtcctacagggctcactttcttactccattcacatctctgctcaaatgccacctgctgtggtccctctatctaaaagatcaggccttctcctctccacactctcttttctctgctttacttttcttcataatctttatctccacctgaccttgtattatatatgtatttattgccaatctcctgtctagaaattatctcacagggctgggactttcatgtgttcattgctctgtttccagcagctaggactgtgcttattggacattcagaaaagaatatacctatatgaagtgagacattggcaaccttcaaaagggtagcctcagaagagtagctcacaagccaaacttgtcacagtcgccacttttatgctctaagttcctgtagttagttagacatgtcattaggagaggggactaatggttcttgctgcacatagaaccatccatgaacatggcctgagatgtgtccaaaggtccccttaactaaaaatattgccacctacttctcccctcattcccacgatgctcgaaattctaaagagtcattcccaggaatcataatcattttgaccttattaaggcattggacttcttgagagagccaataaataatcagactgtgttgacctggttatccaatcaggactcacggccacctgtgtgtaggaaggtctggagcctgtggccccagggactgggaaatcagaggcagtgagtcatccttgacacaagggggcaggagagagcagtgataatccaggggctagaagcctggcctggaaagcttcccctacactagggagggttgggtagtctcaaggtagagggacttcccatggagagatcacagtgtgattcctggttccttcacttatggattctgaggatgatcttgggcaattaatctctctgcacctattttcttttctttttttttgagatggagttttgctcttattgcccaggctggagtgcaatggcgtgatcccggctcactacaacctccgcctcctgggttcaagcgattctcctgcctcagcctcccaagtagctgggattacaggcatgcgccaccacacccagctaattttttgcatttttagtagggacagagtttctccgtgttggcaaggctggtcttgaactcctgacctcaggtgatccgcctgccttggccccccaaagtgctgggattacaggcatgagccaccacacccggcctctctgcacctattttctatctgtgggttggaattataagacctacctcaaaagtttgttagaagaataagtgaaacccatgcttatcaagggcttaaaatggtacctaacacaaggtatgtgctcaataaacaaatacagttgtgatgactatgattaagatgctgctgccctttatgcctcattgaaggcccatctgatctgccacctccttggaacatttcccagtggatcccttctcatgggaccacggtctctcttctcctagtggctggagcactccattggtactcttttctggcgcttgctgcttgttgccgtgtgtggtggaattcatttatttgttatgtgctttagctccccaataatactgtaagttcctggaggaaagagctggtatttgatttgttcttctcttcctaacattgcctccaattccttgtacatagtagacactaaataaataattgcccccatgaggccgggcgcggtggctcacgcctgtaatcccaacattttgggaggctgaggtgggtggatcacctgaggtcatgagttcgagaccagcctgaccaacatggtgaaaccctgtctctactaaaaatacaaaaattagctgagtgtagtggtgggcgcctataatcccaactactctggaggctgaggcaggagaattgcttgaacccaggaggcagaggttgcagtgagccaagatcatgccactgcactccagcctgggtgtcagagcgagactccatctcaaaaaaaaaaaaaaaagaaaaaagaaaagaaaaattgccctcatggatgaagtgaaaacacttcatcaattattttacaatccagtgattttcacagccttttgtaagaatggcccaactggttaatggacaggttaaagggaacatgatttagaactatcaagtagccattgcacctagcctaagagtttttggttgtgtcgttcgggttctccagcactatctgtcagaagctgatgagactgggcaggagatgccttttgagaagtagcttgactggtttagacagaataccaaattctaaattgtatatttcagcttaataagtgagttgatgctgatgatctatctgttcatggaaagggagagagagacttaatttcaaaattattagggcgagaaaagagaaatggaagattagatcaaatgatatgaaattgccatttttataggtcaaaaatggtaaaatattggcctttccaaatgattcgaaatctgattatgtctgcaacaaatcctggtgggatataaattatcacaagttttaatgtactaggagagagagggtacctggacttttcctcatcttttctgttgtgagttactgactgaacatgtgtcaatcaacttcccaccacagcagaggtaacattttaaaggcccagctaaggagcaagcatgacttgttcctgtggaggcaccagatgggtaactgggcccatggcaaatgaagaggaagggactgtgatgtcctggagcagagccacgctgggctgaaccagtggtggatgggtgtgactgaaaaagcaagtccagcctttaggtgcctggactttgaagtcaaggctggctggtggagaacaactgtttcaaaaccaggcatcagaattagattgaagttaaaaaaaaaaaaaacccagaaagaaagaaagacacagccaggcacggtggctcatgtctgtaatcccagcactttgggaggccaaggcagggggaatcatgaggtaggagttcaagaccagcctggccaacgtggtgaaaccccatctctactaaaaataaaaaaattagctgggtgtagtggcaggcgcctgtaatctcagctacttgggaggctgaggcaggagaatcgcttgaacctgggaggcagaggttgcagtgagcagagactgtgccactgcactccagcccgggtgacagagtgagactctgtctcaataaataaataaataaataaataaataaataaataaataaagcacaatacttacttggacagtattgtcaacagaccatatttctctctatctacctcttttaacttcagataatgcaaattcttgtgaaaattacatttttataagaaagcaaagttacatgaattgtaaatattatgtttggagatgatgctggtgatacttaactggaataaatcctgctattgggcactaatgccccaagttgttaatactggaggtttttttgcttgttggcatctatcaggaatgtagacctcagagatcataaaaatagaaaacccagattccaggggatgttctacaccaacccagcttagctcagcaacacagcatctttttttcttccttcttttttctcctctccacattctctgtctggagtctgctctccgtggggattttttcccatgaaaaactatggaagtgattcctccctctttcttttcccctcactccctcaactccagccacaggcctttgtgctgctcctggaatgtgccaggcatgttctttccaggggcctttgcatggcccttcttgtccagactgctgtccccagacacctgcctgtctccccaactccttgcaggcacttgctcagaattcagctttgtgggaaaccttccttaatacgccttccttttttaaatagtgttgcccattcctctttgcagttttatttttcttcactgtactttaaaaaaattatatattttattttctagtctgtcttctccccttcccccgactagggtgtagactccatgagggcagacatttttatctgtttggtctggtacaagcttagggcctagaagagtggctggcacagaagaagcattggatatacaaatcaatattaaggaagtgtgagaactaatattcacaacttgttcctccttttgggtcctccttctttagacagttgtgtacctccagtgtagccacaaaactttccagatgtgaaaaaatagaactatttcaaaatcaattgcagaatatatatagtaccctttgcagatcccagattgcagttcaactctccattcaccagccttcccttgaatcaaagataatttttttttttttttttttgagatggagtctcgctcttgttgcccaggctggagtgcagtggcgcgatctcggctcaccacaacctccacctcccaggttcaagcgattctcctgcctcacctccctagtagctgggattacaggcatgcgccaccatgcctggctaattttatatttttagtagagatggggtttctccatgttggtcaggctggtcttgaactcctgaccttaggtgatccacccacctcggcctccaaaagtgctgggattagaggcgtgagccaccgcgcccggccaaatcaaaaatattttttaggccaggtgcggtggctcacgcctgtaatcccagcactttgggagaccaaggcaggcagatcacctgaggtcgggagttcaagaccagcctggccaacgtggcaaaaacccgtctatactaaaaaaaaatacaaaaattagccaggcgtgatggtgggcacctgtaatcccagctacttgggaggctggggcagggagaattgcctgaagcagggaggcagaggccgcagtgagccgagatcacgccactgcactccaacctgggcgacagaatgagactctgtctcaaaaaagatccaggttaaatagattcatattcatttcagcatatttcattattccaaaccacagaaataaagtgtttcaccaacaatttaattcacccaatatttaccaagctactaccatgtgccaagctccctgtgctaagctttgcaggaaatacaaaggaaaaaagcaaagtccctgttcttaagtgctttaagattgagaagcaggtagaaggtagtaagcagagggaaacagaaggcagaatctggtagctattggttttacgacagaactcatgctctgatgcaatctctggctcttgtttgcataagaaccaacacttttatgaagaggctctcatgactaccccagaggcttccactgtcttccctcccaacccaagccctcacccaccacaggaagggaagggggaagtaaaaggtcaaagcaatacagagggacattgggaccttatgctgccccagcctgtgggaggccagcctccatcctgttcagtattgcagctgacatgcaggataacacctgtgagggaggagcccatggggcggggatacctactctgaaccctgccaaactgctacaccccagctccaggagcaaggagaaagaagtgctaacaatgattttaattgctgggcgtggtggctcacatctctaatcccagcactttgggaggccaaagtgggaggatcacttaaggccaggaatttgagaccagcctgggcaacacagaccctgtctctattaaaaagaagtggtgacgtgcttataatcccagctactcaggaggctgaggtgagaggaccacttaagcccaggaattcaaggctacagtgagctgtgatcatgccgctgcactccagctgggcaacagagtaaaaccctgtcatacacacacacacatatgcacacacatacatacactaactagtacaatcagttgctctgggagatacctctcagggcctcttgtttttcctagtatgcaaggtaagggtaccctggccttggggtggtcagttctgaaagataacctgcacattatgagttatttcataagcagttttagagaaaagaaaaatataaacaaacttgtagcacagaagctaatccaactattttgtgagctgattttttttttttgtctgatcttttttttttttttttttttgagacagagtctcactctgtcgcccaggctggagtgcagtggcgtgatcttggctcactgcaagctccgcctcccgggttcacaccattctcctgcctcagcctcccaagtagctgggactacaggtgcctgccacaacgcctggctaattttttgtatttttagtagagacggggtttcaccatgttagccaggttggtctcgatctcctgacctcatgatccgcccgcgtcggcctcccaaagtgctgggattacaggcgtgagccactgcgcccggcctgatcttttttcttaactatatgcttataaatgaggaggaaggaatgaatatcattaagtggtattcacccttgcaagattctctatagtggcaagggccaggttagaagatctgaatgtaggggaggtcctaaaggtgatggcagcagcagggtgggcaatctggaaagactggggaagtgttgtgtagtacagctcttagacacaggcaagagaagcccctggatatggccccacattcagagagccccactctggccctctgctacccacatcctttcccacagagcgaggagtgcgtgaggctgaggggaggtggtaaccctgtgtctgggcccctccactctagaccagactccaggcacccaggaacctggagttccccactcagctgactcagagctgctgaggtttacacaacaaactcgcactttggcccatcctcctaaaggtggactggctgcccttgagggccttgctaggcctgaggggtggccaagaggtgggaggatcacttaagcccaggacaagctcagacaagaggcagtttgtggctgagcctgaataaaaaagtagaggtgtttaattgtgggaggcccttggcagtgctggaaggagcaagaaacaggaagaaaaagaggtgagtctcaggctgagggccggggactggagggagacaccagctttctctgtgccgccccattcaggcccagaacttcacacagtgtgagattttttaatttgaacttggtcttcgaagccatacaaagggcaatctctcaaggtggggggatagaacatatttcaagtttgttagattgatttattccttttaaatatctggatctctggtatgtgagcctccatctgtcatctcaatttagccatgaaattttagggatgatcctgttttagggatgaaatgtttttggaggtgggttttgaggactgggaaggatttagatgggtcagaatggcaggagataacaggacaaaaggcttggacatgggcatctgcagacaccggcaggcagagtaggggaagaaagccattgtggctgcataccttctatttgccagcttttggggatggcatggggtacgtagccttctcagcctgggctccacctcccaggcatcgcctctgcccgtgacgcctgtcactgtgctccagacgtcccaggccatttggttcccatgcacgccccgccttctcgaacctcctgcttgcacatgtggtctctgccctgctccccctgcccgccctcctgcatcccctcccagcccctctgcctactcacctcctacctgtccctgagacctccctaagacatcaccttctctggaagtctctcctaagggcccacaccagcttggatcccataacactgagaggtgacagcgtgctggcagtcctcacagccctagctcgctcttggcgcctccgctgcctgggctcccactttggcggcacttgaggagcccttcagcccaccgctgcactgtgggagcccctttctgggctggccaaagccggagcccgctcccgcagcttgcagggaggtgtggagggagaggcgcgagcgggaacccgggctgcgggcggcgcttgcgggccagctggagttccaagtgggcgtgggcttggcgggccctgcactgggggcagccggccctgccggcccgggcaatgaggggcttagcacccgggccagcggctgcggagggtgtactgggtcccccagaagtgccagcccaccagcgctgcagctcgatttctcgccgggccttagctgccttcctgcggggcagggcttggggacctgcagcccgccatgcctgagcctcccaccccctccatgggcctctgtgcggcccgagcctccccgatgagcgccacccctgctccacggcgccagtcccatgaccacccaagggctgaggagtgcgggcgcacggcgcgggaatggcaggcagctccacctgcagccccagtgggggatccactgggtgaagccagctgggctcctgagtctggtggggacgtggagaacctttatgtctagctaagggattgtaaatacaccaatcggcactctgtatctagctcaaggtttgtaaacaccaatcagcaccctgtgtctagctcagggtttgtgactgcaccaatcgacactctgcatctagctactctggtggggacttggagaacctttgtgtggacactgtatctagctaatctggtggggacgtggagaacctttgtgtctagctgagggatggtaaacgcaccaatcagtgccctgtcaaaacagaccactgggctctaccaatcagcaggatgtgggtggggccagataagagaataaaagcaggctgcccgagccagcagtggcaaccgtctcgggtccgcttccacactgtggaagctttgttgtttcgctctttgcaataaatcctgctgctgctcactctttgggtccacactgcctttatgagctgtgacactcatggcgaaggtctgcagcttcactcctgaagccagcgagaccacgagcccaccaggaggaacgaacaactccagacgcaccgcctttagagctgtaacactcactgcgaaggtctgcagcttcactcctgagccagcgagagcaccaacccaacagaaagaagaaactccaaacacatccgaacatcagaaggaaaaaactccagacgcgccaccttaagagctgtaacactcaccgcgagggtccacggcttcattcttgaagtcagtgacaccaagaacccaccaattgcggacacaccaccacccataatgccaccttgaaaccactttgtctccgtcaggccctaagcttcttggacaagcggagagaagttcaatgtgggaacagcagggagggccaaacagttttgtttcattttggtttacttttaacccttattacaatccttataactagtaagtagaaaaagaataagaaaatggttaacagcagtggtttgacataataggaaaagcactgtgctttaaaaaaaaaaaaaatttcggccggccatggtggctcacacctgtaatcccagcaatttgggaggccgaggtgggcagatcatgaggtcaggaattcgagaccagcctgactaacatggcaaaaccctgtttttactaaaaatacaaaaattagccaggcatgctggcacatacctgtaatctcagctactcagtaggctgaggcaggagaatcacttgaacccaggaggcagaggttgcagtgagccaaggtcacgccactgcactccagcctgggcaacagagtgagactctgtctcaaaaaaataaataaataggctgggcacggtggttcacgcccataatcccagcactttgggaggccaaggcaggcggatcacgaggtcaggagtttgagaccagcctggtcaatatggtgaaaccccatctctactttaaaaatatacaaaaattagctgggcatggtggcacgcgcctgtagtcccagctactcaggaggctgaggcaggagaatcacttgaacccagaaggcagaggttgtagtaagccaagatcatgccactgcactccagcctgggcgacagagtgagactctgtctctaaaaaataaaaaataaaaaataaataaaataaataggccaggcgcggtggctcacgcctgtaatcccagcactttgggaggccgaggtgggtggatcacgaggtcaggagtacaagaccagcctgggcaagatggtgaaaccctgtctctactaaaaatacaaaaaaattagccaggcgtggtgaccagtgcctgttatcccagctattttggaggctggggcagagaattgcttgaacccggtaggcggaggttgcagtgagccgagtttgtgccactgcactccagcctgggcaacagagcaagactccatctcaaaaaaataaataaaataaaataaataaataaatttcggccaggcgcagtggctcatgcctataatcccagcactttgggaggccgaggtgtgcagatcatgaggtcaggagtttgagaccagcctggccaacatgatgaaacactgactctactaaaactacaaaaaattagccaggcgtggtggtgtgtgcctgtaatctcagctacctgggaggctggagcaggacaatcacttgaacccaggaggcggaggttgcagtgaacagagatcgtgccattgcactccagcctgggcaacagagcaagactccatctcaaaaaaaaaaaaatgctcagtgcatgtgtttgtgtgcctgtgtgtatatgcccacacgtgcacacacagaggtggagtgggggtcctcatttattcaccagaggcttctttggtaaaagaagaaggctgcgtcatcagggttttcaagccttcagagttcccgagggctcccgcagggacagctccccctgtatccccaatgagtggtcttctcccttccccctacaaccatagcagcactctatattttgtctacaagttgagattacctataaaattccatcctgcatttgcaaacctgaacgagaaaggctccaagtcactggtctggagctcttacgtcctgtccaggccccggttcctgggttctgtggttctgtaagaggaaatggcagctggggcgtggaggcctgggtacagctgagtagggagcactcgtgtggggctaaatgaatgcagttgaaggatctggatcatctgggaccctacatgtcttccttctttgcctcctttccagggacgcactctctgagatattttcgcctgggcgtttcggatcccatccatggggtccctgaatttatttcggttgggtacgtggactcgcaccctatcaccacatatgacagtgtcactcggcagaaggagccacgggccccatggatggcagagaacctcgcgcctgatcactgggagaggtacactcagctgctgaggggctggcagcagatgttcaaggtggaactgaagcgcctacagaggcactacaatcactcaggtgtgcatgcggcagagacagacgcttcccccatcccaccccaacccgcagagacccctgggctggcctccaataagcggatgctgaattgcacctgctgtagctttggcaaagcctgaggaatcaggttggtggagttcagggcctcccatctgcctgtgcatcttctggactgtccctctctcccccaggagcactctgtcatttgccccacccactcttccccatctctgtatccgtatctgcatcccatttccactcaggcttctgatatgcatctccttttccattctaaatttgcccattctgcgtctcacttcctggtagtcaggcctagtgacttgcttatgagtatcgacagtaactttcccaggggtatttctggctcctgcatctctctccctcctccactgcagtcagaatagccacaaagtttatcagtcattcccattacaggataactccccaaggcgggaattagcacactcctttgacaggcagtaggtacttcacagatacctgctgacaggtgggcttccataagggggacctcctggggactcagcgatgccatggcaggcctggggggtgacataatgtagaccaaaggatgcttccagccatgcccctgctcccagcacttgagagcccacctctgtctctgtgtggacccctctgggcttctgtgtgtgttccagggtctcacacttaccagagaatgattggctgtgagctgctggaggatggaagcaccacaggatttctgcagtatgcatatgacgggcaggatttcctgatcttcaataaagacaccctctcctggctggctgtagataatgtggctcacaccatcaagcaggcatgggaggccaatcagcatgagttgctgtatcaaaagaattggctggaagaagaatgtattgcctggctaaagagattcctggagtatgggaaagacaccctacaaagaacaggtaaagagaaagagaaggcctcattcccacattgcctgaacaactgtttttatacgtaactcttttaatctaggttatatccactgtatcctgaaagccatctctttagttggcctattgtgatctcatggctagagcccccacgaaaactttccctggttacttttgagcagcatcttgacaagatttgacagttccccttgtcttgacagagtggagtacctccaagggcaccttgtttttagggatctattgaggcaaattcttccattccgtcaatgataagctgggaaattctttgggagatagagcaattcttacaaactgtttagttaacaaagggctcacacaccaccagtaggagtaaaaatctggatttaccaagacaaacagaaggtctctgctttactaaaggattaatgaggttgggcatgatggctcatgcctgtaatcctagcactttgggaggctgaggcaggaggattgcttaaggccaggagtttaagactggcctgggtaacattgtgagaccctgtctctattaaaaaaaaaattagctgagcatggtggcacatgactgtagtcccagatactcaggaggctgaggtgggaggatctcttgagcctggaaggtcaaggctgcagtgagccatgatcatgatcagcctgggtcacagagcaagaccctatttaaaaaaaaaaaaaagtattaatgataagattcctttcagcaaagagctcctcttataccttaaagatatgattcagttggtcaacttttagttcatatagaacttttcatgtatggtcttgttattcaaaattaatcacacctgtatgatgctacaggaaactcctagatacaatgtgtgtgggaagagtatgggaagctcccctctccaggcctctgtctacattcagtgtcctaatggattttcaaccttttggtcaaaacacactcctaaaaaaacaaacaaaaaaaaaaaagaaaagaaaaaacacattcctagaaaaggatcttggattaatttcttacaggccctatcaaaaagcacagtccctcctagtagcatttattttacttttaatgttggaaagcctttttctactaccaaatatcatgcctcggtaaagagacaaggaaagcattgttggagtgaaggctcttctccgtattgggttggccgatgataaggtgggggtcaggaggcaagtcagagatgagcaggaagcagtcccccccagatagtgcctttggtctcggtatggctgtttgacccaatttcagcaagaaacattaaggacaggactgtatggaaaattaagagtagtcatgaggaagcaaggtcacacgtgggtacttctttggtgtcactgctggagcccttctatgatatcagtttcttcgaaggcacaaccatggcatgatctactacatatgtttgtacctgatggcagtcatcaaaatgccagcgcaagtacacaaggcaattcggagccaaaactgagtggggatggctgtgttatttacgtgcactaaacacagaaatgagaacaaggagttctaatctccaatctattgctgacttacttattgggaacagtcacttacacattttatgggtcagttttccttgacacataaaggtatttcaaaggttactagtaaacaaccccagcacactttccaaacagtcaaagctgtatgactttccccccttagaggatggagcatgggccaactccacattcttcactacctagcaccttgccatcatggaaggtatacgtaaatacgtttgttgttgatgaacctgagttctgggtcattcttagctttagaagtttcctgcaataaagaaaaattaggaaagccagttgccaagttctaatattatatgctcagtacataaggcactttgatttaactttagcttcttcttcctagagcccccactggtcagagtaaatcgcaaagaaacttttccaggggttacagctctcttctgcaaagctcatggcttttaccccccagaaatttacatgacatggatgaaaaacggggaagaaattgtccaagaaattgattatggagacattcttcccagtggggatggaacctatcaggcgtgggcatcaattgagcttgatcctcagagcagcaacctttactcctgtcatgtggagcactgcggtgtccacatggttcttcaggtcccccagggtaaggacggggatcgtggctgtctagggagagagcctggagaaaggggtgagcaggaaaccatgctcgctgccagggaggggaggatagatcactgcctcactcagtgtgccttagaatgggtcttttaaataagtggttctcacactttttggaaccaggacgccttcatactattaaaaaattattgaggaccccagagagcttttgctgatgtgggttatatctattgctatttactacattacaaattaaaaatttaaaaattaaacacgaatgggtgcagtggctcatgcctgtaatcccagcactttgggaggctgaggcaggtggatcacttgaggtcaggagttcgagaccagcctggccaacatggtgaaaccccatctctactaaaaatacaaaaattagccaggcatggtggcgcatgcctgtaatcccagctcctggaggctgaggcaggagaatcgcttgaacctgggaggtggaggttgcagtgagccgagatcgcaccactacactccagcctgtgcgaagggagcaagactccctctcaaaaaaacaaaaaaacaaaaaacaaaaaaacacaacccaggcgcagtggctcactcctgtaatgccagtactttgggaggctgacgcgagtgaactgcttgagcccaggagttcaagaccagcctgggcaacatactgagatctcatctctacaaaaaacacaacaattagctgggcatgatggcatgcgcctgtagtcccagctactgaggaggctaaggtgggaggatcgcttgagcccaggaggttgaggctgcagtgagctataatggcaccactgcacttccacctggacgacagagtgagacgctgtctcaaaaaaaaaaaaaaaattaaacacaagaaaacacaagcagatattccattagtggtcagattgatgagtgagaagcaacagtaaggaaaatggtgttgggtttcctgatgatcacagggacaaaagtcccagaaagttaacacagaagggaaaggggacttgtggattttttctcatttgcttgctttcagaatcagaaactatccctcttgtgatgaaagctgtctctgggtccattgtccttgtcattgtgctggctggagttggtgttctagtctggagaagaaggccccgaggtgagaggcacatggaagggatccagggggctgcagactctcctgcatctctccagttttattttctgcacctgctgctccctcctccattcagaaatggcttggctctcaggctgggatcacagaaggacctgggacaaccctcccaccatgtaggggacacaaagcatggataaagcttacagggagagtggtctcttttcataggtgatgcctgacatcaacaaactagtacatctgtccaggggaactgtccccctagaagttgggtcagagaagatatggggatcttgatttgtctttttccaaaccatctttttattattaattactattgacttctggggcagtgtcctttgtttcaagacttcagtcagttttcccattttgaccaccattctttcatcccaagcatatgaaagtccttttccttgtaaattcattattcaaaacattaaatatgtaagagtagataccttcagggaatgggacttagagtaaggaaaaggggaggagaagtaggagatatataggctcttgataatgtggaataacataaattcattcagtaagtatacattaatgacctactgtgctccaggcactgtactggttgctgggatataacaatgaacaagacagatacgatccctgttttcatagagcttacaatagagcctggtaaggttatctcctggctctggcttcactaattgctcaaattgatcacaggatagtaccgatgagaccatgctttgaacccaaagtggaccagaagtttggttttccttcatagacatagacctcaactccaattcaggtgataactgtacaaaagcatgttgttagatcaaagtaaaaccaacccttttactagaaaatcagctcagaggccgggcgtggtggcttacaacttgtaatcccagcactttgagaggccgaggcaggcggatcacttgaggtcaggagttcgagatcagcctggccaacatggtgaaaccctgcctctactgaaaatattaaaaaaaaaaaaattagctgggcgtggtggcacatgcctgtaatctcagctactcaggaggctgagacaggagaatcgcttgaacctgggaggcggaggttgccgtgagcaaagatcgctccattgcactccagcctgggcagcaagagcgagactctgtctcaaaaaagaaaaaagaaaagaaaagaaaagaaaatcagctcagagagttaatgggttgttaatgttttctttatagataaagtacagcactaatcctaatccaataaatgatagtgaaacaaacaaaaaatttttttacaatgacatccctctctcaataattatacagactgtgagttcctgctttttatcttatagagtttacaaatttgagctaaagtttgtcaagtactaagagaatcttgacaaagcaagctaaaactgtcgatgcctgtttctcagattttgctgaacactgcatactttatttttgagctgtgaggaaacattcttgtaatctgactaaaaacccctttcctttcagagcaaaatggagccatctaccttccaacaccagatcgatgattgcagatccctcttttccagttctccttcctctaggagccatgttatcctctgtcccccatagagtcaagcctagtgcttgaaggtcctgacgacacccacaacatacatgagagtaatgggattgagcatttatggcagcaacagaggagccacaaaatgttctttgttctttggctccaaaaagactgtcagctttcagtctcttttgatggactgttttatcagagttgactttaaatacagcttgtctcatgacacaacgcttccctacattctatttgtcaatgatgatttgcaactagttggagattctcagagcaggaaggaatcttttcaaccagagcaggaactgtcttctgcaatgccttggacttgagcctccagcctccacttgaacaccatgtgaagggaacctcagtacttcataaaatggcctttctcattcatctttcatgggaacatttattgtacaagcgctttgaatatcatgggcaccatgactgtgaccctacaggtaggattggatcactccatgagagtagccggcaggtttctacaatggcctgggaatggactgattatttttatacattttctggcctgagagaaagccaaagtcccctgctgttcacagcaaccctgcctgggagcttggaatcttggtaatctgcccggttggatctatggaggtagtctcaccctttttgtcttttgtgggaaattaagagaaataattatcagacatatcatcacctccagtggaactacagagacctggacccagctgcactattttaatgtaaaaataacagtatggccaggtgcagtggctcacgcctgtaatcccatcactttgagcagccaaggcgggcggatcacgaggtcaggagattaagaccatcctggccaatatggtgaaaccctgtctctactaaaatacaaaaaattagctgggcatggtgttgcgtgcctgtagtcccagctacttgggaggctgagacaggggaattgcttgaacccgggaggcagagattgcagtgagccgagatcacgccactgcactccagcctggcgacagagtgagactctatctcaaaataataataataataataataataataataataataataacagtatatttggtgtcaggagagggctcaattctcatttctgcctttcctgtgctggctcatggtagctgggcatgacttgccttcctacataggttgtcttcatacatatgcactgggaatcaataaaagcccatggtgagaatgaacatccccttaatgttccttactatccccaacccctgaggcctcacctactgccctgccatgtggagctacttgccctggggctgccagtcacacattcctcggtcctacttctctgaccccgtttgactctgcacctgagccctaatgcttacttcagtgacctgaactttgacaagtggcttttgtcctgcacctcaggtttgacctctgctctcccttgaccttgactgtgacatttgacctttggctttaatcattacagcctcagataaaggtaccttcagcccgggcacagtggctcacgcctgtaatcctagcactttgggaggctgaggcaggcggattccctgagctcaggagttcaagaccagcctgggcaacacggtgaaaccctgtctctactaaaatacaaataattagctgggcatggtggcatgtgcctatagtcccagctacttgggaggctaaggcaggagaatcacttgaatctataaggcagaggtggcagtgagccgagatcacaccactgcactccagcctgggcaacggagcaagactctgtctccaaaaaaaaaaagaaagataccctcagtgtgccaggcctctaagagctcacctgccaggcttcctccttgctccactgtcccatgtaattccatatatgaagctaccactgtacatctctcttttccggtgcctgttgagttgcatagaagcacagttgtgtttattttgtttttagggttgccatgggcaatttccgtgccacttttaagcagtgttgcactgtgaagagaatgtaggcaagtttatttctggaatggtttcttcttacaatcagaatagttaggatgtaatatatttttgggtgggcatttaaagtgaaaaggtacatatttacatagacacaggtgataatgtatctatgtaaatgccttttgattctgcaactgcaggatactctcatcaaagacacagataaaaagcctctgtgtttccaaggccttgccctacacctaacacataatatgtccaaatggatgaagaggaggcaaggacaaggatgtgatgacaaaacattctgttatgcacttgtagcatttatgtttcttcctgggggattttataatactaaaagaatcataatataaagagatgattaaaaaaaaaatactgccgggcacggtggctcatgcctgtaatcccagcattttgggaggccgaggtgggcagatcacctgaggtcgggagttcgagaccagcctgaccaacatggagaaaccctgtctctaccaaacatacaaaattagccggggatggtggcgcatgcctataatcccagctactcgggagtctgaggcagaagaaccgcttgaacccgggaggcagaggttgtggtgagccgagatcgcgccatcgcactctagcctgggcaacaagagtgaaactccatctcaaaaaaataaaaataaaataagtaagtaatacctaaaattctgcaaccttcattttactatagatggttgaagattatattacttcttaattgttttagccttgttattgcttcattacttcatggttgttgagtacagatgctcagtaatcataacctatgaaatatttgacaccatgatctaaacattaaaaacaaataactgtgctattgccacagctatgttttggctttgaattttctttactgaatattttggatcaagaacactagatgagaaacctgttcaactctgttcttttttttttttttaactccactgtatttattacctgtttttgttttttttgtttgtttgtttttgatgtgcatatagaccaagatgtggtaaatttaaatggcagatgtttttgatgtggtacatttaagggagagaaagcagtttaaagagcagggtgaaaaatccaacaagactccatcgagagtttctgagctctcccatcaggggccagtcctcctttcctctctcctcttactcccatgatttccaagttgtgatcctttccttatttctgaggaatgacttggtttctcctcttctttttttggcctgagagaagatgtttttgcacttgtagctatgaggaacagattgtccactagggaggccagctgatcattttctgccagagtcacacagagcagtcacaccttattttgaaaaccactgtctggggtctttgtcctcacatatgcaggtctagtgtccccacaaagtgatcagatggatatataaagtggagtgccaatgtattaatttactgtgagaaacacaattgctaagtgggtcagatatctgtctcagctggtcagtacaccttccagcaggaaaatctacataagaacaactaaatcacaatctgtagagtgcttgatgaccccagaattggtgcaaggggacacattcttgcttgttagcacctgctctctggagtttgctattttctcacacacagtgtattagttcacagaatgttctccaaggaggacagggggctttgcccatagccatgtgctgtgggcagcagagctaggaagaagcacaggcatctcccagcccaggtgtttcccacttaactgcattgcccttttcatcttttttttttccccaatagcttcaggacattcagtacattgtgctttttagaggttgatgattccactgcctgagctgccttcacctctctttctttggaaattgccatctttgagcattgtatgtctctgtaacatctctgcatctccttttcactctggcctccctttctccattgtccttctagcttctggttgccccaaaccccacagactgtgtaacaaaacccaaaacctattggtttaaaacaatacccattttattttctttcatagtttctatgggtcaggaatttggatatggcttgggtaagcagttctggcttctcatggagttggaggcaagtggtggctggaacagaaatggggcagccaggggtggtggccaggcatcagctacatctcctccatgtagtctcaggaactctccatgtaatctctctgtgtgggttgggcttcctcacaacatggtggcctcagggcagtcactgcttacatggcagctagcttccctcagagtgagtatcccaagagatcacagtcaaagtgcatagcatttatataatctaatcttggaagtcacaaaatgtcattcttgtgatactctcattggtgaagaagtcataaaatcctgctcaggttcaaaaagagggtgtatagaacccaacactcaataggaagattgtcagagttacattgtaagaagagcatgtagttgggagatatcattgtggccattttgggaaagatgcaacatgtcacaatgtcatgttctccatcgtctccccgttccaccttgtactggtttccaagggtagtcgtttaaaagtaccacaaaaactgggtggcttggaacaacagaaatttattgtttcacagttctggaggccagaagttcaaaatgaagtgttggcagaaacatgctgcctctaaagggactgggaaaggatctgttccaggcttccctcctatcttctggttgttccttgccttctggctgcgtaactctagtcttcatttggtgttctccctgcatgcatggctttgtgtccaaatttccttttttcatgaggccatcagtcatactggattagggacccactctactactgcaggatgacctcaccttcccaaattacatctgcaacaaccctatttccaaagaaggccacattctgaggtactgggggttataacttcaacatgaattttttggaggaaacaattcaactcctaacacatctctacccaacctctgtaggttccctcaatccaccaaaattttttggctccactggattatctagcagttaggaaaccaagatcattaaatgaattcaccgcaactacagtgagactgactaccttagcttacctctgtgaaaggagttaagccaaaggaatctgtggaattttggagagtttgggagcatttgggggcaggaggcaaatgttcttcctttaaatcacaacacttagttctcttccatttataagactcacccctccatcccaacccctgcaccacaggacaaggaagtgttcttggtcttcaactttcatccctgatggtgaaagcagttgctcctgacctatttgcccaccagcttctcctctggagcctgaggcttctgatgcctgcctggctggttctcagtaagaaggtcaagttcaaccagaggggagatgctgatgcctttcagtacttaaatatgagttcagaccctggggcctggacataagatttggggtcccctggatataagatttctgaaaacactcagactgtggagacccctgctgagggagaagccccaaactgtggcttcaggggaatgcaccaaggctctcattgaggccaccttctccaacaagctcccctcctgcttccccatggctggcatggctgaggaaaaaggacactgagcacagcccgtgcatgagcggcttgccatgcaacaggataaaacccataatgccactcagcaagccttggttgtaaatctagtttgattacatttgtaatcaaatgatggccatttgttctgtttctggtttgtgaaccaactgaagacataagcagggcctcagctaacccacaaatagcacatgtgtgcaaactggaaaaatgaacccttcttctgggaggacgccagcccaggccaggtcacccggcttggccagcagaacacagagtagattttggtcccgtttgttccccagtggggtatctatccttgtgcagggcacaagcctacatggtggctctggtcatatcattagaaaatagacagaaatgggctgcacaccagaatgaatgaattgaattgaaagggaggagtgatggtggaaaaaaaaacaagtcaattcatttagactggtagaaccagaaccactgtgtagtacatccaaacggttaaaattccctggaagatgttacataatcctatcatggtgtttatttatggaaatctattttaaaaattttatgtaatactgcacagtctgtttgcatgatgccttgtacgtagtagcaactcagtaaatactttttgaatgaactagtatagtattttaattagctagtcttcatgtactggtacaaaagaacagtgtcatcttacagctgaagtcatagaggggaaatatcccactcaagatcatataacattccaggtactcaggatgaatggtttgaggactggtctgaattcttcaaaggtttcagctgtattaacattctccatctaataaactttatcttgtcattgca

SEQ ID NO: 1244 - DNA, 28515 bp, Homo sapiens; identical to SEQ ID NO: 1243

SEQ ID NO: 1245 - DNA, 28515 bp, Homo sapiens; identical to SEQ ID NO: 1243

SEQ ID NO: 1246 - DNA, 28515 bp, Homo sapiens; identical to SEQ ID NO: 1243

SEQ ID NO: 1247 - DNA, 940 bp, Homo sapiens
aatgccttctatcaatgacacccacttctatccccccttcttcctcctgctaggaataccaggactggacactttacatatctggatttctttcccattctgtattgtgtacctgattgccattgtggggaatatgaccattctctttgtgatcaaaactgaacatagtctacaccagcccatgttctacttcctggccatgttgtctatgattgatctgggtctgtccacatccactatccccaaaatgctaggaatcttctggttcaacctccaagagatcagctttgggggatgccttcttcagatgttctttattcacatgtttacaggcatggagactgttctgttggtggtcatggcttatgaccgctttgttgccatctgcaaccctctccagtacaccatgatcctcaccaataaaaccatcagtatcctagcttctgtggttgttggaagaaatttagttcttgtaaccccatttgtgtttctcattctgcgtctgccattctgtgggcataacatcgtacctcacacatactgtgagcacaggggtctggccgggttggcctgtgcacccattaagatcaacataatctatgggctcatggtgatttcttatattattgtggatgtgatcttaattgcctcttcctatgtgcttatccttagagctgtttttcgccttccctctcaagatgtccgactaaaggccttcaatacctgtggttctcatgtctgtgttatgctgtgcttttacacaccagcatttttttcttttatgacacatcgttttggccaaaacattccccactatatccatattcttttggctaacctgtatgtggttgtcccacctgcccttaaccctgtcatttatggagtcaggaccaagcagatccgagagcaaattgtgaaaatatttgtacagaaagaataa

SEQ ID NO: 1248 - DNA, 74989 bp, Homo sapiens
cacatgccaacatgtgacgcgtggaatctacgccagccacagcagagaggtgggggttgtgaccggagttagatgccagcgcagaagggacgtgagcccagccgaggtaccgctgaagaggaatcaattttggtatgcagataatcactgggctcatgggtcttgctctttacaaagaggtatgtccctgtaaagttgtcaggcaaaggaaatgtttcaaacgactccatttcacgaagtctcacctaatttacaattcgttagttgagatgcttgtattcttcgtttctaaaataagacgttgaaccataaagactctagctagctctgcaacctctgatgaatatttcatgcctcattattgtgaaaaatccaaagcagaattggagagaagatgtggtatagggattaggtaagtgaagactggtgcaaagcctcctgggtcgaaattctgtccactgctttgtcattggaaaagttatttaacgtcgtcgtctcagttcccacaactattaaaatggagaggataacaacacctaccttatgctcttgtgaggattaaataagttaccgttaatatatgtaaagcacttaaaagaggaccatgtgtttgctattattatgttatacatacaataaagagtaaacattacctaagttataaagaacttaggcaatggataccaaaagtactaattcctttataataaaagaaaaaaaggcgacaaggcaaataacgataataactgataatggctgggcgcgatggctcacgcctgtaaccccaggactttaggaggcggaggcgggcggatcacttgaggtcaggagtttgagaacagcctggccaacatggtgaaaccctgtctctactaaaaatacaaaaaattagtcgggcgtggtggcgcacacctgtaatcccagctactcgggaggctgagacaggagaatcgcttgaacccgggagacgaagtttgcagtgagctgagatcgcgccgatgcactctagcctggacaacagagcgaaactccgtctcaaaacaaaaaactaacaaacgaacaaaaaactgatcatttattatacacccagaactgtgcttttagcacagttttgttttgttttgttttgtttttgagatggactcttgctctgtcacccaggctggagagcagtggcgcgatctcggctcactgcaacctctgcctcccgggttcaagcgattctcctgcctcagcctcctgagtagctgggattacaggcgcgcaccaccacgcctggctaattttttttttttgtatttttagtagagatgggggtttcaccatgttggtcaggctggtctcgaactcctgacctcgtgatccgcccgcctcagcctcgcaaagtgctggaattacaggcgtgaaccaccgcgtctggccgtattgtctcatttaatcctcacaacagtcttatggaatgggtgctgctatctttgtttttcagatgaggaaacaagctcagagggttgaaatgacttgtccaaggttacaggccagtggaggcttgaacccaggtatttgtaattccaaatgtcatactctgtccacattcattccttgtaacctgcctgggctgtcacagttggtgtggggctagcagctccccagggaccaaaacaggcgcatccccgcccaccgccccgcccatcgtgccagcccgactccacccctgtggctacacccactgccccgcgccttacccactggtgggccacgcccacagcccccagctaggtgcctccgctgtccgggctctagtcccgccctcgcccctccccgcccaccggcctcgcagtcaccgcggacgccaatcttgtgcatggagtcgccattttgctcctagagaggccgccaggagacccggcgctttcttccttctgcagctgaggctgcggcggggccggggctggggtcggggccaggtaggcgggcgggagccagtggcgagcggcagcgagggctggctggctccggcattgcggggcgcaggtgcaaggggcggggagcccgcggcgccggcaggcggacgggtcggggtccctgggtggtggctgcttgggggctcactggggcgatctcgcgcccgcggcccttccatttttccctcccttcttcctctcccgccaggggtcggcgggggcgggggacgggcgtccggtgcctgggctctctcctctccctgaggcgccgctggggagtcgaaccctgatgatgggacctgtggtgagcagccctgaaagcaagcccagacccagccattctccgtccctaagctgacacggagcccctgattttaatttacctggctttgctagttacgaatatatctctcacctcctaaaggatgattttatccaactcagaactcaccccagcagagattgagggggaaccgtgatgaaatttttaagtattctgcttgatgataataatttttctcttatgttaatgttggctccgtttgggtgtttagcttttgaaaggagtatgaaaatgcggaatggggctttggggcttgaggtgtgatctctagtgtttaaaaaatttaattgcacaaatagaaataattcacccacattattgaaccccactaaagcatatcctttttgtccatattcctttcctgctgccctcgtgtgtaccattattactcagttgtgatttgagctcgttccacttaaagtcattcatagatacttttgcgtcgtgttgaatatttattgaatttctattctgtgttttacttaattactttattatggaacctttacacaggtctggtgtacttgttctttgaaaagtcttatgttgaccaccatcactgagcatatagctttttccttatttccttgggataattacccgaagtggaaataccgaatcaaacttctgttttctttctttggcactattatataaattgttttccaaacaaggcatgtttacaatagacatttttcaaaatctgggtatttgtcctattttgctctctgtatgcagaattcagcggggtgccaagtcgttttctgtgtgggttgagagacaggctgtgcagcccactgttgcataggactaactactacaaatcatgctgagaccgagctatttttgctgcttagaggctttgcagccttgagtaagtttcttcatctggaaacctagcttccctgtctaaaatgggtctcattctagtgcttgcttcactgggttgtcataagcattgtgaacactcagatgttaggcatgagttaacattgtgttggagagataagcagagcctgggatcatacaggagtggaagagtaattcggtttagaatttgcccttcaaattctcatcaatattgatattaaaaacagatttccttggagtgaggcacatcactaataaacatacataataagtttttttatttttattttttttgcagagtcttgctctgtctcccgggctggagagcagtggcgcgatctcagctcactgcaacctctgcctcccgggttcaagcgattctcctgcctcagcctcctgagtagctgggattacaggcatgcgccaccacgcccggctaattttttgtatttttagtagagacagggtgtcaccacgtttgtcaggttggtctcaaactcctgaccttgtgatctgcctgccttggcctcccaaagtgctgggattacaagcgtgagccaccatgcccatccaataaacataaatttttatactttttaattttttgacacagagtcttgctctgttgcccaggttggagtgtagtggcgcgatctcagctcactgcaacctctgcctcccaagttcaagcgattctcctgcctcagctgcgcaagtagctggggttacaggtgcatgccaccacacctggctcatttttgtattttttagtaggggtttcgccttgttgaccaggctggtctcgaactcctgacctcaggtgatccgtccaccttggcctcccaaagtgctgggattacaggcctgaggcactgcgcctggccggtttttatactttatgatgccttttagttcatctttcaatttcatttgttaatcattgtgactcattgaagtcaggcattattcagcaatcatttgtttagcctctaccgtgtggcagctgcacagggtatacagcagagaatatcatggtaaaaaatagtctctgctgcctggaccttaaattctgatggggaaatctttttaccaaggttatatctcttgtctggaaggtaaaggctgaggcccagcaaggacaagtgatgtccacatggcctagtagctggaaggcaaacccaactcttcacactcctacttcagccatctttaagtagaaggtatttacacagtagatgctttagagggaagacaacacacttcaatgtgagtcttccccatctgaaatgtgggtgagtggttttgaaatgactgctagtctgtccaaaggaaatgatctctcagtgtggtttcttcattcatgagacttaacattctaaaatcttattcaaaagaggagtatgatttgctctttaaaaggtgctaagattctctgaaaacggtgtgttttcatacatgttataaataattctcacacattctagagtaaatttagaataaacataaagcagttatagctcatggggaaaataagggagtgttctcatttcacactaaaaccttgtgctaacaagcctcctgccagccccatctcgatgattattatgtttttgaggatagtctttataactcttttcttgaagcttggtaaagaacacagccttaattaccaacaggagaaaggagaactaaaactacaagcaggcattatggccgggcgcagtggctcatgcctgtaatcccagcactttaggaggctgaggcgggtggattacctgagcttgggagtttgagaccagcctgaccaacatggagaaaccctgtctctactaaaaatacaaaattagacgggtgtggtggcgcatgcctgtaatcccagctactcaggaggctgaggcaggagaatcgcttgaaccggggaggcggaggttatagtgagccgcaatcgcgccattgctctccagcctgggcaacaagagtgaaactccatcttaaaaaaaaaaaaaagaaaaaaaagaaaaataaacagcccttatgtttgaataacttgtgaagtgaatagtcacaaaacatgactatgttgatagtcatttccaagtggatgctccccagtccactccaccatgtcattttgagggtggtcttaggttaggattctatatagaagcctatatctgaagtctagaacgtcagagaccacatgcagggtgttgcaggccattttaaaccatgagagataaggaaagacttcaggaaatatcctggaaaaaatatacaaaggcaggagagctatcttgaaatagtttggaggccatcctgtggaaaaggaatttgatgtttcccataaatctctaaggagagtacaagaaccagtgggcagaagctgcaggaagaggaatctcagcatgttcttttgtttgtttgtttgtttgttttgagacagtcttgctctgtcacccaggctggcgtgcagtggtgcagtctctactcactgcaacctccgcctcccaggttcaagcgattcacctgcctcagcctcgtgagtagctgggactacaggtgtgtgccaccaggcctagctaatttttgcatttttagtagaaatgaggtttcaccatgttggccagactggtcttgaacttctgacctcaggtaatccgcctgcctcgctctcccaatttgctgggattataggcatgagccacggcgcctggccacagcatgttctaaggaagaatttggaatgatgggccctcagcggatgtgggcatcagaccctggggctgttcaagcttctgttgagtggttccttggcaggattcctacagatgggctttgaacaaaagatttaggagggatgggctgaactacctctaagatctcttcctacctctaaaatactttcattctaagtgttccaactcctatcaggaatcctgctgtactttaaggagcttcttatttgaaggttagggggtgtaaaaaaaatgcccctccccccatggctgttactgtacttatatggtagataatcaagatgttagaagtcagttcataggtagcatgtccgatatgcagggcactgtgttaagtgccttgcagaaattttacagtcacctgtggggtcagttttcacagttgtatggatggcagaactgaggctaagagattttgagtattagataacttatgcaagtcctcactgtgagtttaggggaagtatttcaagatgcaaacatgagtttgactccaaatcctgtatttacaactacaggaaaattagtttgtttttatttattttcctggacctgtaacacccttttatttatttatttatttatttatttatttatttatttatttttctgagacagagtctcgctctgtctcccaggctggagtgcagtggcatgatctcagctcactgcccacttcgcctcccaggttcacgccattttcctgcctcagcctcccgagtagctgggactgtaggcgcccaccaccacgcccacctaattttttgtatttttagtagagacggggcttcactgtgttagccaggatggtcttgatctcctgacctcgtgatccacctgcctcggcctcccaaagtgctgggattacaggcatgagccaccgtgcccggcaattttttatttatttatttttttatttttttgagacgaggtcgcattcccatcgtccaggcaggagtgcagtgaagtggtgcaatcatggctcattgcagccctgaccatctgggctcaagtgatcctcccacctcattttttgatttttttgtagagactaggtctcactatgtagccgaggctggtctcaaactcttgggctcaagcagtcagcccaccttggcctcacaaggtgctgggattagcggtgtgagttgctgtgcctggccataccttttgttcttaaacacacatgtttattggttgagagatggctttagaagtatttaagatcccttccagaatgttgatgattaaacgtattctttctttcttttctttctttcttccctttctttcttcttctcttttcttttcttttctttatttgaaacggagtctcgctctgtcgcccaggctggagtgcagtggcgcgatcttggctcactgcaagctctgcctcctgggttcatgccattcttctgcctcagcctcccgattagctgggactacaggcacctgccaccacgcccggctaatcttttgtatttttagtggagacagcgtttcgccatgttgtccaggctggtctcgaacccctgacctcaggtgatccacccacctcggcctcccaaagtgctgggattacaggcgtaagccactgcgtggccttttttttttttttttttttttaattttttagatggagttttgttctcattgcccaggttggagtgcagtggatctcagctcactgcaacttctgcctcctgggtttaagcgattctcctgcctcagcctcatgagtagctgggattacaggcatgtaccaccatgcctggcttatttttatttttatttttttgtatttttagtagagatggggtttcaccatgttggtcaggctggtctcgaactcctggcctcaagtgatctgcccacctcagcctcccaaagtgctaggattacaggcgtgagccactgtgcctggccgtatataatttttatggaggtcacatgtataaatgcatagaaaaagtcttatgttgtccctaccaaactgataagaaccctcacttctggggaggacctgggatcgaggctggtgactttatccttaactatcatgtttcaggtttttttttttttctgagacggagtctcgctctgttgcccaggctggagtacagtggtgcaatcttggctcactgcaacctctgcctcctgagttcaagcgattctcaagcctcagcctctagagtagctgggactataggcagccaccaccacgcccagctcatttttgtatttttagtagagacagatttcacccttttggccaggctggtcttgaactcctgaccttgtgatccgcctgccttggcctcccaaagtgctgggattacaggtctgagccaccgcgcccagccatgtttcaggtttttatagggaggatgtgtttgtgttttacttgtataattaaaatttgagaataatgaaaaagattagcttagtttcagctcattgatgatctacaccagccttcccagaggtcccaggtgaacatacaactgtggaaatgcagtgggcttgctgagaaagggcccccctgcccacagcctgctggattgttgctgttcctcccatctagcatctccattatgtgatgaggacactcagcaatgatgacgactttttttttttgagatggagtcttgctgtgtcgccaggctggaagtgcagtggcacgatctcagctcactgcaacctctgcctcccaggttcacgtcattctcctacctcagcctcccgagtaggtgggactacaggcacgcgccaccatgcccagctattttttgtatttttagtagagacagggtttcaccatgttggccagggtggtcttgatctcttgatctcgtgatctgcctgccttggcttcccaaagtgctaggattacaggcgtgagccaccacatctgaccagcactgatgatttataagccagggacctttttatttttggcccactgccaaaatttgggtgtgaccaaaactgtcatttgggtggtcgcttaagtgtccttcaaggtgattatctagtcagcccgtgttccacttgaggaaaatgaagatgagaggtcagttttagacatgacacagggcagctgaaaggccgggaaaggttttatggtaaacaaggattacaggaaaagctgggtgtagatgggtcatttattctttgtctaaggattaatcagtccttgttctcgctaatggctctgccatttttctgtgtgttaatccaggaggaattttgttgtcagagaataaaaggaggttgtccataattgactttaagcagcaatcagtaaaacattgagctcttcagctccgcctttcttgtaagtttatcatttcttcttagtggttgtgaacatcatgtgataatgtatttccataaatttaggaccctgaaatccaactgaactttctgtttgtccatatatatctaatatttaaaaaatactattaggatggaaactaatttccttcagctgaagtcatttcctttaaaaaaaattcattcaggtatatttcatatcatatggcagtttttaataagtattatatccttctaggctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagtgagttataattgtaccattaaaatctatattcattatgtgatgctttaaatttgataatcagattagcagttattgttaaatttgaaagcagatattttataattataaaataattatatctttttttcatcatgtatcttttttttcatcatgcaagatgttcatgtagtatgtctcatctgtatatattaagggctattctttttgtaaactatcccatctccctacatattctttcagcagacatttattgagtgccttataagtgccagggattgtgttagatgctatatatatatataattatttgagtataaagcacactggggccaggcgcggtggctcacgcctgtaatcccagcactttgggaggccaaggcgggtgtatcacgaggtcaggagattgagaccatcctagttaacaaggtgaaaccccgcgtctactaaaaatacaaaaaattagttgggcgtggtggcgggcacctgtagtcccagctacttgggaggctgaggcaggagaatcgcttgaacgcaggagggttgcagtgagctgagattgcaccactgcactccagcctgggcaacagaacgagactctgtctcaaaaaaagaacattaacatgtatattatatgaaataacttatagcttatagtttagtataattttagatatttattaaacaaatattgtacccctactactgtgtactagaccttgatctagatgttggggattatcagtgagtcaagatccatcctttttatgaaatttacattttagtatgggagccaaacagaaatcaagtcaacaaaacaaacaaggtaatttcagatgatgtcaatgctatgaagaaaactgtgtgaaagtaatgatggggcaggttgttctgctttagcatgtgtgctgaagtgcttttaaactgaagggatggtgtgtgagttgagaaacctgaatgagccaccaagtgaaggtctggaggcagaacccccccaagcagaggggacagcagattccaagcctctgcagcatgcaggaggagttcttggtgtgtctcaggaacgtgggctggagtacagagtgtccaaggaagatggctagtgaggcaggcagagcgggactgcatagtccttcctggggagacatggggttggggtgaggggctaggtaatggattgatgtaacaatttaatgttgactttaaattttataagaagaataactttattttattttactcttatcgatttacgagtctccttaaatagtaaagatactgggtttcttctattactttttcagctttttccccctttctcttctctaggcggctaggggtggagatgggcaaagtgcaggtttaccaggaacctaacagaggtgagctatcttgggcatgtggaacattgacctttttgtgaaatgtggcatattggctccgtccttcatcctttactattgaaacgatttgattcagttgtacatttccattagcaagaagtcaggcaggcaaggtagaacagagtggttttttagctctcactaataccagctagatatctaaccctggtgcaagtcatttctggggcttgaactgcagttctgagacttcattcagtaaaagctgcagacatatttgaaccagctggtcaactgaatgaacatgagctcaactgttgcttaaatttatgtcaccttaggaaggatgagtaaatcctgtcaccttagacaggatgactaaatcctgtgtgaccgcagttttagttagtctttatttgcacctaagctgccttgggttagacttcataaaatattgttaagaaatactttttgctaattgatacatgtcattacataattctcccaagttgtaaaaagaagtgttatttaacctttgtaggtccaggtgtgctggctcatgcatctaatgccagcactttgggaggctgaggcaggcagattccttgagctcaggagttgagaccagcctgggcaacacggcaaaaccctgtctctactaaaaatacaaaaattagccaggagtggtggtttgcacttgtagtcccagctactagggaggctgaggtggaaggatcgcttgagcccaggaggtggaggctgcagtgaagtgtgatcataccacagagtgagaccctgtctcaaaaataaataaataaataaatagaaagtgatctttgtaatttctttagcaatggtggatatttgaaattattttaggccaggcgtggtggctcacgcctgtaatcccagcactttgggaggccgaggtgggcggatcacctgaggtcaggagttcgtagaccagcctggccaacatgatgaaaccctgtctctactaaaaatacaaaaatttgctgggcttggtggcaggcgcctataatcccagctcctgggaaggctgaggcaggagaatcgcttgaacccgggcggtggaggttgcagtgagccaagattgtgccattgcactccagcctgggggggaacaagagcgagactttgtctcaggggaaaaaaaaaaaaaaagaaattattttagcaggagcgatggacagcttgcatgggcttgagagttacacaccttatccttgacaagttatttaacctttctaaactataaataaactgtaaattagggctgttttgaggattaagtgggataacttgtgtgcctaccagtttttggcacacagtaggtgctcaatatatacttattcctgttccttttccactagaagatttaaaaaaacattttttttttttttggtagaacaagggtctcattatgttgcccaggcttatctcaaactctgggcaaaagcagttctcctatttcagccccccaaagtgctaggattacaggtgtgagccaccaggcctggcccctctacaggattttatcaaatatttacatattataaagcctacaggaggctttgataaaaaggcacaagttttgctgttcccatgtttatctccgttcctgcctcttttctgtctcccaagatccctatgtggcgtcagtagggaaaaagtataattaaactctgcaaggagagtttggagaagattcttcctctagaggggattgaatgatgttctttgtctggagtctaggagggaaggtgaaagggagaagcagtggcataagactccaggagactggtccactctccaagtttctgaataaagggagagaaaatacttggtgtttattgggaaggaaggaagtaatatttgtgaatttcttactgttaccagatactgaaaaactgagttcaggagttcagggattgatgttaggtacgaggtccagtttgaatccagatctccctgactctaaagctcattttcttttcttttcttttcttttttttttttttgagacagggtctttctgtgtcactcaggctggggtgtagtggcatgatcagggctcactgcagcctctgcctcctgggctcatgtgcttctcccaccttagcctccccagtagctggtactacaggtgggcaccatgctgccaggctattttttttttttttttaaatatggagtcttgctctgtcacccaggctggagtgcagtggggcaacctcggctcactgccacctccgcctcccaggttcgagtgattctcgtgcctcagcctcccaaagtgctgggattacaggtgtgagctacacacacacacccagccataatttttttttttttttgatacggggctttgccatcttgctcaggctggtaaagctcattttcttaacatcataccacatttcttttgtaaacttgtattctgttttttccaacatttttttttttctcttatcctcacaatctgttcccattttgctactttttttttgtgtgtgtgtgtgtgtgtgtgtgagacagagtcttgctccattgcccaggctggagtacagtggcgcaatcttggctcactgcaacatccgcctctcaggttcaagcgatactcctgcctcagcctcccaaataggtgggcttacaggtgtgtgccagcacgcccggctaattttttgtgttgttggtggagacgggctttcaccatgttggccaggttggtctcaaacttctgacctcaaatgatcatccacctcagcctcccaaactattttcctacatttttaatgaaaatgttcaaacatataaaaaagttgaaagaatagtacagtgaactaccgcctagcttgaacagttaacattttgccatatgaatatgtatgtggcgaaccatttgaaattaagtgcaggccgggtgcggtggctcactcctgtaatcccagcacgttgggatgctgagctgggtgaatctcttcagcctgggaggtcaagactgcagtgagccatatttgcaccactgtaccacagcctaggcaacagggcgagatgtgtcccaaaaaaagaaaaaaaatgtaagttgcagacagttaatccttgaatacttgaccatgcatcctctaggaataattactttcacctaaataaatatgataccattatcacatttaaagaaattaactacaggcagggcatggtggctcacacctgtaatcccagcactttgtgggggtcaaggtgggtggatcacttgagaccagaagtttgagaccaacctgggcaacatggcaaaaccccatctttaccaaagataaagaaattagccagggttggtggcacacagctgtaatcctagctacttgggaggctgaggcaggaagatcacttgagtccgggaggtggaggttgcagtgagctgggatcacgccgctgcactccagcccgggcaacagagcaagaccttgtctcaaaaaaaaaaaaaaaagaaaaggaaaagaaaattaacttaacaattaaggacaattctttttttttctgtggcctcaagtgatctgcccgccttggcctcccaaagtgctgggattacaggtgtgagacaccgcacccagcccaacaacaattctttaatcatctaatatatggcctatattcacatttccctaattgtcctaaagggtcttttattttttatttttttgagatggaatctggctttgtcacccaggctggagtgcagtggtgcgatcttggcttactgcaacctctgcctcccaggttcaagcagttctcctgcctcagcctcctgagtagctgggattataggtgtgtgccaccaagcccagctaatgtttgtatttttagtagagacgaggtttcaccatgttggccaggctagccttaaacacctaacctcagattatccgcctgcctgggcctcccaaagttctggtattacatgtgtgagccaccgtgcccagcctaaagggtcttttatagttgttttttccaacacctccaccccaaaccaggattcttagttcaagggattttttttaaaaaatatctctttagtctcttctattttagaacaatcccctcacctcttccgttttcttcctgtgacagtgaagaggttgtcttgtagaatgtcccattatggatttgtctaattgtttctttatgactgatcacacatattttgagagtagggatattaggtcttatttatctttgtttctcacaacatacaatgttttgtacctaatacattctgaattgataattgatgctgattgaatgagtatataattttcttttttttttttttttttttttttgagacggagtttcgctcttgttgcccaggctggagtgcaatggcacaatctcggctcaccgcaacctccgcctcctgggttcaagcgattctcctgcctcagcctcccgagtagctaggattataggcatgcaccaccacgcctggctaattttgtatttttagtagagacggggtttctctatgttggtcaggctggtctcgaactcctaacctcaggtgatttgcccgccttggcctcccaaagtgctgggattacaggcatgagccactgtgcctggcctatgattgtctataaagatactgtgctcaggctgggcacggtagctcacacctgtaatcccagtactttgggaggctgaggcaggcagatcgcgaggtcaggagatcgagaccatcctggctaacatggtgaaaccctgtctctactaaaaaaatacaaaacagttagctggatgtggtggcgggcgcctgtagttccagccactcgggaggctgaggcaggagaatggcatgaacccaggaggcagagcttgcagtgagccaagatcgcaccactgcattccagcgtgggcgacagagcaagactccgtctcaaaaaaaaaaaaaaaaaagttaccatgctcggagtggtacagcactcaactgtttgtatatataaggggtgagaattatacatttacttatttcaagtcagaaatgtaattctctcttaaagctgtgttttaaaaagtgattaatggcagtatgtgtattatcccttgtaacatctaaagcctactgagtcttataacagtttgagttgccatattctattacattagggaataatacagatttttttgtgtattttgaaaaatttgaactatatgcctttccctctcttctttttccttttcctgccagaaacaagagtacaaattcaagagtctgtgaggggaaaagatgttttcatcatccaaactgtttcgaagtgagtatccagcaaaagtgttgctttctgggtttcagtttaggcatgagtgtttaaaataatgatagatggctagccaggaagagttataatagtcttaaaattagtatatcttaccaatttagaatttagaaaactaagttttctgacataactgctgacttttacatgttctttcagtgtttttccttctttctttctttttttttttgagacaaagtcccactccttcacccaggctggagtgcagtggtgcaatctcagctcactgtaaccacctcctcccaggttctagtgattctcttgcctcagcctcccgagtagctggtactacagttggcgccaccacgcctggctaatttttgtatttttagtagagacggggtttcaccatgttggccagactggtcttgaactcctgacctcacgcaatctgcccgcctcggcctaccaaagtggtgggattacaggtatgagccaccgtgtccagccactcagtgttcttaacgggtggaaataaccaagtattggagtagaggctctttttttttttttttttttgagacagaatttcactcttgttgcccaggctggagtgcaatgacgcgatctcggcttaccgcaacctcagcttaccgcaacctctgcttcccaggttcaagcaattctgcctcagcctcctgagcagctgggattataggcatgtgtcaccacgcccggttaattttgtgtttctagtagagacagggtttctccatgttggtcaggctggtcttgaactcccgacctcaggtgatccacctgcctcagcctcccaaagtgctgggattacaggcgtgagccactgcgcccagcctggagtagaggctgttaatgataatagtatacattaagtttcctaacaattaacagccagaattttgtaaaacttgcaaggaagcatttctagttccctcctctccccaaaagaaacagaggctaggggaggagacctttcttagttggggttctttaagcttttattgcatataaaagtgatcattatttactgttttattacataaattagctgagaggataaaaaactgtactgaaggaatgtgtattcctgtctggtgtgacctttgacacacctgtgttctggaaattgtttggtcacatatgtttaagctaggtatagaagattcaatgcagcaaggctgtctctggcactctggaagggagggtgatcacctggagccctactttttttttttctttttcttttttctaagaggtagagtcttgctctgttgtccagtctggagtgcagtggtgagatcataactcactacaacttcaaactcctgggctcaaactatcctcctccctcagcctcccaagtagctgggactacaggcatgcaccagcatgctcacctcgttttttcattttttgtagagatggaggtctcactgtattgcccagctggtctcaaacttttggcctcaagtgatcctcctgccttgacctcctatattgctgagattccagcaatatagaaggtgagcctatcacacctggccttaaagccccactttccattgtgtgtttgtccacaaatgtccctaaatgcttctgtgtatgaagttcttcgctcagaacaatttttaatgtctagaaatcagtttgtctagtgcattattttttagcttagagagtctgaaagttgctgcatgcttaatttgtgtatatacatatataaaaccaacgaaagggaaaaagaaggccatttcgggagactttagtcttggaacacacatttttttcacctaaattttgaacattttctctcctggtctttggtttattgggatgaagtcacaaaacccccatctctcctgggaagaggagtggcaggggagacctgtccttgcatcctatagccctggcaaacgggtgtgctctgaaggaggaagggtgtggagggcctttgccacggtgccctagcttcaccttctgctgtgacacccaggattctcagcagagctggaggtgggggcacggagcgccaactgcccctgctgctgctgtcctctttcccctttcccacgtctgccaccaaaccagggtggaagtggaggactcacctgtgcccacatcttaaccctttacctccagcatcggggtagggaaggggcgggcacagaacaacttaaacggcttctggctccttggtttctgtgtctgtggtacttttatgtccttacagacaagtgtgattccattggataaatgcacagaggttgtgtggattacccaaggggatgggtaggcattgagggcacccctggacttagaatttaggacttcagaagggtgactgctgatccttctcattttcaagtccttctggttgtttatttttgtacatttcaatacttatcctgtgcccctgtcttttgtcagtttcatattcctctaatcagaatcactcagcacccctttcattttctctccgtgtctcattttgcattgttccatacctgacataagcttgtgttaactcgggttctcagtcttgtccatgttgcagagtctggacgtcatggtcttctttgtgaaataccatgaaataacatttagtgttgagggccagatgtggtggctcatgcctgtaatcctagcactttgggaggtcgaggtgggcatatcagttgaggccaggagtttgagaccagccaggccaacacggtgaaaccctgtctttactaaaaatacaaaaaattagctgggcatggtcatgagcgcctgtagtcccagctactcaggtggctgaggcacgagaattgcttgaacgcaggaggcagaggttgtagtgagctgagatcacgccactggattccagcctgggtaaaagaacaaggctccatctcgaagtaaaaaaaaaaaaggctgggcgaggtggcttacacctataatcccagagctttgggaggccgaggcgggcagatcaggagttcaagaccagcctggccaacatggtgaaaccctgtctctactgaaaatacaaaaattagctgggcgtggtgatatgcgcttctaattccagctacttgggaggctgaggcatgagaatcgcttgaacccaggagacagagggtgcagtgagccaagatggcgccactatactccaggctgggtgatagagtgagactctgtctcaaaaaaaaaaaaaaaaagcctgtaatcccaccactttgggaggccccaggcgtgcagatcacctgaggtcgggagttcaagaccagcctgaccaacatggagaaacgctctctctgctaaaaatgcaaaattagccgggcatggtggcgcatgcctgtgatctcagctactcgggaggctgagacaggagaattgcttgatcctgggaggcggaggttgcggtgagccgagatcatgccattgcactccagcctgggcaacaagagcagaactccgtctcaaaaacaaacaaacaaaaaaatgatttagtgttgtcagatacatcttatacttcattttactacagattagtgctagcactaaaaataaaagagaaatttaaaattaagaaaattccatccattaactgaagttttcctgtatttcaaacaagactgtccttatctgagttcagtaatggaaagccttgttcctccactcttatccttcccatagaatacttttctgaaaatctttttttttcctaagttaattaacagggtgaaagtctcttttaactcatcagatgtcagacttgttgtatagtgacagagaacctactcacctgaatgttctgtgtttccattcactccttctttcattaacaaatacttattttgaatgtctacaatatgtgaattacagttagttacacgtatgcaggatgcctccatgattaaaacagagaaagtccttgtccttgtggagtttatattccagtggaggaagacataaagtgagcataataaagacatagattatctagaaggtgatgaatggtttggaaaaaaataagacagcatggtgagatgatagtggtgagagggcagagagaggcagacagggtaggcctcattgtggaggtgacatttgaacagagactagagaaggtgagggagagtcaggtgactaggtggggagaaaagcattgcaggcagtgggaacgcctagagcaagccccttagcggtgtgagctgctgtgggaggactgaacagggtcaggtgtggccaggcaggaggggaggggcagatcctcaagtttggactggagttgtaaatttgagagttgccaccatctatgaagctgtgaaattagatgagaagcccaaaggacgagagggaacagaaagagaggacacatgagcaagtcctgggacgtgaggctggggagaagaggaaccagcaaaagaaaccaagggtggaaggaggacaccagagaggggcattctggaagccaagtgaccgtggacatggccgcatggaggccactgatgacctttatgaaaacaaagcttcactggactatttgggagagactgagagtagataaattggagatagtgtaagatgtacagcaaaggggagcagaggggagagtggttatgagtcgtgttaatggaagtaacagaatgtttgtggccgatgggttatcagtggtggaggcaggagaggagagagaattccttacataggtgtgccatttggagggattaattttagggccactggcatggaaatttcctctgactgatgactgagggcaggccgactcctggggcacagatgcacatagtgggagcttgtggacacgctcctctgagagtacttaagtagggtggtcagttgagagcagatgatgggggatcttatggaggcctgagaaaagaggaatttattggttggtttttttctgccttgcaccttaggttgtataaaggcatgagtaacacactgctgacactttttggaacagggaatactgtgttgtagatcccttgatgagatttgctgtgtctttgttacagggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtaagaatggcagatgtttcacaattaattgggggcctgggagttttatttatttattctctcttttttaagacagggtcttgccctgtcacctaggctggagtgtagtggcgtgatcatagctcactgcaacttgaactcctacagtcaagcagtccaccagagcctcccaagtagctaggactataggcacataccaccctgcctgctaatttttaaattttttgtagatactgggtcttactatgttgttcaggctggttttgaactgctggcctcaagggatgtttctgctccagcctcccagggtgctgagattatagtcatgaaccaccataccctgctggagttttatttttaccttagaaatatcaaagtaatggctgggcacagcagctcacgcctgcaatcccaatgctttgggaagctatgtgggatgatctttgaactcctgggctcaagtgatccccctgagtagttggaactatggacatataccaccgtgcctgcctagataggcatatattggaaaagatacatattattctgtgtcaggcattttcaggtaacaacctaagtatttttcctgtgtttctaaataaccttcatagttgttattgggtatttgtgtcaatatatttgtgtttgtgtgtgtgcgcgcttgtataagtgtatatgattttatttatttatttatttattttgagatggagtttcgctcctgttgcccaggctggagtgcaatggcatgatcttcgctcaccacaacctccacctccccggttcaagcgattctcctgcctcagcctcccaagtagctgggattacaggcatgcgccaccacgcccggctaattttgtatttttagtagagacagggtttctccatgttggtcaggctggtctcaaactcccgaccccgcctcagactcccaaagtgctgggattacaggcgtaagccactgcacccggcctatgatttttttattttaatttttattctgtttatttattttttgagacggagtcttgctccgttgcccaggctggagtgcagtggtggcacctcggctcactgcaaccactgtctcctgggttcaagcgatttttgtaccttagcttctctagtagctgggactacaggtgcctgccaccacactcagctaatttttgtatttttagtagagatggggttttgccatgttggccaggctggtctcgaactcctgacctcaagtgatccacctgctttgggctcctaaaattctgggattacagacacaagccaccatagccagcctgaatgtatatgattttagaaggtatgtatcacggagcatttgcacagagtgaatagaataaaagtccccatatcactgcattttaagacaggtacttactgtagaataaacctttttttttgtttgttttttgagacggagtcttgctctgttgcccagtctggagtgcaatgacgtgatcttggctcactgcaacctccaccacccgggttcaagcaattctcctgcctcagcccccagagtagctgggattgcaggcacacaccaacatgcccaactaattattattatttttattttttatttttgagtctcacctgtcatccaggctggagtgcagtagcgtgatctcggctcaccgcaacctccacttcctgggtttaagcgattcacctgcctcagcctcctgagtagctgggattactggcgcccaccaccacgcctggctaatttttgtatttttagtagagacgaggtttcaccatgttggccatgcttgtctcgaactcttgacctcaggtgatccaccttcctcagcctcccaaagtgttgggattacaggcgtgagccaccacgcccagcccagaataaactttctaagatagtttttcagtaaaggcaaacgtaaaacaaacatttaaaaactaggcagggtgtggtggctcacgcctgtaatcccagcactttgggagaaccagggggcgatcacctgaggttgggagttcagagcagcctaaccaacatggaaaaaccccgtctctactaacaatacaaaattagccgggtgtggtgacacatgcctgtaatcccagctactcgggagtctgaggcaggagaattgcttgaacccgggaggtggaggttgtggtgaaccaagatcatgccgttgcactccagcctgggcaacaagagcaaaactccgtctcaaaaaaataaaaataaaattaaaaactcaacccgaagcaacctcaggagcctaccccattgtaaacactatgacaggcagctggtgaggagagcaggcttgcctgctgaatcttcaggaaagggcccatcttctctaccagccttgcttgatgggcctccagacttactttcctgttcttttgggcaagtaatgctttaaacaatttttcatactgaattttccttacacttttctggtgatcgttacaaaggtggtgaaggttttctgttttctccaatttccaggctggtgcagtttgtcttgatatctttttttttccccatgggtctcagtcctcttgcccgggctggggtgcagtggtgtgatcactgctcactaccaggaggtagccttgacctcctgggttcaagtgatcctccgaccttagcttccagagtaactagggactacaggcatgcatcaccatacctgactagttttttgtatttttagtagaaatggagtctcaccatgtggcccaggccattttcaaacacctgggctcaagtgatactcctgcctcggcctcccaaagtgctgggtttacaggcatgagccaccacacccggctgacttgttatcttaagactggactttgccatgcctgttaaacttcaagaagatttgatctgctctaatataatttttaaagactcttctgtattactgttatctttgctatattatgactattttttatttatttattttttcgagatggagtctcgctctgtcgcccaggctggagtgcagtggcatgatctcagctcactgcaacctccacctcctggattcaagtgattctcctgcctcagcctccctagaagctgagattacaggcacatgccaccacacttggctaatttttgtatttttagtagagacggggtttcaccgtgttggccaggctggtcttgaactcctgacctcaggtgatccgcctgcctcagccttccaaagtgctgggattacagctgtgagccatcgcacctgaccaagactttaaattgatgtgaaaatcaggcatctcacagtactaaaaaaaaaaaaattttttttgaaaaatacaagtgctgagtttttttgatggtagaacaattttgtctttttttttttgagaccaagtctccccctttcacccaggtcggagtgaagtggtgcgatctcggctcactgcaacctccgcccccccaggttcaagcgaattctcctgcctcagcctcccgagtagctgggattatgggcacgtgccaccatgcctggctaatttttgtgtttttagtagagatgaggtttcgccatgttggccaggctggtctccaactcctgacctcaggtgatccacccgcctcggcctcccaaagtgctgggattacaggcgtgagccaccgtgtccggccttattttttatttttttgaggcaagatctcactctgtcacccagactggaatgcagtggctcaatctcagctcacttgcagccttgaccttctgcactgaagcgattctcccaccttagcctcctgagtatctgggactacagatgtgcgccaccatgcctggctaatttttgttttgtagaggcggggttttgccatgttccccaggctgatctcaaactcctgagctcaagcagtttgtcagccttggccttcaaagtgctaggattacaggcgtgagccactgtgcccggccatgagagcaattttttttttttttttgagacggagtcttgctctgtcacccaggctggagtgcagtggcatgatcttggctcactgcaacctctgcctcccggattcaagctattcttctgcctcagcctcccaagtagctgggactacaggcacacgccaccacgcccagctaatttttgtatttttagtaaagatggggtttcatcatattggtcaggctggcgttgaactcctgaccttgtgatccacccacctcgccctcccaaagtgctgggattacaggcgtgagccacagtgcccggctggagagcaattttttaatagtaacttattgtatatagtattttatgtagtacctattttatacagtgcaacttgtttttaaactgtttataggctgggtgcagtggctcatgcctgtattcccagcactttgggaggctgaggcaggaggattacttgaggtcaggagttcgagaccaacctggccaatatgatgaaaccccttctctactaaaaatacagaattatctgggcgtggtggcatgcacctgtattcccagctactttcaaggctgaggtgagaggattgcttcagcctaggagttcaaggctgcagttagctatggtcatgccactgcactccagcctgggtgacagaatgggatcccatcttaaaaaaaaaaaacaaaaacaaaactatttattgcttgtgtctgctttattttcaaaggtctaactcatcttattactatggatttacaccagaaggaaattcagggcttcttcaatattcctgttgacaatttaagagcatctcccttcttattacagtatattcaagaagaggtgagctagctcaaacttttttattttaacattctgattaaggttgaaagatgtatttccatttccttaggatacccctaaaggattaaaacttgatgtattgtacttaaagtaccattatactttatagctataatccaacgcattttagaattctgaatctgcagtttgtttctttagataagctcttaaaattgctttttcttttggacctcaagtacctagaattggactagatatgattgtaatgagtaatttactctcattactagtctatgcttgatcctggttctgttttatgtatccatctatccatcctgtctctctgtccatccagttataatagccagcatccatgatcccacctcccagcaagaaaactagagtcatcatcataacttagagctgctcatgggctccttctctgtcctatccccctgcctccttccaccctagggaaccactgtcctgaagcggtgctgaatctgtcagatgctttttctgtatcagtggagatgatcattttttttccttcattctgttaatgtggtttattaccacccttgaatcctgggataaatcagatgtttaattttaatatagctacatttgtttttctttgatatgagttagcatttttgtgacttactatttaagaaagcttttaaaatgttaatttatactgtacttagctattttgcttttagctgtttttctttctttttttttttttttggtggggggtgtgatggagtcactcccaggctggagtgtaatggcgcaatctcagcccactgaaacctccacctcccgggttcaagcaattctcgagtagctgggattacaggcatgcgccaacacagctggctaattttttgtatctttagtagagatggggtttcaccatgttggccaggctgatctcgaacgctgacctcgtgatctgcctgcctcggcctcccaaagtgctgggattacaggcatgagccaccgcacctggccttagcggtttttcttatataaattatttctctctttaataacttttctagataacttctttttacagtactgtatttaaaagaagataacttctttttacagtactgtatttaaaagatggcagtttataggtttctgaggaacttctttctggtaagaatacagggcttccccattctccagcaattgttataagtccttatagagaaaatgaatttaagtatttttgaaagagaaaaatgtaaaatattctgctttttttttttctttaaagttacacacaagaaacataaaaactctacgccaggcgcagtggctcacgcctataatcccagcactttgggagtctgaggcgggtggatcacttgaggtcaggagttcagaccagcctagccaacatggtgaaaccccatctctactaaaaatacataattagctggatgtggtggcgcgtgcctgtaatcccagttacttgggaggctgaggcaggagaattgcttgaacctgggaggtggaggttacagtgagccaggattgtgccacggcactcctgcctgggtgacagagcgagactatctcaaaaaaacaaaaaagaaaacaaaaatactctaacaaattaaaaaaataatagagactttaattttacctgaaaaattttatgttttttttttgagacagggtctttctctgtcacccaggttggagtgctgtagtgccatgatagctcactgcaaccttgaactcctgggctcaagagatttctcccacctcagccttctgagtagctgagactagaggtgtgccaccacacctagctaatttttaaaaaatatttccagagtcagaatcttgctgtgttacccaggctggtctcaaactcctggcctcaagcgatcctcctgcctcagcctcccaaaacagtgtgattacaggtgtgagccactgtgcctggcctaattttacctgaatattattcttagttgagagagaaggtgagataaaattggcaaatgtcttgatagggaaggatgaagaggtttaggcagagagagagtgagagggtgagcattgaacgtggttcagttagcaaccagccgcatggagaaacctgtcattttggaagaaatagagcagtcgctatagacttatgtgggttgctgtcgacatcttgttgttttaggggatgtttccattcaggacacaggcatgttgtgtgccaatgtctcaaggcacaaatggcaattgcacctcttaagggatgcccggtgggtgagcctaaagaacgaaggctggggcacccttgtgctggttgcaaggtcaggctggaagcctaacgctagtcattgcctgtagtgcaggcttctacctgaggatgacactgccttctacttgaaaaaatccccattttagtttcattgttgagaagaagtcagggctgagtgtggtggcccacacctataatcccagcactttgagaggctgaggaggttggatcagttgagtccaggagtttaagaccatcctcggcaatatggcaaaaccctgtctctacaaaaaatataaaaattaaccaggtgtggtggtgcattcctgtggtcccccctactcaagaggatgagaagtgggaggattgcttgagcctgggaggttgaagttgcccaggtggtcgaggctgcatcaagccgtgatctgggcgacagagtgagattccttctcacaaaaaaaaaaaaaaaaaaaaaaaaaattaatatgtgggaactcagtgttaaaaaggaatttttgtgtattgcttttttcttttttttggagacagtctctctctgtcactcaggctggagtgcgattttggcttactgcagcctccgcctcctgggttcaagcaagcatatctggctaatttttgttttttgtttttttttgagatggagtttcgctcttgttgcccaggctggagtgcaatggcatgatctcggctcacagcaacctccccctcccaggttcaagtgattgtcctgcctcagcctcccgagtagctggggttacaggcatgtgccaccacacccggctaattttgtatttttagtagagacagggtttctccttgttggtcaggctggtctcgaactcctgacctcaggtgatctgcccaccttggcctcccaaagtgctgggattacaggtgtgaaccaccgcacttggcctaatttttgtgtttttagtagagatagggtttcaccgtgttggccaggctggtcttgaacttctgaactccagtgatctgcctgcctcagcttcccaaagtcctggtattacaggcatgagctactacacctggcctgtattgcctttttatagtatacgtatcttgtctcttttgttttcgtgtgttagagcctcttaaagcaggggatagatattcatgtttcactgaatctaaggtgctgtcagtccaggcttacattattttacgtcaccaagaaagaagaaaacactgctaattatactgtggcactgtgccttcttgtcacttagtgatcctattctgcaggttttgatgctgacgctttctccatctcttgtgtttgtcactggaatttaagcaccttctgccagagtcagaaggaacattctggtactaggatgctcgttgccttgaaatttttgccatctatacttttttttttttttgagacggagtctcactctgtcgcccaggctggagtgcagtggcgcaatctcagcttactgcaagctccgcctcccgggttcacgccattctcctaggcctcagcctccccagtagctgggactacaggcacctaccaccacgcctggctaatttttttgtagttttagtagagatggggtttcaccgtgttaaccaggatggtctcaatctcctgacctaatgatctgcccgcctcagcctcccaaagtgctgggattacaggtgtgagccaccgcgcccagccaacttttgccatctcttctgagggcgtctgacagtgtctgttgccttccgctgcactgctggggatgtgtcaggcagtccttttcacagtttgacctactggtagggatcttcctttcttaagtttcataaagcatttgattgttgccttgcaagaaaatgtggaattgtatcatttttccagtgatgaatatttgattcatgaatatcaaattatactctgatggtctcttcctgtgtctttctgcatacatgataatttttcttttcttcttttttttttttttttttttttttgagacggagttttgctcttgttgcccaggctggagtgcagtggcgcaatctcagctcatcacaacctccgcctcccaggttcaagcgattctcctgcctcagcctcccgagtagctgggattacaggcatgggcccccatacctggctaattttgtatttttagtagaaagggggttttccatgttggtcaggctggtcttgaactcccaaactcaggttatccacccgcctcaacctcccagagtactgggattacaagcgtgaagccaccgtgcccggcttgataatttttcattttaatgaaaaattttaatgaaaagaatcatagtaattctttctggagacattttaaatgggttcaaacaattctcctgggttcaaacaattctccggcctcaacctcctgagtaactggattacaggtgtgcaccaccacgcctggctaattttgttttgcatttttagcagcgagggggtttcaccatgctggccaggctggtcttggctcagatgttctgcccaccttggcctcccaaagtgctgggattatgggcatgagccaccgtgcctggccatctttgggaattttttttaatctgttaagtatttcatcccttctatttcttttattattttcctttgggaactattaggtcctgaaaattttggatctagtctctataacttttaaaaacttattttactttttgcatacttatatatagcattctggggaaattccttgtcttgatcttccctggtttgttcttaaagttgtgtttattctgctgttaagccagccagctactgggtttctttagaccataataacttcttccccctagatttatttttggttctttttcataataacttgttctttcttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagtatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcctgggcggggcggctggccgggcggggggctgacccccccacctccctcccggacggggcggctggccggtcggggggctgaccccccacctccctcccggacggggcggctggccaggcagaggggctcctcacttcccagtaggggcggccgggcagaggcgcccctcacctcccggacggggcggctggccgggcaggggggctgaccccccccacctccctcccggacggggcggctggccgggcaggggggctgaccccccccacctccctcccggacggggcggctggccgggcggggggctgacccccccacctccctcgcggacggggcggctggccgggcagaggggctcctcacttcccagtaggggtggccgggcagaggcgcccctcacctcaacttgttctttcttgttgtatataatttcccattttaacctccgtagagacaatagacttgtttttgttagagtcctttcttttaggtcctttaattgttattaactgttttcttggttctgtcttttcttggctgggtttggtaatgtttgatgatgtttgatgagacaaggaaatacatgaaaaagtttagaaagactgccagcaaaaataatgaaagtgcccaaatggaaatatattttactgccttacttcctgagagtgttggataaattaggctttcctgtagatacagctgagccatgtgattatgccggaggcaactgtactaaattattcaaattaatcattttttgttcatttgctaagtagttattatttagtgcttgttgtatggtaggcattgttttatacatgttgctaggtgttattaactgctcatattaaaattcattggtgtaattgtgagaaaaaagcaatgagaatatagttaatatatttttttaaaatagtgctgggccgattatcctttaacaaattggttgcttcaacatgttatgactgcgatatgttaaatagccatttgtttggactgcagtaatttggaatttgacagtcagcttgtattcagattgaattggatatccttgtactttgaaattacatgtaattaggattcttgttgacgagatatatagaaacatctttacactgcatcattagtatttgctggcagagataagagctaatcaccaattatccctacttttttcctaaaagaagtctgtgtggctcacaagttagtaatattttttcataggcaggttcctttcttcattttccaaaggagaattttactttgaactttttctttttttggaaaactttcaactagccaagcatttttgggtctgttggaattttcctttttgttgacatgcagtaatacctgacttcttgtctgtcacagatcccagattacaggaatgcagtaatcgtggccaagtctccagcctcggcgaagaggtaggtgggaatctcacaacctctttctggatctacttctaaggattgtatccgtgatgagttccaggcattctaatttgaacttcagtggttcccagcgatatctcttatttttcttccatggactggtattttaagattgttctgtcaactccatttattaagtaaacattttaatttcctctcttttttttccaatcccactctatgattgccagacatacttccttttttaagttatcttccacttacactttcttttatttttattattattattatttattttattttatttctttattttttgagatggagtttcgctcttgttgcccaagctggagtgcagtggcgcgatctcggctcaccacaacctccacctcctgggttcaagcgattctcctgcctcagcctcccaagtagctgggattacaggcgtgcaccaccatgcctggctaatttttgtatttttagtagagatgaagtttcaccatgttggtcaggctggtctcaaactcctgacttcaggtgatccacctgccttggcctcccaaggtgctgggattacaggcgtgagccaccacactgggccttatttttatttttaatagtagaaacagagttttgccatgttgtccaggcaggtcttgaactactgaggctcaaacgatccacccacccgccttaccctcccaaagtgctgggattacaggcatgagccactgcgcctgacctcaatcatatttcttgaccaaagcaatccagttctggggaatacgatctagtgttttccccagacccagattgacaatcacatgtcagtctttgagtctggcgtttacagtactggcgaatatttacagtactagcagacaacttcatagttgtttactgccccttatttgaggaactcagaaattgattaacagaattttatccagctgagaggccagttatttgtatatgttaaaggtgacattttacaaaattgacacaacctgaggtgtaccaaagggggagccttgagagtcagtagagtgagttacatgtaacctggagtaactgatgtgtcactattgcatacttaaaattatatgtcggttgagaggatttcttatactaccagtgttttgtggagaagccactccactggagagggaaagaacaaaatcacttgtaggaataaagcctttttcctaaaaaagcccttttaaagttattttccagttgaatacctttgatcactggattgttgttgagtcctgtggaatgaaagaaagtgtagggtgcctccaccctgggctcgtgggctggcagtattgaaggatggaggagaacttgcacacagtaagccattgatttcaaaagtatttcacataagtcattgacgttatgaattaagaatagcactttaatatgtagacttagtatattaaataaaataaattggcatttgagataaaaccattacatggctgtgttcttgtggctgactttcccaacccagccgggcctgtgttcacccatgtgtccttcaagaagttgtatcacctgatctcctcttgtccatttgattaaattgtaagaaacagactgaattttagaatgtaaacatttcaaatagcttttccaaacatttcttcaaaggctgaattaattttacttaataatttttctctgatatacatgctttaaaaaaatgtaggtgaaaaatcacataatatacaataattttaaagtatagaattcactggcatttagtgcattcacaatgttgtgtaaccaccacctgtctctgttttcagaacattttcgtcttcccagaagaacatctagtacccattcagcaatcattccttatcccttcaccttctgtccctcggcagccacacagtatgtggccctctgtgtctggtttctttcacttagcagttttcaaggttcatctatggtgtagcatgtagtatctcagtgttttgttgtcgctgttattgttcgagacaaaatcttactctgttgccgaggctggagtgcagtggcacgatctcagctcactgcaacctccgcctcctgggttcaagcaattctcctgcctcatcctcccaggtagctggaattacaggtgcatgctaccacacctgggtaatttttgtatttctggtagagatgaggtttcaccatgttggtcaggctggtcttaaactcctgaccttgtgatctgcctgcctcggcctcccaaagtgctgggattacaggcgtgagccaccgcacttggccagtacctcagtccttttgatggctgagtaatattgcattgtatgtgtatactagtttgtttatccattcatctgttgatggacactttttttttttaccgtttggctattatgaataggactcctatggtcagtcatggattagtttttgtgttggcataagttttcatttttcctttcttgtggatatatattaggattggaattgctgggtcatatggcagtttcgtttatgttttgaggaactatcagtctcttttccactgcagctgcccattttacattcccaccagcagagtatgagggttccaacttctccacatcttcaccaacacttaattctctgagttttttcattataatcatcctagtgggtgtgaaattctaccttatcgtggttttcatttgcatttccctaatgattgatgatgttgagtatcttttttttttttttaatgagacagggtctcagtatgttgctcaggctgggctcaaactcttgggctcaatcaatccttctgcctcagcctgttgagtgtgtgtgtgtgtgtgtgtgtgtgtgtgtgtgtgtgtgtatttatttatttatttatttttttgagacagagtctcgctctgtcacccaggctggagtgcagtggcgcgatctcggctcactgcaacctccgcctcccaggtttaagcgattctcctgcctcagcctcctgagtagctgggattacaggcatgcgccaccatgcctagctgttgagtatatttttatgtgctttttggccatttgtatatatttggagaaatgcctgttcacaccctttgcccatttaataattgggttgtctttttgttgagttataagcactctttatatattctacatactaaaccttgttagatacatgatttgcagatattttctctctttctgcagattgtcttttcactgtcttgatggtgttctttcacacaaaaaggtttcaatgctgataaagttcaatttatctttttttttttttttttttgagacggagtctcagtctgttgcccaggcttgagtgcagtgtctcagctcactgcaacctctgcctcccgggtacaagcgagtctcctgcctcagcctcctgagtagctgggattacaggtgcccgccaccacacccggctaattttttgtattttttagtagagatggagtttcaccatgttggccaggctggtctcgaactcttgacctcgtgatccgcctgccttggcctccccaatcaatttatcttttttgtttgttattgcctctgcttctgatgtcatgtctaagaatccattggccaggtgcagtggctcacttctgtaatctcagcacttcgggaggctgaggcagaaggatcacttgagcccaggaatttgagaccagccagggcaatatagtgagacctcgtttttaagaaaaaaaaaaacattaactggatgtggtggcatttgtctgtggttctagctacttgggtggctgaggtgggaggattgcttgagcccaagaggtcaaggctacagtgagccgtgattgcaccactgcctggctaatttttgtgtttttagtagagacggggtttcgccatgttggccagactggtctccaactcctgacctcaagtgatcttgacctcaaatgatcatcccaaagtattgggattacaggcatgagccaccgcacccagccaccatagctttttaatttttttgagatggagtttcactcttgttgcccgggctgcacaatcttggctcactgcaacctctgcctcccaggctcaagcaattctattgcctcagcctcccaagtagctgggattacaggtgtgcaccacttcacctggctaattagtagagatggggtttcactatgttggtcaggctggtgaccaacctgatctcctgacctcaggtgatccacccacctctgactcccaaagtgctgggattacagacgtgagccaccatgcaggcctctatagcttttttttttcttttgagacggagtttcgctcttgttgcccaggctggggtacaatggcacgatctcagctcaccctgcaacctccacctctcgggttcaagtgattctcctgcctcagtcttctgactagctgggattacaggcatgcgccaccacgcctatctaattttgtatttttagtagagatggggtttctccatgttggtcaggctggtcttgaactccagacctcaggtgatctgcctgcctcggcatcccaaagtgttgggattattggcatgatccaccatgcccggccctctgtagcttttcaatagtcttttttttttttttttttgagacagagtcttgctctgttgcccaggctggagtgcagtggtgcaatcttggctcactgcaccctccgcctcctgggtttaagcaattctctgcctcacctcctgagtagctgggattgcaggcacctgccaccatgcccagctaatttttaatttttgtatttttagtagagatggggtttcaccatcttggccaggccagtcttgaactcctgacctcgtgatccacccacctcagtctcccaaagtgctgggattacaggcgtgagtcaccacgcccagccttaatagtcttcaagttgggtattgtcacacctccaactttgttcttcaatattgtgttggctattttgggtcttttgcctctccatataaacttcagaatcagttttttgaaatacacaaaataacttgttgggatttagattgggatttgcattaaatctgtagatcagattggggagaactggcatcttgacaatattgagtcttcctatccatgaacatgggatatcattttttaaaaattcatctttgatttctgtcatcagagttttgtagttttccccatatagatgtgtactttttttttttttttttttaaagagaaagtcttgctctgtttacccagactggagtgcactggtgccatcacagctcactacagccttgaatttttgggctcatggcaatcctttcatttcagcctcctaagtagctaggactataggtgtgcaccaccatgcctggctaattaaaaaaatatatatatattttttgttagagacgggggtctgactgtgttgcctaggctggtctctaactcctaggctcagcctcccagtgttgggattgcaggcatgagccatcacttccagcccatattttgttatatttatgcctaaataaatatttcatttctttgggtatcccttaattttttagacattgttttctttagttctgtgaacatatttatgatagctaatttattgtgtctagttattctgacattgggctttttcagagatcgtttctgttgactgcttttttactgtgtatgggccatgtttttcttttttttaatgtttaaaaaaacttattactttattattttaatttaatttaatttttatttttattttatgacagagtcttgctctgttgcccaggctggagtgcagtggcatgatctcagctcactgtgacctctgcctcctgggttccagcgattctcctgccttagcctcctgagcagctgggattacaggtgtgtgccaccaaacccagctaatttttgtatttttagtagagacgggatttcaccatgttggctgggctggtctcaaaactcctgacctcaggtgatccacccatcttggcctcccaaaatgctgggattacaggtgtgagccaccatgcctggccaaaacttcttactttaaaaaagaatacagaaacaagatcttgctgtgtttctggactggtctcaaactcctggcctcaagcaatcttcctgccttgggcctcctgaagttctagaattaaaagtgtgagccaccatgcccggcccatattttcctttttgtttgcatgccttgtacattttagttaaaaacaacattttaaattatgtaatgtgaaaaatctgagcatcagattctacctccaccaattcccagtgtttgttgttgctgttgtttctgtgatatgtttgtttagtggccaccctgtgccaattctgtaaagtctgtattctttgtagcattcagccactgaagtctctggttggttagcttactggccagctaatgattggacagagatttcctgaaatgccttgaagcaataaatctcccactctcttcaaggtctgtgtgtgtgtgtttgtgcatgtcttcaattctcccagcagcttacaactctgccttagcctttacttcttggttgcacagagccttaaggtcagccaaggttcaaggttaggggcttttcaggtccttcctgggtaagcgcatgttctttacatgcaggaataagcttttcaaggcccatgtggccatctcattccccagattttccttttttttttttttttttttgtctagccccttgttttactcaactggtattgtcacttcaggcggctgcagtgttaaacagttgctgttgattgctcatctactctggggatgggactattcacacagagtgactctaagtttgatcatattctccagccctgagtctcagcaagctgccagataggcataatagtgatggttacctgagaatgggcttcttgagaagctccaaacctgttcttttcccaccagtggttgctagtcttctgtttctcatggccaccatgattatgaggtttccaatttttgtcttttgcagaactggagagagaggcatgggaataatggaataatgggaatggggcaagttaaaacacacacagtttcttttttttgagacagggtctcactctgatgcccaggctggagtgcagtggcatcattatggtttactgcagcctggacttcctgggctcaggtgatccacctcagcctcccaagtagctgagaccacaggcatgcagcaccatgcctggctaattctcatgttttttttgtagagatggggtctcactatattgcccaggctggtctccaactcgtggcctcaagtgatctgcccatctcagcctcccaaagtgttgggatgatagtcgtgaaccagcatgcccagcccaaagtttgctctttaacaagattcagctgtttttcttaaacactcctcagattgttgcaagctgttggttaacttccacagttatgtaaaagttaatttttgcaaaattttttagagtttttctttctttcatggaggagcagattttttagggtccttattctgccattctagagtggtgcttctctatagtggtgttgttgttgttgttgttgttgtttagacggatttttatacttgtcacttaggctggagtgcaatggtgccatcttggctcactgcagcctccacctcccaggttcaagcgattctcctgtctcagcctcctgagtagctgggattacaggctcccatcttcacacccagctaatttttgtattcttagtagagatggagttttcactatgttggccaggctggtctggaattcctgacctcaggtaatctgcctgccttggcctcccaaaatgctgggattacaggcgtgagccaccacgcccggccctctatagtgttttgaatatcaccttatatagctgttttaatagttgttctaagtattttattacatatacaaaacatattacaatatactgatgtcattttatcagcctgagtgaaatatagaagtcatacctctctgtgtctctttactccccctgtttttaatatatttgtcttaaatatttctatacatacatttatagcagtatcaggctgttagaatttttgcttttttttttttttttttttttttttgaggcagtgtctcgctctgtcaccaggttggagtgcagtggtgcaatcttagctcttggtaacctccgcctcccgggttcaagtgattctcctgtctcagcctcccaagtagctgggactataggcgagcgccaccacgcccagctaatttttgtatttttagtagagatggggtttcactgtgttggccagggtggtctccatctcttgacctcgcaatctgcccaccgcggcctcccaaagtgctgggattacaggcttgagccaccacacccagccagaatttttgcttttaaacatcaaacataatttagaaaagtcagaaatgaagaaaagcttattatatttacaggtatttttgtttccttcttccttgctgatattccaaagtttagtttattgtttcctttctgtttagagtacctccttttgccgcttttaaataatagttctgttggtaacacattttgctggttttccttcatttgagaatgtctagagttccttttcattcttgaaggacatcgttgctgggtataggattctggagtaacggttcttttctctcagcacctgaaaagtttttgtgtcactttcttttggtcactgtggtttctgatgagaagttggttatcatgaattatttttcaagattatttctttgtctttagttttcaaaagtttaattatgatatatcttgagattgctttgggtttatcctgtttggtgtttgctggacttcttgaagctgtgggtttatgtctctgaccaatttgggaagctttcagccattgtctttttgagtacttttttagtcctaccgtctttctcctctttttctgggactcttatgacataaatgtcaggtgtttgtttgtttgtttgtttgtttgtttgtttgagatggagtttcattcttgttgcccaggctggagtgcaatggcgtgatcttggctcaccgttgcaacctctgcctcttgggttcaagcgattctcctgcctcagcctcccaagtagctgggattacaggcatgcaccaccacgcccagctacttttgtatatttagtagagacggggtttctccatgttggtcaggctggtcttgaacttccgacctcaggtgatccacccaccttggcctcccaaagtgctgggattacaggtgtgagccaccgtgcccagctgatcttttgttacaggtccatgggattctgtttatttttattttctagtcttttatatttttattttttagtgggtctcactatgttactcaggctggtcttgaacccctgggctcaagtgattctcccatcttagcctccagagtagctgaaactacaagcacatgccaccatgccctgccacagccattgttctctctgttgtccaaattggctaatttctgttgtctgtcttccagttcactgattctttccttgacctccattattattttcactgtaacttccattctgctgttgagtatatccaactgagttttttttttttttttttttttttttgagacagggtctcacctctgttgcccaggctggagtgtagtggtatgatcacagctcactgcaacctctgcctcctaggctcaagcaatcctcccacatccgcctcccaagaagctgggactacaggtgcatgccaccgtgtcttgcgaatttatttttggtatttttggtagagacggggattttaccatattgcccaggctggtcttgaactcctgagctcaagtgatctgcccacctcagcttctctaaagtgctgggattacaggtgtgagccaccacccccagcccaactgagctttttaatttggttattgtattttttaagttctaaaataagtttttggttctctttttttgagactgagtctcgctctgttgcccaggctggagtacagtggtgttatcacagctcactgcaacctccgctccctgggttcaagtgatccttatgcctcagcctcctgaggagctgggattacaggcatctgccaccacgcccggctaatttttgtatttttagtagagatggggtttcaccatgttggtcaggctggtcttgaacttctgacctcgtgatctgcccgcctcagcctcccagactgctgggattacaggcgtgagccaccgtgcctggctgctaattttgtatttttagtagagacggggttttgccatgttggccaggctggtttcaaactcctggcctcaagtgatctgcctgcctcggcctcccaaagtactggaattacagtcatgagacactacgcctggccttgggtctttttttataccttctatttttttgtcaatactttctttgtttagacttcttgttttttatttcacacatgctcataattgctgcttgtagcacttttctgatggctgctctaaaatctttgttatacagtttcagcatgtctgtcatcttggtgttggcatctgttaattgtcttttttcattcatattgagatttcactggcctttagtgtggcgagtggcttctgattggaatctggacttttagatattgtgtgtgagactctgggtctcatttaggccttctgattttgctggcttctcaggactctggcagggaaagtggtggtgttggggctcgtttctgctaggtaagggtagaagtcgagattcaccaccaggccttgtgtggaccacctaaggtggtccttgttactcatgggtggaaatgctccctccatgtcctccgctgacgccaaggaaaagtagcatcattctcattgggtggtggtggaattcctgactccaccaggctgcctctgataccactgcaatggagaggggaggggcacctctttactgctgagttgggggtagaagtccagatttcactctccactgactctggcagttgctccttactgctgagtgagggtgaaagtcccagctccctgtttggccttctgtgaaaccaccccattgggtttggggtgcctcattatagcctgacaagccaggaagtacaggctcacccctcaacctttactcatgcggcggaaatgtggcggaaacgtgggctgtggctttcctgcctgtgtggctagagtaaggcagttattgtctaaatattttctcactcactaggttgcccttttcttagtcctttgactagggagagccgacctttgttggagcttttcttgtctttgcccactggcatttttgggtcgcttcttctccagctacaaatctgggataataaggcaaaaggaatgcccaaggaagccaccaccgtgacgttgctcaggtcctgaggtcccttgctagtctgccttctctctaccttttagtgtcttctcatttttttttgagacggaatctcgctctgtcacccaggctggagtgcagtggcacgatcttggctcactgcaaactccgcctcccgggttcatgccattctcctgcctcagcctcccgagtagctgggactacaggcgtctgccactatgcctggctaatttttgtatttttagtggagacagtttcaccatgttagcaaggatggtctctatctcctgacctcgtgatctgcctgcctcagcctcccagagtgctaggattacaggcatgagccactgcgcctggccagagtcttctcatttttgtttgtatgtaacatccaggggttttagttgtgggtggcagaaggagtattaataatccttcctagtggaagcagaagtgacaatgttttgatacttttttttccttgagacaggttcttgctctgtcatccaggctggagtgcagtggtacaaccacggctcactgtagcctccatctcctgggctcaagagatcctcctgccttagtctcctgagtagctgggactgcaggcatgtgccaccatgcccagctggttttttccttatttttgtagcaacgggatctccctatgttgccaggtctggtctctaactctagggtacaagtaatcctcctgccttggcctcctaaagttccgggattacaggcatgagccactgcatctggccttgatacatttttttttctttcccactaaataccagaagaacatgatgaattttctgttgactttcccatctgggtggacttttagtaacctctagagtcctcagtttacttctgtcacccacctgttcacagagggatggatgtagtagccttttgctcagtttctttggcttttgtcagtgatgtttgtcattcatctgttcaaatgtttattgagaacctattttgctggggctgatgaggcctaggaagatgccctgtaggaatgcatgtgtagcgtcagatgttttttatctatgttatgttatttgatctttgcaactttggaagtcagcagttataatctctcatagatgaggaaacagacccacagagatgaaggaaccaaggtagttccaccaaatgttgtttccttgaaggtagtggggcaactatttacttccaagaatgttttctataccagtgattaggggacttgagtgttggccaaatatgattgaaattgggccaggtgcggtgtcacacctgtaatcccagcactttgggaggccgaggggggtggatcacttgaggtcaggagtttgagaccaccctgaccaacttagtgaagccctgtctctactaaaaatacaaaattagcggggcatggtggcgcacgcctgtaatcccagctacttgggaggctgaggcaggagaattgcttgaacctgggaggcagaggttgcagttagtcaggattgcgccattgtactccagcctgggtgacaagagcaaaactccatctcaaaaaaaaaaaaaaaaaaaaaaaagaaattgacttgcccccctccactcagtctttaccgagtacatatttgagtgctgctgtgccagccatcgtggatgtggtggtgaccagtgcaggcagggctgtgttcccatggcacttgcagactgccctcatgtgctctttgactggtaggtcagttgggtagattggaacgaaagacccagtctctttttctcccagtttcagtaattgaatccacatagatcatactacattaaatgaatgttttagaggctgggcgcattggctcacccctgtaatcccagcactttgggaggccgagatgggtggatctcctgaggtcaggagaattgcttgaacccgggaggcggaggttgcggtgagcccagatcgtgccattgcactccagcctaggcaacaagagcaaaactccatcaaataaataaatgaatgaatgaacgtgtgttttagtatggagatgagtgctacaaaaggttcagttttatatggaacaggtagtaaaataacacagtcaaggcttaggagtttggtctgtgagtttaaggtattgtgagtgggctaggctcgatggctcacacctgtaatcccagcactttgggaggctgaggttggaagatcatttgagtccaggagttcaagaacagcctgggcaacatgttgaaaccccatctctaccaaaaatacaaaaattagccgggtgtggtggcgtgtgcctctagtcccagctactcaggaggctgaggtgggaggatcacttcagcccagtaggtggaggttgcagtgaggtgagatcacaccactgcactccagcctgggtgacagccagaccctgtctcaaaaaaacaaagtaaaataaaaaggtattgtgagcaagagctctgtcgacatggcatcaacacagtaaagtcagttctggttgtcttatatcccgtagctatgtggtggtgattttcttgtgttctaatgtcctgataaacacattcacccagacttcgagcaggagatggcactttctggctcagccacatgcaaattctgatcctattatttctagttccctcctccaagtttttcatttggcagccaaccttagaaaatagctgtaatcaatgtagaagtcagactggggctgacttttatcagtcaggaaggtattaaattagcagtccaagacttgggcttccacttgtgccttagccagtctttgtgagaaccttggtcaaggctgtctctccaagcctcagtttcctggggataacacctgcttggcttatcttacagagttaataagcatcaaagaacttactgaaggactttataaattaaataccattatgtagaatggtggtggttagtgcctttatttatttattttttgagacagggtctccctctgtcgcccagtctggagtgcagtggtgtgatctcggctcactacaacctccacctcctggattcaagcgattctcttgcctcagcctcctaagtagctgggattacagacgtgcgccaccatgcccagctaatttttgtatttttggtagacatggggtttcaccatgctggtaaggctcttctcgaactcctgacctcaagtgatctgcctgcctcggcctcccaaagtgttgggataacagacgtgagccactgttgggataacaggcgtgagccactgtgtttagtggttagtgcctttagaatcctgaagttattgatgaataggtcgaagtccagagctattgttttggagttgtttgacaatgagcagttgttttgactaaaagggatcatcagagaaagtgttgcttttgtaaggaacagaacttgcttgaatgagttgtttgaaattgttttctctgaataactgagtgaataggaaacaaaaggatagctgaggccctgtgtcttgttctttctcacccatgatgtaaattaactcattatcgtacaatcaggatcaagttgctttagaattcctctctgtcagtgcatgaaacaaaatgacacagagaaaccatcctgattgattttggaattagatgggaatgcaaagtatctgattaagttatatggagtatccagaaactcccattgctgtgcaggtaataattttatttatttattattttacttatttatttttttgagacagagtcttgctgttgtcgcctgggctggcatgcaatggcacgatctcggctcactgcaaccttcgcctcccggattttagcaattctcctgccttagcctcccgattagctgagattacaggtgcctgccaccatgcctgggtaatttttttgtatttttagtagagacggggtttcaccacgttggccaggctggtctcaaactcctgacctcaggtgatccacctgccttggcctcccaaagtgctgggattacaagtgtgagccaccgcacccggccatgattttatttatcttaagagcattgtgctttgtagaggttggtataattgaaatattattctaggaattggcaaacctccacagatcccagatggaaaagacttccttagaggataactaacaggtcagtcatttggccaattttgtttgcaaagccaatcttgaatttcaaggaggaactaataatctatgtgatgccaactcttttgaagactctgccccattgttctgtctgaaatttttttctcttgagaattttttttttttttgagacggagtttcgctcttgttgcccaggctagagtgcaatggtgcgatctcggctcaccgcaatctccgcctcccgggttcaagtgattctcccacctcagcctcccaagtagctggggattacaggcatgtgccaccacacccggctaatttgtttgtgtttttagtaaagacagggtttctccatgttggtcaggctggccccaaactcccagcctcaggtgatctgcccgcctcggcctcccaaagtgctgggattacaggcgtgagccactgctcctggccactctcttgataattttttaaaaactattttgattttttttgtaaggatgaattcaaagttatatgaatactaaatcttacatcttgggatatttatcaaatgttattaaaatattctgtgtttatgatgctccctcttttcccttaggacaaatattctgtcttacacacacatagataaatatattttactgacttcactgtttttgacctgaacagtcttgctcctgtgaaggtttatcatcttttccttggaaatataaattacattcctcatagataggaccagaccaataaatgtttacttacgtgtgtctgagattgtttgtttgtttgtttgtttgtttatttgagacagggtctttctctgttgcccaggcaggagtgcagtggtgcaattatagctcagtgcagccttgaccttctgggctcaagtgattctcccacctcagcctcccaagtagctgggactacaggcgcgtgctaccacgcccagctaatttttgtatttttagtagagacagggtttcaccatgttggccaggatagtttcgatctcttgaccttgcgatccacccgcctcagcctcccaaagtgctgggattacaggcgtgagtcactgtgcctgggccagctaatttttttttatttttgtagagacgaggtctccctgtgttgcccaggctggtctcaaacccctgggctcaagccattctcctgccttcgtctcaaagtgctgggattacaggtgtgagccatcacccagctttaaaaagtatattgaaaataggatgatttaagcatgagttttttgtgtgtttgtttgtttgtttgttcgtttttcagtagagatggagtttcaccatgttggccaggctggtcttgaactccttgtcccaagtgatctgcccgccttagcctcccaaagtgctgggattacaggcgtgagctgccgtgcccagccaaatttaaatttcttgaaataattgctaacactgtagcaaagctttcctttgttgtgtagtgcatataggaaaccaggttgatgtgaaatttctaacagctcataagagtctacatactaatagtatttagtactttctagtgccctgctcttcatatgtcatgtaaatgccttggctgtatctagtatagatagtactagtgggattcagtataatccttaattttttgtttgtttttagtaattcttgtaagcagttagttaagaacttgttttgaatttttggtgctggtaagccaagactgcgagaacttgttggattcttaaacacttgaacatttaccatgcattaggtgctgaggatggaaaaaagagtaagactcagcatggcccccaggaatcaggagtggctgtattaatatcagacaaatcaaggcaaataattttgccatggttgaagaaggtcttttcctaatgataaaggggtcagttcttcaagaggacaaaacagttctaaacatttataaactaaatgacagtgtttcaaagtatatgaagcaaacactgataactgcaaggagaaatagatatatccataatgatagtgattccattattcttctcttagtaattgatagaataaggagactgaaaatcattaaggatgcgggagacttgaacaaccccttcagcctgctggatctgactgacagtcatagcacaccatccagagagagcagaatgtagttcttttttagtataaacacaaagatagatcatattcttgtgagccataaaataagccccaaattgataattatgcaagccatacaaaatatattctctgaccacagtggaattaagaataattctaataacagaagtatctttggaaatgtcctgaatatttagtaactaaataacatacttttagataacccataggtcaaagaagaagtcaaaagtgaaattaaaaagtatttagaaccaaatgaaaatgaagacacaggccaggcgcggtggctcatgcctgtattcccaacactttgggatgccaaggccggcagattacctaaggtcaggagttcaagaccagcctggccaatatgatgatgaaaccccatctctacaaaaaatacaaaattagccgagcgtggtggcacaccctgtaatcccagctactcgggaggctgagacaggagaatcacttgatccagaggtggaggctgcagtgagccgagatcatgtgaccgcactagccaagatcacgccactgcactccagcctgggcgacagagcaagactccatctcaacaacaaaaaaaagccagatgcggtgggaagaagctcctgcaagaggccacggagccagcgacgggaggccttgaagccagtgacgacccactcagccgagctgccgctttcgcagcacgccaaggacactcatgaggaccatgatacttccactgagaatgcagatgagtccaaccatgaccctcagtttgagccaatagtttctcttcctgagcaagaaattaaaacactggaggaagatgaagaacttttaaaaatgcagacgaaactgttctgatttgcctcagagaaggatctcccagaatggaaggagtgaggcaccggcaacgtcaagctcctgaaacacaaggagaaagggaccatctgcctcctcatgcggagggacaagaccctgaagatctgtgctaaccactcttcacgctgataatggagctgaagcccaacatgggtagtgaccatgcctgggtctggaacacccacgccgacttcgccaacgagtgccccaagccagagctgctggccatccacttcctgaatattgagaatgcacagaaattcaaaacaaagtttgaagaatgcaagaaagagatcggagagaaaagaaaggatcgggcaaaaacgatcatgccaaaaaaagtggcggaaaagctagaagctcttttggtggaggaggaaaccaaggaggatgctgaggagaagcaataaatcatcttattttatttccttttcctccctttcctttccttttcaaattttaccctgcccctccttttcggtttgtttttattctgttttgtttttacaagggatgttatataaagaactgaattcaacattcaaaaaaaaagattaaagcataaatcaatgaaatagaaaacaaaaaccagaaaaaagctaaaaagctgattctttgagaaaatcaatgcaattgataaacctttatccagactggttaggagaaaacaagacacaaattacctaccgtaccaagtgttggtgaagatgtggaggaactggatctctcatgttctgctcatgggactgtaatatggtataaccactttggaaaacagtgtggcctttttttttttttttttttgagatggagtctcgctctgtcgcccaggctggagtgcattggcactatctccactcactgcgagctccgccttccaggttcacgccattctcctgcctcagcctcctgagtagctgggattacaggtgcctgccacccagtccggctaatttttttgtatttttttagtagagacggggtttcaccgtgttagccaggatggtcttgatctcctgacctcatgatccgcccaccttggcctcccaaagtgctgggattacaggcgtgagccactgcgcccggcctatgtggcctttttataaagagttaaatatacacctactatatgatccagccattccactcttaggaatttatcaggagataagaaagcatgtggctggacacgtaattccagcactttgggaggccacggtgggcagatcatctgaggtcaggagttgaagaccagcctggccaacatgacaaaaccccgtctctacaaaaaatacaaaaattagccaggcgtggtggcacgtgcctataatcccagctacttgggaggttgaggcaggagaatagcttgaatctgggaggtggaggttcacaccactgcactccagcctgagcaacagagtgagactctgtctcaaaagaaaaagaaagaaagaaggaaagaaagcatgtgcccatacagagatctgtgtatgaatgttcacagcagctttgtgacagccaaaaactagaaacaaccggaaagctcagcaatacataaatggatacactgtgatatattcacccagcagaatattactcagcaatgaaagggaatgaactattgatatgttattccatggatgaatctccaaaacatgtgctgcgtaaaataagacaaaatggccaggcgcaagtggctcacacctgtaatcccagcactttgggaggtcgaggtgggtggatcatttcaggtcaggagttcgagaccagtctggctaacatggtaaaaccccatctgtactaaaaatacaaaaaagttagccagatgtggtggtgcatgactgtagttctggctatttgagaggctgaggcaggagaatcgcttgaacccgggaggcagaggttgcagtgaactgagaaatcctgccaccacacttcagtctgggcgacagagcaagactccatctcaaaaaaaaatcagacaaaaaaaggcaactttatgatttcacttacgtgaaattctagataggtgaaactatagtgacagaaagcagatcagctgttgcctggggcaacacttagtgaaaaatcactaaggggcataaggagatgcttgtggtgatgacgttccttatcttgattgtgctaatgcttatatgggcacatacagccttcagagctcatgaaattatatactttagatatgcacagtttctcatatctcagttttacctccctaaaactattaagaaatttgtgcttaatactttggtgagcattttatgccctttgccccatgtagttggttctcactggtaggtaggcaggcaggtagaattagcagctttaggtgagacagagctgagcggaggttccttcactcagtcaggctctcccggccagtggcttgcagaccaggccaggctgctgcccttctttggtgctgctgcagagggaagtgtttggcatgtggggtctctacagttagtcctggtttctaagagtctaaggctgttttattctctcttttctttagtcctttgggagacaacattctacttatgttctcttaatgttttgtcccctaggcattagcagaaccaagggctgcatgagttttgagcttgtgtctggtgttttccctcagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccagtaagtgtgctgctgcctctttcccactttcctctgattttaaggctgactacactgttgtctgtgtggtttttttcctcattcttcgtttttttttagttggcaaaaactcattaacacctttcttggccagatagtagcgaatgcatttctgattaccttgtaaattgtaaggccgtttagaagcagtctgtccttctttgcaagacctgtgaaaatgtttggactattgagacagttgcaatgcttcagggaagtccattcattcattcagcagtatatactagagtgtagtttaacataagcaaaaagctttttatatacaaagttattgactgtgatgttgtttttaatgcaaaatattagaaaggtttaaatggtttaccagagtgtagggcttggtaaattatactgtgtcagtacagctaattatgcagccctttgaaataatcaagactatctggaaacgagaaaaatatatggaatatatatgaacaaggcagaatataagattgtatacctatttgtcttagttcaggctgctgtgatgaaataccttagactgggtaatataaacaacaaatttattgctcacagttctagaggctgtgaaggtcaagataaaggcgccagcactgaccccgtgatgggccgggcacggtggctcacgcctgtaatcccaacactttgggaggccgaggcgggtgaatcacctgaggtcaggagttcgagaccagcctgatccacatggagaaaccccctctctactaaaaatacaaaattagccaagtgtggtggcgtatgcctgtaatcccagctccttgggaggctgaggcaggagaatcgcttgaacccgggagacagaggttgtggtgagccgagatcgcgccattgcactccagcctgggcaacaagagtgaaactccttctcagaaaaaaaaaaagataaaggcgccagcagatttggtgtctgtcgagggcctgttcctcgtagatggtaccttcttgctgcatcctcatgtggtggagaaaggtggaagactccctcaagcctctctgacaagggcactgacccccttcgtagagcagagtcctaacaaactagtcacctaaaagccctacctcttaataccaccacagtgggttccagcatgaatttggaaggacacaaaaattcagaccatagcattttgccccggcccctcaaaattcatgttcatcttacgtgcaaaatacattcattctatcctaatagcccccaaaatgttaactccgggtaagtcttaacttaatttcagcatcacctcaaaagtctgaagtccaaagtcccatctaaatatcatctaaatcaaatatgggtaagactccagctctgggattcactctgacgcacgtttctctccggctgtgagcctgtgaaatcaaacaggttgtatgcttccaaaatgcaatggtgggacagacattggatagacattcccattccaaaaaggagaagtgaggcccagtgtggtggttcacgcttgtagtcccagcgttttgggtagccaaggtgggagggttgcttgaggccaggagttcgagaccaaaagggagaagtaggaagaaagaaaggagtgacaggtcctgaccaagtctaaaacccaaccagacaaacaacattaaatcttaaggcttaagttgactcaaagccccgccttccacaaaaactggggcaggggttggtcttgcaaagctctggatggccccactcccacagctttgctgggagcagcccatgcagcagctctcagtcactggattctcatgcctgcatctctcaggctggagttgcactctagtggttctaccagtcttgggtcttggggtggtcttgccccacaactccactgggcattgccctagtggggtctctctggtggccctgcccttgtgacagttctctgcttgggccctggcactctttggggcatcctttgaagtctgggtagaggtagatgtgcccccacagctcattcactctgtgcactgtggagatggccctgcacggacaccactgtggtttgttgcctgtgccttccagaggggtggcccgagctatagttggacctgcttgagctatagctggagtgggtaaggagtattctggaatgtgggaagtggagccttgaaatcgttctgcccccaagaccctggcattctaggcttatgatgagatgggcagtcacaaagatctcagaaatgcctttggggtcattgagtcactgtcttgatgaatagcgtctggttctttttttttttttttttttttttttgagacaaggtctcactctgtcacccaggctggagtgcagttgtgcgatcatggctcattgcagtctcacctcctgggcccaagcagtcctcccacttcagcctcatgagtagatggaactacaagcacttgccaccgcacctggctaatttttgtattttttgtagagacaaagttttaccatgttgcccaggctggtcttgaactcctgagctcaagtgatccacccgccttaacctcccaaagtgcttacaggtgtgagccaccactcctggccgtctggcttctttctatccatactaatctccttatcaaatgtttgcttggtggctgggcgcggcggctcacacctataatcccagcactttgggaggccgaggcaggtggatcacgaggtcaggagatcaagaccagcctggccaacatgatgaaaccccgtctctacaaaaaatacaaaaattagctgggcatggtggtgcgtgccttaaatcccaactactcgggaggctaaggcaggagaatcacttgaaccagggagttggaggttgcagtgagctgagatccaagactgtgccaccgtactccagcatggcaacagagtgagacaccatctcaaaaaaaaaaagaaaaaagaaaagtttgcttggctacacacttggagttctgtcctgaacatgtttttgcttttttttttttttttttttttttttgagacagagtcttgatctgtcttccaggctggagtacagtggtgcgatcagatctcactgcagcctccacctcccgggcccaagccattctcctacctcagcctcccaagtagctgggactatagatgtgtgcaccaggcctggctaattttttttttttttttggtagagacggggtcttgctttgttgcctaggttggtcacaaactcttgggctcaagcaatcctccctccttggcctcccaaactcttgggcttataggcctgagccattgcatccagccttgcttttacattctttacaagatggccaggctgataattttccaaatatttaagttctacctcccctttgatgataaatctcatctttaattcatcttcttggattttagtataagcagtcaagagcagccatgcaccctcttttgccaaagattctatttcactgccctttttttttttttgagatggagtctcactctgtcacccaggctggaatgcagtggtgcaatctcggctcactgcaacctccagctcccgggttcaagcaattctcatgcctcggcctcctgagtagctagcactacaggtgcacaccaccacacctggctcatttttgtatttttaatagagatggcattccaccatgttggccaggttggtctcaaaactcctgaactcaagtggtccgcctgcctcagcctcccaaagtgctggggttacagacatgaaccactgcacccgacctttttttttttttttttgagacagtgttttactctcttgctcaggctggagtgcagtggtgtgatcacagctcacagcagccttgacctcctgggctcaatcgatcctcccacctcagcctcccaaatagctgggactgcaggcatgtgccaccatgtctggctaatttttgtattttatgtagagatggagttttgccatgttgcccaggttggttttgaactcttgggctcaaagcgatccttccacctcagcctcccaaagtgctgaaattacaggtgtgagccaccatgaccagcctactgtctgtttttctactagcattgtgatcatgaccacttagatcatttctaagaagattgaggctttctttacagctgttttcttctgagcctgtcttagtctgttttgtgttgctataacagactatataagactgggtattctataaagaagacactttatttagctcacagttcttcgggctggtaagttaaagagcatagcatcacatctggcagtttctggtgagggccacacactaggttgaaacatggtggagaagaaaagtgagcaggcgggtgcagagaaatcacatggcaagagaggaaacgagagagcctgggaagccaaactcatttttataacaacctgttctcatgggaactaagtgccctgagagcaagaactcactcacccccataggaaggcattaatccattcatgaaggatctgcctctgtgacccaaacatctcccactaggccccacctctcaatagcgcacactggggatcaatttttttttttttttgagacggagtcttgctctgtcgcccaggctggagtgcagtggtacgattttggctcactgcaagctccacctcctgggttcaagcagttctcctgcctcagcctcccgagtagctgggactacaggtgcatgccaccacacccggctaattttttgtattttagtagagatggggtttcaccttgttgcccaggctggttgaactcctgagctcaggcaatctgcctacctcggcctcccaaagtgctgggattacaggcgtgagccactgcgcctggcccaaatttttaacataagttttagtggagacaaactacatccaaaccaaagcagaactctcaccagagctcccctttacggtctgtacatagcaatacagtctttttctagccttttcctcttccagcctctgcccattacccagttccaaagccactcctgcattggtgggtatttaatacagcagcaactcacttctcagtaccaatttctgtcttagtttgttaaggctactataacaaaataccttagacttggtattttttttttttttttgagacggaatttcgctcttgttgcccaggctggagtgcaatgacacgatcttggctcaccgcaacttccacctccacctcccgggttcaagcgattctcctgcctcagcctcctgagtagctgggattacaggcgcgcaccaccacgactggctaatttttgtatttttagtagagacagagtttctccatgatggtcaggctggtcgcgaacccctgacttcaggtgatccgtccacctcagcctcccaaagtactggaattacaggcatgagccactgcacccggccagactgggtaatttataaacaacagaaattcattgctcacagttctggagactgggaagtcctggatcaaggcaccagcagattggtgtctgatgagggctcactctgctcctgaggtggcaccttgttactgtgtcctcagatggtggaaggagcaaggcagctctctgtaagggcactaatcctgttcatgaaggcagaggccttgagccttaatcatttcccaaaggccccactgttaatactatcacattgggtattaagttccaacatagcattttgagaggacaccatcttcagaccacagcactctctttgtctatgcaaagaccaggaggaaataggaagaatgaatgtagttgggttggggtggtagagttatgcatgaatttgtttttgtgtttaagaaacttccccatgccttaataacatcttcttaattaaaaaaaaaaatgccaccttcgagttgttggggaagaaccctaaccccctgccctcatagattcagtgtttggtggcatatggactaaactggcaaaagacagatgaggaagaggaaaggcagtttaatcacatacatacagatgtgtgtgattaaactcttttgtgagtcacaaaaatgtgactcgaagtggttacaatttggggcttatatagcatcttaataggggaacaggaggggcagaaaaggcccctgtgggaaaacagatgacttctttttttttttttttgaaacgctcttttgcccagcctggagtgcagtggtgcaatcatggcacactgcaacctcggcctcccaggttcaggcgattctcctgggtagctgggactaccggtacatgccaccatgcccaggtaattttggtattattattattattattattattattattattattatttttttttttttttttttttttttttttttttttagtagagacagggtttcgccatgttggccaggctggcctcgaactgactgcaagtgattcgcccgcctcggcctcccaatgtgctgggattacaggcgcccggccaagatgactccttaataggggaagaggaggagggaggggactgatgggaagtgggcgctgaggagaaaagatgggagagaggctagtttttgacagcgtctgtttaggtgtggtctggacttcttctggtcttaagcgataagagtcagtcttccctggtgttcccagggaggagatttatcacagttgagttctttggagttattttgtgaggctctgcttttcagcatataagggacttcaggaactcaaatgctttcagctcaaaataatttttaggtcacagaggtatattctggactgttaggtttttgccttgcccaggagtttgctcatttataaatagagggaaaaaaaaaccagagaaggaactagtgtggttgggatagccatgcacgcagctgggattccagctatactttgtagatcccaactgaggtggaaagggaaggccatctgggcaggggttaaatctcctaaggggtgggggactgagcttgagtttgcatctggctccatcacttatcagctgtgtgttcttgggcctgttgtttttctgaaaaagagcgacagcaagaggccatcctcagagtggacccatgataggccaagatggtggaaagcccaggacgagccctcaggacccagcactgcctgccttatgtgagtgagataggactgcagtggtgagacgttcagtgatgggccatggtgtggccaggaagacactagcctgactaccaggaggcccctggagggaagagatggactaagatagcagtatctgcggggagccaaccaaggaggactttgaataccagtaaatacactcgtgtcctagaaggcagcccacaaaggctctcgatccgggccatttagtgttcagcaggccaggcctgcatctgtgtttgggatagggctgcaagtgcagaggccagatccgggaggctgatgaagttgagcaggcacatgggaggagagcttgatctcttgggctatgctgtccagtcgggtggccactggctacatgtggctcctgcacactgggaacggggtggggagcagtgggagtgtgaaggacacacccctaatctgaaaactttaatgtaagtatctcattagtgaagttttattgactctgtgttaaaatggtaatattttgatatgttgaatcaaatcaaacatgttattaaaattaattttacctttttttgtgcttttgtaatgtggctactagaaaatctgaaattgcatatgtggctttcatttctgttgtgcgttattgctctaggggttggtaacaatgggaatgaaagtgacagagcacattgagaaatgttaaaaagacgatgggagggaggccaggtactttggcgcactcctttaatcccagcactgtggaaggctaaggtggaaggtttgcttgagcccaggagtttgagaccagcctgggcaacatagcacaaccccgtttctacaaaaagtttaaaaattagccaggcggctgggcgcagtggctcacacctgtaatcccagcactttgggaggccgaggtgggtggatcatgaggtcaggagttcaagatcaaactgaccaagatggcgaaacgctgtctctactaaaaaatataaaaattagccaggtgtggtggttcgtgcctgtaatcgcagctactcaggaggctgaggcaggagaatcacttgaacccaggaggcagaggttgcagtgagctgagattgtgccactgcactccagcctgggcaacacagtgagactacctctcaaaaaaaaaaaaattagccaggcatggtggtgtgcctgtaatcccagctacttgagagtgaggtgaaaggatcacttgaacccaggaagtcgaggctgcagtgagccatgatggtgccactgcactccagcctgtgtgacagagtgagaccctgtctctaaaaaagatagcaggagggaatgaacatttttagtgtattagtctccagtacagcccttttaattgagtgatgattttccactttatagataaacaggatcagaaagagaaagcgacttccctgcagtcacatagtgacaagctggacatgtctgactaaaacctgtgctttttccactgtgttcttgggtctcttggacttagtaatggggatttaaggaggaggaaggcagtgagatagagccagggttcaggatttggggctgggagggtgttaataaagcgtttggctcaggacctcaaagccttttgcttgtgtgtgcatttctcacagcctcacgtgcccaggctgttggtgctggggggtaggcctggggctgccgctccctttcagaatccttgcctggcctcagaggggcttgtgtctaggaacctcagcagaaccctgcaagggctggctgggaccattggtgagatgagccatgcccgggagcatggaagaatatatgttcctcttcagtcctgtaagcacatgggctgtgatgaggaacgcgttggcagtctttagatgaacgctgcttctttggaacttgctgggtgttagcttttggtgtggcctttgggagtggactctggactgcagacactgaactacaggtttcccatctggaaatgagttcataggactggatgatctctatgttctttctaatatttctttactcgtgggatctttatgtttcattcataattttaattataatgtttctatgtttatgttttgactcaagtagtgatcactacaggccgtctttgggaatgcagtagaattttagtttcatagatcctaaatatttgattgtttttatacatttgatgattggacaccctacatagaatacttttttaaggtactagcaaataatatatgaagggaaaagaaagcattcttcctgtagcatctcgaatataaagattttgttatttagtattagattttaaaaattattttgtatcctctgatttcttatagatgaaaatatgcctactaaaaaacaatgaaaatactttttcagaatataagcactatatataatatttgaaaatattatccataaaagttagaagaaaataataattagtgcttgatgccactattcaaagacacaccactttaatttggtgagcctctttttggtttttcacccttattttcataaagctgcgatgcatgcttcatacataattgtgcatgttgctgcctccttctcccagctgcccgacgtgtcatctcaggtcaccagaaactttgacaggaaacagcaatttcttttttttttctttgagactgggtctcactttgtcacccaggctggagtgcagtgacaatcacggctcactgcaaccttgacctcccaggctcaagcgatttgtccacctcagcctcttgtaaacagcatttttatggctaataacccatcgtatgaatgtggcttagactgcccaaccacagcctaatttggggtttttatgttttcttctgttctttgcccttataatgtggcaggaaatatatgtggataaaacacttttcccatactttggcttatttcatttcaagcttctaaaagtgagattaatgagtcagaaggtatgaatataaggctttttgtcaaattgatttcctagagggtgattcattatactttttcaccggcattgaggtcaagtgtcctgggagtaggactgttgaaaatgtaaaaagtcacttcagttctggaatttatcttgctttgctttgttttgttacacttttttgccctctcctgatgctcacctggggtcacacattgcctctggttgtcatatgtctttcatctctttcaatctagagcagtggttctcaattagggagtggatattgtctcctagaggtcatttggaaatgtctggagatagttttgattgtcagaatcaagggggtggctactggcatctagtgagtagaggccaaacatgctgctaaacttctcacagtacgtagggtggtcccttgcagcataaacgtgtctggcccaagatctcagcagttgaaaagtcccaatctagaacagtattttaactttttctttttgtgacattgccttaaaagaaaattgaagtcaaagtcacataacatagaattaaccattttaaagtataaaatttactggctttcagtatattcacagttttgtgcagttaccatttctttctagtttcaaaacttctcattaccccggaagaacaccctgcacccattaagtagtttcaccatgcccccatcccccagcccctggcaaccacttacctcttttctgtttctgtggatgtttgcctaatctggacacttcatataaacggaatcatataatatgtgggcttttgtatctggcttctttctttgagcatgtttttgaggttcatccatgtgatagcacttgtcagtacttcattgcttttggtggctggataatatttcattgtcagcatttgaaaggaatttgggttgtttccacttttggctatgctgctctgtatattcatgtatgagttttctgtgtggatagatgattcatttctcatggtctatacctggtatcggaattgctgcgtcacttggtgtatgtttaactttttgaggaactgccagactcttttttcacagcagctgcaccattttatattcctaccagtaatgtacaaagatttcagtttctccacatcctcatcaacacttattttctactttttattgtagccagcccagtgggcataaagtggcatctcattgtgattttgataaacatttccctaatggctaatgacttcatttgtatatcttctttggagaaatatctgttgaaatcctttgcccatttttgaactaggtttgtctttttttgttgaattataaaagttctttatatattttggcatatggcgcatatatatatatataatttttttttttttttttttttttgcgacagggcctcactctctcacccaggctggagtgcagtggtgcaatcgtggctcactggagccttgacctcccgggcccaagtgatcctctcacctcagccccctaagtagctgtgactactgtcatgcaccaccacgccctgctaatttttgtatttttttatagagacagggtttcgccatgttgctcaggctggtctcaaactcctgaactcaggcaggcaatctgtccacctcggcctcccaaagtactgggattacaggcatgagccaccatgcccagcctactttatatattttggatactagactcttaccagatacatgatatgcaaatattttctgccattctgtaggggttttttttacttttttatttttatctatttatttatttttatttatttattttttgagacagagtctcgctctgtcacccaggctagagtgcagtggcatgatctcggctcactgcaagctccacatctcaggttcacgccattctcctgcctcagcctcccaagtagctgggactacaggcgcccactagcacacttggctaatttttttttttttttttttttttgtatttttagtagagacagggtttcaccatgttagccaggaaggtcccgatctcctgacctcgtgatccgcccgcctcagcctcccaaagggctgggattacaggcgtgagccaccacgcctggcgtggaattgctttctcaattccctcttttgattgttcagtgctgctgtgtagcagctgattttgtgtgttgattttgtacttggcaacttggctgaattcatatattattagctttggtaggtggatttgtggattcttgggtattttcaatatgtaggaacatgtcatctgctaatagagatagttttacttttcctttctgatctggatgcctttcatttcgttttcttgtctaattacccttgctagagtatccagtatgatggtgaatggcagtggtgcagtgggcatccttgtcttgttgctgatcttaggggaaagcttttggccttcggccataaagtatcaagttagctgtgggtttttgtagttgcccttaatcagattgaggaaattcccttgtattcctagttggttgaatgtttttatcttgagatattaacttctttaaagttttgttttactttttaatataaaaattttggtgtgtgtgttttattccaaccagtgctgattcctaaagaaaagcccccaatcacggttgtgggtgatgttggaggaaggattgccatcatcgtggtatgtagacctcttttattattaattctagtatttgccattgttattctgttgattgattgattgattgattttattacagagactcactgtcgcccaggctggagtgcagtggcacaatctcggctcactgcaacttctgcctcccaggttcaaacgattctcctgcctcagcctcccaagtagctggaattacaggtgcctgctaccacgcctggctaatttttgtatttttagtagagatggggtttcaccatgttggccaggctggtctcaagctcctgaacttaagtgatccacctgcctcggcctcccaaagtgttgggattacaggcgtgagccactgcacctggccaatttatttgttaattctgggcatataaaggcctaaggatagtagtatggccagataattcttattaaatttgtgccttgtgctaaatgtttgctttggcccagaaattggaaaatgctattgtttattttaaaattgctcactactggctgggcgcgttggctcatgcctgtaatcccagcactttgggacgccaaggcaggccaatcgcttgggctcaggagttcaagaccagcttggacaacatggtgaaaccctgtctctacaaaaaatacaaaaattagctgaacttggtggcacatacctgcagtcccagctacttgagaggctgaggcgggaggatcacttgagcctggggctcagaggttgcagtgagccgagatcatgccactgcactccagcctgggtgacagggtgaggctgtgtctcaaaaaaaaaaaaaaaaaaagtcatcctgtcataacatgagatattgttctgtgatcaaagtaaagtacaagctgggcacagtggctcatgcctataatcccagcactttgggaggccaaggcaggcagatcacctgaggtcaggagttgaagaccagcctggccaacatggtgaaaccccatctctactgaaaatacaaaaattagctggacatgttggcgcacacctgtaatcccagctacttgggaggctgatcttggagaatcgcttgaatctgggaggcggaggttgcagtgagccaagattgtgccactgcactctagcctgggcgaaagagtgagattccatctcaaaagaaaaaaaaaaagtaaactacaaagttgattataactgtttgaaacatgcatcctttcacacatcataagaccagtgcacaaaaagagtgcacttcatgcctgtatattttaaagaatagaatgaacactgggtacccgctagctcacttgaggcatagatcatcaccaggtacctagaggcctcctctgggcttaccctggtctctttgcctcagaggttgtcactgatgtgaaagctgcccatcttgatcctgtagtcagccatgagggcttgtggccttaaatgctgcctttttttcttgtctttgatgtttatgtaaatgatgtctttgtgtactttgggactttcttgctcaacactgttattgaaatttacctgtgtagtggcaggaagttgtacttcattctttttcactgctatgtgttgtgtctttggtataactgctacacaactgattgaggcaatggtactgctttgaacatcctcgtgcctattttctggtgcaaaagtgtgagagtttcaaggtgcctgggagtggggttgttgggtctgaaggtatgcacatttttaactttacaaggtgctgccaaattgtttccaaagtggtcacacccatttcccaagttccatagtgggtgccccacattatccccagtgcttgataattttgtacgcacccttttcaggttagaaaatctctctggggccgggcacggtggctcacttctgtaatcccagcactttgggaggccgagacgggtgtaggtcaggagatcgagaccatcctggctaacacggtgaaaccttgtctctactaaaaatacaaaaaattagccgggcgtagtggtgggctcctgtagtcccagctactcgggaggctgaggcaggagatggcatgagaggcggagcttgcagtgagccgagatcgtgccactgcactccagcccaggcgactgagcaagactctgtctcaaaaaaaaaataagaaaatctctcacgtcaccctccagggtaatagctgtccattacttattccttagttggcaaagtctatagtaacaaggtgctgtggattcagtagcacctttccccccgttctagtgccactgcattatttatttatttatttatttatttatttatttctatttttttttttgagacaaagtctcgctctgtcacccaggctggagtgcagtggcgtgatctcagctcactgcaacctccacctcctgggttccagcaattctcctgcctcagcctcccaagtagctgggactacaggtgcacgccaccacgtccggctaatttttgtattttttttgtagagacggggtttcaccatattcaccaggctggtttcgaactcctgacctcgtgatctgcccgccttggcctcccaaagtgctgggattacaggcgcaagccactgcacccagccgccagtgcattttttaaaaaaacgtttttattttgaagtaattatagatccacaggaagtagggggcaatacacagggacatcctgtgtattcattacccagcatcctccatcttgcttaactatagtacaataacacagactgaaaattctcggtgccacagccacagaggtccttcagacagcaccagttgtgcatgtagtgagtgtgagtgtgtgtgtgtgtgtgtgtgtgtgtttgtgtttgtgaatgcagtcttaccatgggtagctttgtggaaccaccaccacagtcaggacacagaattgctccttcactgcaaggcaccctcatgcttcctttcatagctacactgacatccttcccacccaatctgcaaccccttgtgtctttgtccactttgtgctgctgtaacacctgagactaggttgtttataaagaatagaagaaatttattctctaacagctctagaggctgtaagtccaaatcatggcaccagcatttggtctggtgagggccttcttgctgtgtcctcacatggcataaggcagaaggacaaaaaggaatgaactttccttcagaaggccaggaaagaggttaacccactcccacaagcctttttatagcgacatgaattcattcctgatggtggatccctcacaacctaaacactttcccaaagaccccaccacccaacactgttgcactggggaataagtttccaacacatgaattttggagggacaaaaacattcaagccacagcactggcaaccactgatctgtcccctgtctttctaattattatttcaagaatgtcatataaatggaatctatggtatataaccttttgagttttgtttaacctaccatgattcccctgagatccatccaggttgttttgtatattaatatgttattcctttttattgctgggcagtatcccatggtatagaggtaccagagtttatttgttgaaggacatttggatgatttccaggttggggctattatacataaaactcgctatgtacattcatgtataggtttttgtgtgaacagagttttaatttctctgggataattgcacttacaaatgcagttgttggtttgcatggtagttgcagatatactcttataagagactgtcaaactgttttccaaagtggctgtaccattttactagtaggacttttaaagtagcgtgtgtgtgtgtgtatgtattttttttgaggtatggtctgggtctgctgcccaggttggagtgcagtggcttgatcacagatcactgcaacttctacctcctggctaaagcaatcctcctgcctcagcctcccaagtagctaggactacaggtgcgtacctccatgcatggctaatttttgcttttctgtttttgtagagactgggtttcgtcatgttgctcaggctggtcttgaacccctgagctcaagcaatcctcccacctcagcctcccaaagtgctgggactacaggcatgagccaccacgcctggcctttatatgtatatttttgatcatagtaacatcagtatgcaattaaagagtaataatatgtatgtaaaataaagacacgaatatttattcaactctagacaacgtttgatgccataatgggtttaaaataactctgggagcctgggaatctagtctctagattggaaaccactgaactgggtattttattattaaaaacaataatcattattattttttccattgtaataacatgtaaaaaaacatatttcccatatgctcagtggagaaaatttggaaataaggaaagtagcaagaagaagtggggggaaagaggcacccataattctattacccagagtcaaaaacatcttttaacactttttctgtgcattaaaaacaaaaaaagaaaattatacctccatcatttctggtgtgacctgcattgtgacagcacaatgttggccagttatggtgcagaaaacagtgctacccctgggagcctggagtgtggtgggagatagctccaatagtggcaggtgctgtgcaggaagaggctcgtgtgaaagtactggagggctgccatggggcacggtgatggggacatggggccatgccgtctgcacaaggccaagtggaagagcagatttttcacggtaaatgtaggcagaccctttttttttcctggttgtctaacctattattgtagaagtgctcatatacattcttttccatctgtgctttggcaggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtaacagggtctgggtgtgtgtgggtacagctgcctgggcttttggcacatcttgatctttagttacagagagtcaggacaagactgagatcttttgtggctgagaaacgattcaagggctgggtgcagtggttcacgcctgtaatcccagcactttgggaggccgaggcaggtggattacctgaggtcaggagttggagaccagcctggccaacagggtgaaaccccgtctctactaaaaatacaaaaattagccgggcgtggtggcacacacctgtaatcccagctacttgggaggctgaggcaagagaatcactggaacccagagggcagtggctgcagtgagccgagattgtgccactgcattccagcctgggtgacagaatgagactcttgtctcaaataataataataataataataataataataatgtgtacaactcattggtttttagaatgttcagagttgtgcagtcattaccatagttggttttagaacattttcttcttcctagaaaggaaccccatacccattagctgtcacttcacattttctctcactgccattagtccctgggaaccactaatctgctttctgtctctctagatttgcctgttctggacatttcatataaatgagattatacaatgtgtggtcttttgtgtctggctgtcttcactcaacataatattttcaaggttcatccatgttggagcatgaatcaatacttcattttatgatcaaataatgctgtgttacatggatagtccacattttgtctctctcttcgtatttcatgttgatagaaaaaattttttttctactttttaacttatgaatggtgctgcagtaaacatttgtgtacaagtttttgtgtggacatgtgttttctcttctcttggatacgtacctaggtttagaactgccaggtcatacagtaacttcatgtttaaactttcaaggagctgccagactgtttttcaaagcagctgcgccattttacattcccacagccgtgagttgggggggggctccagtttctctgcatccctccagtacttgttattatcttttttgccatacctatcctagtgggtgtgaggttatcaaatcttaacctaagaaacacaggctgggcgcggtggctcacgcctgtaatcccagcactttgggaggccgaggccggtggatcatgaggtcaggaggtcgagaccatcctggctaacgcggtgaaaccccgtctctactaaaaatacaaaaaaattacttgagcgtggtggcgggcgcctgtcgtcccagcttacttgggaggctgaagcaggagaatggcatgaacccaggaggcagagcttgcagtgagctgagatggcatcactgcactccaggctgagcgacagagcaagactccgtctaaaaataaataaataaataaataattgaaacattgacttgagacatagatccactgtgttttcctgtcgtggcaagcctcagatttgagaagctgtcacatttccagatcaaaccatgaagctacttggctttctgatgctgtggttttttttcttttgcttcacaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataactaaaataaaatgaaagctaaatctacacgctgtgaatgttgaa

SEQ ID NO: 1249 - DNA, 73220 bp, Homo sapiens
cagctaggtgcctccgctgtccgggctctagtcccgccctcgcccctccccgcccaccggcctcgcagtcaccgcggacgccaatcttgtgcatggagtcgccattttgctcctagagaggccgccaggagacccggcgctttcttccttctgcagctgaggctgcggcggggccggggctggggtcggggccaggtaggcgggcgggagccagtggcgagcggcagcgagggctggctggctccggcattgcggggcgcaggtgcaaggggcggggagcccgcggcgccggcaggcggacgggtcggggtccctgggtggtggctgcttgggggctcactggggcgatctcgcgcccgcggcccttccatttttccctcccttcttcctctcccgccaggggtcggcgggggcgggggacgggcgtccggtgcctgggctctctcctctccctgaggcgccgctggggagtcgaaccctgatgatgggacctgtggtgagcagccctgaaagcaagcccagacccagccattctccgtccctaagctgacacggagcccctgattttaatttacctggctttgctagttacgaatatatctctcacctcctaaaggatgattttatccaactcagaactcaccccagcagagattgagggggaaccgtgatgaaatttttaagtattctgcttgatgataataatttttctcttatgttaatgttggctccgtttgggtgtttagcttttgaaaggagtatgaaaatgcggaatggggctttggggcttgaggtgtgatctctagtgtttaaaaaatttaattgcacaaatagaaataattcacccacattattgaaccccactaaagcatatcctttttgtccatattcctttcctgctgccctcgtgtgtaccattattactcagttgtgatttgagctcgttccacttaaagtcattcatagatacttttgcgtcgtgttgaatatttattgaatttctattctgtgttttacttaattactttattatggaacctttacacaggtctggtgtacttgttctttgaaaagtcttatgttgaccaccatcactgagcatatagctttttccttatttccttgggataattacccgaagtggaaataccgaatcaaacttctgttttctttctttggcactattatataaattgttttccaaacaaggcatgtttacaatagacatttttcaaaatctgggtatttgtcctattttgctctctgtatgcagaattcagcggggtgccaagtcgttttctgtgtgggttgagagacaggctgtgcagcccactgttgcataggactaactactacaaatcatgctgagaccgagctatttttgctgcttagaggctttgcagccttgagtaagtttcttcatctggaaacctagcttccctgtctaaaatgggtctcattctagtgcttgcttcactgggttgtcataagcattgtgaacactcagatgttaggcatgagttaacattgtgttggagagataagcagagcctgggatcatacaggagtggaagagtaattcggtttagaatttgcccttcaaattctcatcaatattgatattaaaaacagatttccttggagtgaggcacatcactaataaacatacataataagtttttttatttttattttttttgcagagtcttgctctgtctcccgggctggagagcagtggcgcgatctcagctcactgcaacctctgcctcccgggttcaagcgattctcctgcctcagcctcctgagtagctgggattacaggcatgcgccaccacgcccggctaattttttgtatttttagtagagacagggtgtcaccacgtttgtcaggttggtctcaaactcctgaccttgtgatctgcctgccttggcctcccaaagtgctgggattacaagcgtgagccaccatgcccatccaataaacataaatttttatactttttaattttttgacacagagtcttgctctgttgcccaggttggagtgtagtggcgcgatctcagctcactgcaacctctgcctcccaagttcaagcgattctcctgcctcagctgcgcaagtagctggggttacaggtgcatgccaccacacctggctcatttttgtattttttagtaggggtttcgccttgttgaccaggctggtctcgaactcctgacctcaggtgatccgtccaccttggcctcccaaagtgctgggattacaggcctgaggcactgcgcctggccggtttttatactttatgatgccttttagttcatctttcaatttcatttgttaatcattgtgactcattgaagtcaggcattattcagcaatcatttgtttagcctctaccgtgtggcagctgcacagggtatacagcagagaatatcatggtaaaaaatagtctctgctgcctggaccttaaattctgatggggaaatctttttaccaaggttatatctcttgtctggaaggtaaaggctgaggcccagcaaggacaagtgatgtccacatggcctagtagctggaaggcaaacccaactcttcacactcctacttcagccatctttaagtagaaggtatttacacagtagatgctttagagggaagacaacacacttcaatgtgagtcttccccatctgaaatgtgggtgagtggttttgaaatgactgctagtctgtccaaaggaaatgatctctcagtgtggtttcttcattcatgagacttaacattctaaaatcttattcaaaagaggagtatgatttgctctttaaaaggtgctaagattctctgaaaacggtgtgttttcatacatgttataaataattctcacacattctagagtaaatttagaataaacataaagcagttatagctcatggggaaaataagggagtgttctcatttcacactaaaaccttgtgctaacaagcctcctgccagccccatctcgatgattattatgtttttgaggatagtctttataactcttttcttgaagcttggtaaagaacacagccttaattaccaacaggagaaaggagaactaaaactacaagcaggcattatggccgggcgcagtggctcatgcctgtaatcccagcactttaggaggctgaggcgggtggattacctgagcttgggagtttgagaccagcctgaccaacatggagaaaccctgtctctactaaaaatacaaaattagacgggtgtggtggcgcatgcctgtaatcccagctactcaggaggctgaggcaggagaatcgcttgaaccggggaggcggaggttatagtgagccgcaatcgcgccattgctctccagcctgggcaacaagagtgaaactccatcttaaaaaaaaaaaaaagaaaaaaaagaaaaataaacagcccttatgtttgaataacttgtgaagtgaatagtcacaaaacatgactatgttgatagtcatttccaagtggatgctccccagtccactccaccatgtcattttgagggtggtcttaggttaggattctatatagaagcctatatctgaagtctagaacgtcagagaccacatgcagggtgttgcaggccattttaaaccatgagagataaggaaagacttcaggaaatatcctggaaaaaatatacaaaggcaggagagctatcttgaaatagtttggaggccatcctgtggaaaaggaatttgatgtttcccataaatctctaaggagagtacaagaaccagtgggcagaagctgcaggaagaggaatctcagcatgttcttttgtttgtttgtttgtttgttttgagacagtcttgctctgtcacccaggctggcgtgcagtggtgcagtctctactcactgcaacctccgcctcccaggttcaagcgattcacctgcctcagcctcgtgagtagctgggactacaggtgtgtgccaccaggcctagctaatttttgcatttttagtagaaatgaggtttcaccatgttggccagactggtcttgaacttctgacctcaggtaatccgcctgcctcgctctcccaatttgctgggattataggcatgagccacggcgcctggccacagcatgttctaaggaagaatttggaatgatgggccctcagcggatgtgggcatcagaccctggggctgttcaagcttctgttgagtggttccttggcaggattcctacagatgggctttgaacaaaagatttaggagggatgggctgaactacctctaagatctcttcctacctctaaaatactttcattctaagtgttccaactcctatcaggaatcctgctgtactttaaggagcttcttatttgaaggttagggggtgtaaaaaaaatgcccctccccccatggctgttactgtacttatatggtagataatcaagatgttagaagtcagttcataggtagcatgtccgatatgcagggcactgtgttaagtgccttgcagaaattttacagtcacctgtggggtcagttttcacagttgtatggatggcagaactgaggctaagagattttgagtattagataacttatgcaagtcctcactgtgagtttaggggaagtatttcaagatgcaaacatgagtttgactccaaatcctgtatttacaactacaggaaaattagtttgtttttatttattttcctggacctgtaacacccttttatttatttatttatttatttatttatttatttatttatttttctgagacagagtctcgctctgtctcccaggctggagtgcagtggcatgatctcagctcactgcccacttcgcctcccaggttcacgccattttcctgcctcagcctcccgagtagctgggactgtaggcgcccaccaccacgcccacctaattttttgtatttttagtagagacggggcttcactgtgttagccaggatggtcttgatctcctgacctcgtgatccacctgcctcggcctcccaaagtgctgggattacaggcatgagccaccgtgcccggcaattttttatttatttatttttttatttttttgagacgaggtcgcattcccatcgtccaggcaggagtgcagtgaagtggtgcaatcatggctcattgcagccctgaccatctgggctcaagtgatcctcccacctcattttttgatttttttgtagagactaggtctcactatgtagccgaggctggtctcaaactcttgggctcaagcagtcagcccaccttggcctcacaaggtgctgggattagcggtgtgagttgctgtgcctggccataccttttgttcttaaacacacatgtttattggttgagagatggctttagaagtatttaagatcccttccagaatgttgatgattaaacgtattctttctttcttttctttctttcttccctttctttcttcttctcttttcttttcttttctttatttgaaacggagtctcgctctgtcgcccaggctggagtgcagtggcgcgatcttggctcactgcaagctctgcctcctgggttcatgccattcttctgcctcagcctcccgattagctgggactacaggcacctgccaccacgcccggctaatcttttgtatttttagtggagacagcgtttcgccatgttgtccaggctggtctcgaacccctgacctcaggtgatccacccacctcggcctcccaaagtgctgggattacaggcgtaagccactgcgtggccttttttttttttttttttttttaattttttagatggagttttgttctcattgcccaggttggagtgcagtggatctcagctcactgcaacttctgcctcctgggtttaagcgattctcctgcctcagcctcatgagtagctgggattacaggcatgtaccaccatgcctggcttatttttatttttatttttttgtatttttagtagagatggggtttcaccatgttggtcaggctggtctcgaactcctggcctcaagtgatctgcccacctcagcctcccaaagtgctaggattacaggcgtgagccactgtgcctggccgtatataatttttatggaggtcacatgtataaatgcatagaaaaagtcttatgttgtccctaccaaactgataagaaccctcacttctggggaggacctgggatcgaggctggtgactttatccttaactatcatgtttcaggtttttttttttttctgagacggagtctcgctctgttgcccaggctggagtacagtggtgcaatcttggctcactgcaacctctgcctcctgagttcaagcgattctcaagcctcagcctctagagtagctgggactataggcagccaccaccacgcccagctcatttttgtatttttagtagagacagatttcacccttttggccaggctggtcttgaactcctgaccttgtgatccgcctgccttggcctcccaaagtgctgggattacaggtctgagccaccgcgcccagccatgtttcaggtttttatagggaggatgtgtttgtgttttacttgtataattaaaatttgagaataatgaaaaagattagcttagtttcagctcattgatgatctacaccagccttcccagaggtcccaggtgaacatacaactgtggaaatgcagtgggcttgctgagaaagggcccccctgcccacagcctgctggattgttgctgttcctcccatctagcatctccattatgtgatgaggacactcagcaatgatgacgactttttttttttgagatggagtcttgctgtgtcgccaggctggaagtgcagtggcacgatctcagctcactgcaacctctgcctcccaggttcacgtcattctcctacctcagcctcccgagtaggtgggactacaggcacgcgccaccatgcccagctattttttgtatttttagtagagacagggtttcaccatgttggccagggtggtcttgatctcttgatctcgtgatctgcctgccttggcttcccaaagtgctaggattacaggcgtgagccaccacatctgaccagcactgatgatttataagccagggacctttttatttttggcccactgccaaaatttgggtgtgaccaaaactgtcatttgggtggtcgcttaagtgtccttcaaggtgattatctagtcagcccgtgttccacttgaggaaaatgaagatgagaggtcagttttagacatgacacagggcagctgaaaggccgggaaaggttttatggtaaacaaggattacaggaaaagctgggtgtagatgggtcatttattctttgtctaaggattaatcagtccttgttctcgctaatggctctgccatttttctgtgtgttaatccaggaggaattttgttgtcagagaataaaaggaggttgtccataattgactttaagcagcaatcagtaaaacattgagctcttcagctccgcctttcttgtaagtttatcatttcttcttagtggttgtgaacatcatgtgataatgtatttccataaatttaggaccctgaaatccaactgaactttctgtttgtccatatatatctaatatttaaaaaatactattaggatggaaactaatttccttcagctgaagtcatttcctttaaaaaaaattcattcaggtatatttcatatcatatggcagtttttaataagtattatatccttctaggctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagtgagttataattgtaccattaaaatctatattcattatgtgatgctttaaatttgataatcagattagcagttattgttaaatttgaaagcagatattttataattataaaataattatatctttttttcatcatgtatcttttttttcatcatgcaagatgttcatgtagtatgtctcatctgtatatattaagggctattctttttgtaaactatcccatctccctacatattctttcagcagacatttattgagtgccttataagtgccagggattgtgttagatgctatatatatatataattatttgagtataaagcacactggggccaggcgcggtggctcacgcctgtaatcccagcactttgggaggccaaggcgggtgtatcacgaggtcaggagattgagaccatcctagttaacaaggtgaaaccccgcgtctactaaaaatacaaaaaattagttgggcgtggtggcgggcacctgtagtcccagctacttgggaggctgaggcaggagaatcgcttgaacgcaggagggttgcagtgagctgagattgcaccactgcactccagcctgggcaacagaacgagactctgtctcaaaaaaagaacattaacatgtatattatatgaaataacttatagcttatagtttagtataattttagatatttattaaacaaatattgtacccctactactgtgtactagaccttgatctagatgttggggattatcagtgagtcaagatccatcctttttatgaaatttacattttagtatgggagccaaacagaaatcaagtcaacaaaacaaacaaggtaatttcagatgatgtcaatgctatgaagaaaactgtgtgaaagtaatgatggggcaggttgttctgctttagcatgtgtgctgaagtgcttttaaactgaagggatggtgtgtgagttgagaaacctgaatgagccaccaagtgaaggtctggaggcagaacccccccaagcagaggggacagcagattccaagcctctgcagcatgcaggaggagttcttggtgtgtctcaggaacgtgggctggagtacagagtgtccaaggaagatggctagtgaggcaggcagagcgggactgcatagtccttcctggggagacatggggttggggtgaggggctaggtaatggattgatgtaacaatttaatgttgactttaaattttataagaagaataactttattttattttactcttatcgatttacgagtctccttaaatagtaaagatactgggtttcttctattactttttcagctttttccccctttctcttctctaggcggctaggggtggagatgggcaaagtgcaggtttaccaggaacctaacagaggtgagctatcttgggcatgtggaacattgacctttttgtgaaatgtggcatattggctccgtccttcatcctttactattgaaacgatttgattcagttgtacatttccattagcaagaagtcaggcaggcaaggtagaacagagtggttttttagctctcactaataccagctagatatctaaccctggtgcaagtcatttctggggcttgaactgcagttctgagacttcattcagtaaaagctgcagacatatttgaaccagctggtcaactgaatgaacatgagctcaactgttgcttaaatttatgtcaccttaggaaggatgagtaaatcctgtcaccttagacaggatgactaaatcctgtgtgaccgcagttttagttagtctttatttgcacctaagctgccttgggttagacttcataaaatattgttaagaaatactttttgctaattgatacatgtcattacataattctcccaagttgtaaaaagaagtgttatttaacctttgtaggtccaggtgtgctggctcatgcatctaatgccagcactttgggaggctgaggcaggcagattccttgagctcaggagttgagaccagcctgggcaacacggcaaaaccctgtctctactaaaaatacaaaaattagccaggagtggtggtttgcacttgtagtcccagctactagggaggctgaggtggaaggatcgcttgagcccaggaggtggaggctgcagtgaagtgtgatcataccacagagtgagaccctgtctcaaaaataaataaataaataaatagaaagtgatctttgtaatttctttagcaatggtggatatttgaaattattttaggccaggcgtggtggctcacgcctgtaatcccagcactttgggaggccgaggtgggcggatcacctgaggtcaggagttcgtagaccagcctggccaacatgatgaaaccctgtctctactaaaaatacaaaaatttgctgggcttggtggcaggcgcctataatcccagctcctgggaaggctgaggcaggagaatcgcttgaacccgggcggtggaggttgcagtgagccaagattgtgccattgcactccagcctgggggggaacaagagcgagactttgtctcaggggaaaaaaaaaaaaaaagaaattattttagcaggagcgatggacagcttgcatgggcttgagagttacacaccttatccttgacaagttatttaacctttctaaactataaataaactgtaaattagggctgttttgaggattaagtgggataacttgtgtgcctaccagtttttggcacacagtaggtgctcaatatatacttattcctgttccttttccactagaagatttaaaaaaacattttttttttttttggtagaacaagggtctcattatgttgcccaggcttatctcaaactctgggcaaaagcagttctcctatttcagccccccaaagtgctaggattacaggtgtgagccaccaggcctggcccctctacaggattttatcaaatatttacatattataaagcctacaggaggctttgataaaaaggcacaagttttgctgttcccatgtttatctccgttcctgcctcttttctgtctcccaagatccctatgtggcgtcagtagggaaaaagtataattaaactctgcaaggagagtttggagaagattcttcctctagaggggattgaatgatgttctttgtctggagtctaggagggaaggtgaaagggagaagcagtggcataagactccaggagactggtccactctccaagtttctgaataaagggagagaaaatacttggtgtttattgggaaggaaggaagtaatatttgtgaatttcttactgttaccagatactgaaaaactgagttcaggagttcagggattgatgttaggtacgaggtccagtttgaatccagatctccctgactctaaagctcattttcttttcttttcttttcttttttttttttttgagacagggtctttctgtgtcactcaggctggggtgtagtggcatgatcagggctcactgcagcctctgcctcctgggctcatgtgcttctcccaccttagcctccccagtagctggtactacaggtgggcaccatgctgccaggctattttttttttttttttaaatatggagtcttgctctgtcacccaggctggagtgcagtggggcaacctcggctcactgccacctccgcctcccaggttcgagtgattctcgtgcctcagcctcccaaagtgctgggattacaggtgtgagctacacacacacacccagccataatttttttttttttttgatacggggctttgccatcttgctcaggctggtaaagctcattttcttaacatcataccacatttcttttgtaaacttgtattctgttttttccaacatttttttttttctcttatcctcacaatctgttcccattttgctactttttttttgtgtgtgtgtgtgtgtgtgtgtgagacagagtcttgctccattgcccaggctggagtacagtggcgcaatcttggctcactgcaacatccgcctctcaggttcaagcgatactcctgcctcagcctcccaaataggtgggcttacaggtgtgtgccagcacgcccggctaattttttgtgttgttggtggagacgggctttcaccatgttggccaggttggtctcaaacttctgacctcaaatgatcatccacctcagcctcccaaactattttcctacatttttaatgaaaatgttcaaacatataaaaaagttgaaagaatagtacagtgaactaccgcctagcttgaacagttaacattttgccatatgaatatgtatgtggcgaaccatttgaaattaagtgcaggccgggtgcggtggctcactcctgtaatcccagcacgttgggatgctgagctgggtgaatctcttcagcctgggaggtcaagactgcagtgagccatatttgcaccactgtaccacagcctaggcaacagggcgagatgtgtcccaaaaaaagaaaaaaaatgtaagttgcagacagttaatccttgaatacttgaccatgcatcctctaggaataattactttcacctaaataaatatgataccattatcacatttaaagaaattaactacaggcagggcatggtggctcacacctgtaatcccagcactttgtgggggtcaaggtgggtggatcacttgagaccagaagtttgagaccaacctgggcaacatggcaaaaccccatctttaccaaagataaagaaattagccagggttggtggcacacagctgtaatcctagctacttgggaggctgaggcaggaagatcacttgagtccgggaggtggaggttgcagtgagctgggatcacgccgctgcactccagcccgggcaacagagcaagaccttgtctcaaaaaaaaaaaaaaaagaaaaggaaaagaaaattaacttaacaattaaggacaattctttttttttctgtggcctcaagtgatctgcccgccttggcctcccaaagtgctgggattacaggtgtgagacaccgcacccagcccaacaacaattctttaatcatctaatatatggcctatattcacatttccctaattgtcctaaagggtcttttattttttatttttttgagatggaatctggctttgtcacccaggctggagtgcagtggtgcgatcttggcttactgcaacctctgcctcccaggttcaagcagttctcctgcctcagcctcctgagtagctgggattataggtgtgtgccaccaagcccagctaatgtttgtatttttagtagagacgaggtttcaccatgttggccaggctagccttaaacacctaacctcagattatccgcctgcctgggcctcccaaagttctggtattacatgtgtgagccaccgtgcccagcctaaagggtcttttatagttgttttttccaacacctccaccccaaaccaggattcttagttcaagggattttttttaaaaaatatctctttagtctcttctattttagaacaatcccctcacctcttccgttttcttcctgtgacagtgaagaggttgtcttgtagaatgtcccattatggatttgtctaattgtttctttatgactgatcacacatattttgagagtagggatattaggtcttatttatctttgtttctcacaacatacaatgttttgtacctaatacattctgaattgataattgatgctgattgaatgagtatataattttcttttttttttttttttttttttttgagacggagtttcgctcttgttgcccaggctggagtgcaatggcacaatctcggctcaccgcaacctccgcctcctgggttcaagcgattctcctgcctcagcctcccgagtagctaggattataggcatgcaccaccacgcctggctaattttgtatttttagtagagacggggtttctctatgttggtcaggctggtctcgaactcctaacctcaggtgatttgcccgccttggcctcccaaagtgctgggattacaggcatgagccactgtgcctggcctatgattgtctataaagatactgtgctcaggctgggcacggtagctcacacctgtaatcccagtactttgggaggctgaggcaggcagatcgcgaggtcaggagatcgagaccatcctggctaacatggtgaaaccctgtctctactaaaaaaatacaaaacagttagctggatgtggtggcgggcgcctgtagttccagccactcgggaggctgaggcaggagaatggcatgaacccaggaggcagagcttgcagtgagccaagatcgcaccactgcattccagcgtgggcgacagagcaagactccgtctcaaaaaaaaaaaaaaaaaagttaccatgctcggagtggtacagcactcaactgtttgtatatataaggggtgagaattatacatttacttatttcaagtcagaaatgtaattctctcttaaagctgtgttttaaaaagtgattaatggcagtatgtgtattatcccttgtaacatctaaagcctactgagtcttataacagtttgagttgccatattctattacattagggaataatacagatttttttgtgtattttgaaaaatttgaactatatgcctttccctctcttctttttccttttcctgccagaaacaagagtacaaattcaagagtctgtgaggggaaaagatgttttcatcatccaaactgtttcgaagtgagtatccagcaaaagtgttgctttctgggtttcagtttaggcatgagtgtttaaaataatgatagatggctagccaggaagagttataatagtcttaaaattagtatatcttaccaatttagaatttagaaaactaagttttctgacataactgctgacttttacatgttctttcagtgtttttccttctttctttctttttttttttgagacaaagtcccactccttcacccaggctggagtgcagtggtgcaatctcagctcactgtaaccacctcctcccaggttctagtgattctcttgcctcagcctcccgagtagctggtactacagttggcgccaccacgcctggctaatttttgtatttttagtagagacggggtttcaccatgttggccagactggtcttgaactcctgacctcacgcaatctgcccgcctcggcctaccaaagtggtgggattacaggtatgagccaccgtgtccagccactcagtgttcttaacgggtggaaataaccaagtattggagtagaggctctttttttttttttttttttgagacagaatttcactcttgttgcccaggctggagtgcaatgacgcgatctcggcttaccgcaacctcagcttaccgcaacctctgcttcccaggttcaagcaattctgcctcagcctcctgagcagctgggattataggcatgtgtcaccacgcccggttaattttgtgtttctagtagagacagggtttctccatgttggtcaggctggtcttgaactcccgacctcaggtgatccacctgcctcagcctcccaaagtgctgggattacaggcgtgagccactgcgcccagcctggagtagaggctgttaatgataatagtatacattaagtttcctaacaattaacagccagaattttgtaaaacttgcaaggaagcatttctagttccctcctctccccaaaagaaacagaggctaggggaggagacctttcttagttggggttctttaagcttttattgcatataaaagtgatcattatttactgttttattacataaattagctgagaggataaaaaactgtactgaaggaatgtgtattcctgtctggtgtgacctttgacacacctgtgttctggaaattgtttggtcacatatgtttaagctaggtatagaagattcaatgcagcaaggctgtctctggcactctggaagggagggtgatcacctggagccctactttttttttttctttttcttttttctaagaggtagagtcttgctctgttgtccagtctggagtgcagtggtgagatcataactcactacaacttcaaactcctgggctcaaactatcctcctccctcagcctcccaagtagctgggactacaggcatgcaccagcatgctcacctcgttttttcattttttgtagagatggaggtctcactgtattgcccagctggtctcaaacttttggcctcaagtgatcctcctgccttgacctcctatattgctgagattccagcaatatagaaggtgagcctatcacacctggccttaaagccccactttccattgtgtgtttgtccacaaatgtccctaaatgcttctgtgtatgaagttcttcgctcagaacaatttttaatgtctagaaatcagtttgtctagtgcattattttttagcttagagagtctgaaagttgctgcatgcttaatttgtgtatatacatatataaaaccaacgaaagggaaaaagaaggccatttcgggagactttagtcttggaacacacatttttttcacctaaattttgaacattttctctcctggtctttggtttattgggatgaagtcacaaaacccccatctctcctgggaagaggagtggcaggggagacctgtccttgcatcctatagccctggcaaacgggtgtgctctgaaggaggaagggtgtggagggcctttgccacggtgccctagcttcaccttctgctgtgacacccaggattctcagcagagctggaggtgggggcacggagcgccaactgcccctgctgctgctgtcctctttcccctttcccacgtctgccaccaaaccagggtggaagtggaggactcacctgtgcccacatcttaaccctttacctccagcatcggggtagggaaggggcgggcacagaacaacttaaacggcttctggctccttggtttctgtgtctgtggtacttttatgtccttacagacaagtgtgattccattggataaatgcacagaggttgtgtggattacccaaggggatgggtaggcattgagggcacccctggacttagaatttaggacttcagaagggtgactgctgatccttctcattttcaagtccttctggttgtttatttttgtacatttcaatacttatcctgtgcccctgtcttttgtcagtttcatattcctctaatcagaatcactcagcacccctttcattttctctccgtgtctcattttgcattgttccatacctgacataagcttgtgttaactcgggttctcagtcttgtccatgttgcagagtctggacgtcatggtcttctttgtgaaataccatgaaataacatttagtgttgagggccagatgtggtggctcatgcctgtaatcctagcactttgggaggtcgaggtgggcatatcagttgaggccaggagtttgagaccagccaggccaacacggtgaaaccctgtctttactaaaaatacaaaaaattagctgggcatggtcatgagcgcctgtagtcccagctactcaggtggctgaggcacgagaattgcttgaacgcaggaggcagaggttgtagtgagctgagatcacgccactggattccagcctgggtaaaagaacaaggctccatctcgaagtaaaaaaaaaaaaggctgggcgaggtggcttacacctataatcccagagctttgggaggccgaggcgggcagatcaggagttcaagaccagcctggccaacatggtgaaaccctgtctctactgaaaatacaaaaattagctgggcgtggtgatatgcgcttctaattccagctacttgggaggctgaggcatgagaatcgcttgaacccaggagacagagggtgcagtgagccaagatggcgccactatactccaggctgggtgatagagtgagactctgtctcaaaaaaaaaaaaaaaaagcctgtaatcccaccactttgggaggccccaggcgtgcagatcacctgaggtcgggagttcaagaccagcctgaccaacatggagaaacgctctctctgctaaaaatgcaaaattagccgggcatggtggcgcatgcctgtgatctcagctactcgggaggctgagacaggagaattgcttgatcctgggaggcggaggttgcggtgagccgagatcatgccattgcactccagcctgggcaacaagagcagaactccgtctcaaaaacaaacaaacaaaaaaatgatttagtgttgtcagatacatcttatacttcattttactacagattagtgctagcactaaaaataaaagagaaatttaaaattaagaaaattccatccattaactgaagttttcctgtatttcaaacaagactgtccttatctgagttcagtaatggaaagccttgttcctccactcttatccttcccatagaatacttttctgaaaatctttttttttcctaagttaattaacagggtgaaagtctcttttaactcatcagatgtcagacttgttgtatagtgacagagaacctactcacctgaatgttctgtgtttccattcactccttctttcattaacaaatacttattttgaatgtctacaatatgtgaattacagttagttacacgtatgcaggatgcctccatgattaaaacagagaaagtccttgtccttgtggagtttatattccagtggaggaagacataaagtgagcataataaagacatagattatctagaaggtgatgaatggtttggaaaaaaataagacagcatggtgagatgatagtggtgagagggcagagagaggcagacagggtaggcctcattgtggaggtgacatttgaacagagactagagaaggtgagggagagtcaggtgactaggtggggagaaaagcattgcaggcagtgggaacgcctagagcaagccccttagcggtgtgagctgctgtgggaggactgaacagggtcaggtgtggccaggcaggaggggaggggcagatcctcaagtttggactggagttgtaaatttgagagttgccaccatctatgaagctgtgaaattagatgagaagcccaaaggacgagagggaacagaaagagaggacacatgagcaagtcctgggacgtgaggctggggagaagaggaaccagcaaaagaaaccaagggtggaaggaggacaccagagaggggcattctggaagccaagtgaccgtggacatggccgcatggaggccactgatgacctttatgaaaacaaagcttcactggactatttgggagagactgagagtagataaattggagatagtgtaagatgtacagcaaaggggagcagaggggagagtggttatgagtcgtgttaatggaagtaacagaatgtttgtggccgatgggttatcagtggtggaggcaggagaggagagagaattccttacataggtgtgccatttggagggattaattttagggccactggcatggaaatttcctctgactgatgactgagggcaggccgactcctggggcacagatgcacatagtgggagcttgtggacacgctcctctgagagtacttaagtagggtggtcagttgagagcagatgatgggggatcttatggaggcctgagaaaagaggaatttattggttggtttttttctgccttgcaccttaggttgtataaaggcatgagtaacacactgctgacactttttggaacagggaatactgtgttgtagatcccttgatgagatttgctgtgtctttgttacagggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtaagaatggcagatgtttcacaattaattgggggcctgggagttttatttatttattctctcttttttaagacagggtcttgccctgtcacctaggctggagtgtagtggcgtgatcatagctcactgcaacttgaactcctacagtcaagcagtccaccagagcctcccaagtagctaggactataggcacataccaccctgcctgctaatttttaaattttttgtagatactgggtcttactatgttgttcaggctggttttgaactgctggcctcaagggatgtttctgctccagcctcccagggtgctgagattatagtcatgaaccaccataccctgctggagttttatttttaccttagaaatatcaaagtaatggctgggcacagcagctcacgcctgcaatcccaatgctttgggaagctatgtgggatgatctttgaactcctgggctcaagtgatccccctgagtagttggaactatggacatataccaccgtgcctgcctagataggcatatattggaaaagatacatattattctgtgtcaggcattttcaggtaacaacctaagtatttttcctgtgtttctaaataaccttcatagttgttattgggtatttgtgtcaatatatttgtgtttgtgtgtgtgcgcgcttgtataagtgtatatgattttatttatttatttatttattttgagatggagtttcgctcctgttgcccaggctggagtgcaatggcatgatcttcgctcaccacaacctccacctccccggttcaagcgattctcctgcctcagcctcccaagtagctgggattacaggcatgcgccaccacgcccggctaattttgtatttttagtagagacagggtttctccatgttggtcaggctggtctcaaactcccgaccccgcctcagactcccaaagtgctgggattacaggcgtaagccactgcacccggcctatgatttttttattttaatttttattctgtttatttattttttgagacggagtcttgctccgttgcccaggctggagtgcagtggtggcacctcggctcactgcaaccactgtctcctgggttcaagcgatttttgtaccttagcttctctagtagctgggactacaggtgcctgccaccacactcagctaatttttgtatttttagtagagatggggttttgccatgttggccaggctggtctcgaactcctgacctcaagtgatccacctgctttgggctcctaaaattctgggattacagacacaagccaccatagccagcctgaatgtatatgattttagaaggtatgtatcacggagcatttgcacagagtgaatagaataaaagtccccatatcactgcattttaagacaggtacttactgtagaataaacctttttttttgtttgttttttgagacggagtcttgctctgttgcccagtctggagtgcaatgacgtgatcttggctcactgcaacctccaccacccgggttcaagcaattctcctgcctcagcccccagagtagctgggattgcaggcacacaccaacatgcccaactaattattattatttttattttttatttttgagtctcacctgtcatccaggctggagtgcagtagcgtgatctcggctcaccgcaacctccacttcctgggtttaagcgattcacctgcctcagcctcctgagtagctgggattactggcgcccaccaccacgcctggctaatttttgtatttttagtagagacgaggtttcaccatgttggccatgcttgtctcgaactcttgacctcaggtgatccaccttcctcagcctcccaaagtgttgggattacaggcgtgagccaccacgcccagcccagaataaactttctaagatagtttttcagtaaaggcaaacgtaaaacaaacatttaaaaactaggcagggtgtggtggctcacgcctgtaatcccagcactttgggagaaccagggggcgatcacctgaggttgggagttcagagcagcctaaccaacatggaaaaaccccgtctctactaacaatacaaaattagccgggtgtggtgacacatgcctgtaatcccagctactcgggagtctgaggcaggagaattgcttgaacccgggaggtggaggttgtggtgaaccaagatcatgccgttgcactccagcctgggcaacaagagcaaaactccgtctcaaaaaaataaaaataaaattaaaaactcaacccgaagcaacctcaggagcctaccccattgtaaacactatgacaggcagctggtgaggagagcaggcttgcctgctgaatcttcaggaaagggcccatcttctctaccagccttgcttgatgggcctccagacttactttcctgttcttttgggcaagtaatgctttaaacaatttttcatactgaattttccttacacttttctggtgatcgttacaaaggtggtgaaggttttctgttttctccaatttccaggctggtgcagtttgtcttgatatctttttttttccccatgggtctcagtcctcttgcccgggctggggtgcagtggtgtgatcactgctcactaccaggaggtagccttgacctcctgggttcaagtgatcctccgaccttagcttccagagtaactagggactacaggcatgcatcaccatacctgactagttttttgtatttttagtagaaatggagtctcaccatgtggcccaggccattttcaaacacctgggctcaagtgatactcctgcctcggcctcccaaagtgctgggtttacaggcatgagccaccacacccggctgacttgttatcttaagactggactttgccatgcctgttaaacttcaagaagatttgatctgctctaatataatttttaaagactcttctgtattactgttatctttgctatattatgactattttttatttatttattttttcgagatggagtctcgctctgtcgcccaggctggagtgcagtggcatgatctcagctcactgcaacctccacctcctggattcaagtgattctcctgcctcagcctccctagaagctgagattacaggcacatgccaccacacttggctaatttttgtatttttagtagagacggggtttcaccgtgttggccaggctggtcttgaactcctgacctcaggtgatccgcctgcctcagccttccaaagtgctgggattacagctgtgagccatcgcacctgaccaagactttaaattgatgtgaaaatcaggcatctcacagtactaaaaaaaaaaaaattttttttgaaaaatacaagtgctgagtttttttgatggtagaacaattttgtctttttttttttgagaccaagtctccccctttcacccaggtcggagtgaagtggtgcgatctcggctcactgcaacctccgcccccccaggttcaagcgaattctcctgcctcagcctcccgagtagctgggattatgggcacgtgccaccatgcctggctaatttttgtgtttttagtagagatgaggtttcgccatgttggccaggctggtctccaactcctgacctcaggtgatccacccgcctcggcctcccaaagtgctgggattacaggcgtgagccaccgtgtccggccttattttttatttttttgaggcaagatctcactctgtcacccagactggaatgcagtggctcaatctcagctcacttgcagccttgaccttctgcactgaagcgattctcccaccttagcctcctgagtatctgggactacagatgtgcgccaccatgcctggctaatttttgttttgtagaggcggggttttgccatgttccccaggctgatctcaaactcctgagctcaagcagtttgtcagccttggccttcaaagtgctaggattacaggcgtgagccactgtgcccggccatgagagcaattttttttttttttttgagacggagtcttgctctgtcacccaggctggagtgcagtggcatgatcttggctcactgcaacctctgcctcccggattcaagctattcttctgcctcagcctcccaagtagctgggactacaggcacacgccaccacgcccagctaatttttgtatttttagtaaagatggggtttcatcatattggtcaggctggcgttgaactcctgaccttgtgatccacccacctcgccctcccaaagtgctgggattacaggcgtgagccacagtgcccggctggagagcaattttttaatagtaacttattgtatatagtattttatgtagtacctattttatacagtgcaacttgtttttaaactgtttataggctgggtgcagtggctcatgcctgtattcccagcactttgggaggctgaggcaggaggattacttgaggtcaggagttcgagaccaacctggccaatatgatgaaaccccttctctactaaaaatacagaattatctgggcgtggtggcatgcacctgtattcccagctactttcaaggctgaggtgagaggattgcttcagcctaggagttcaaggctgcagttagctatggtcatgccactgcactccagcctgggtgacagaatgggatcccatcttaaaaaaaaaaaacaaaaacaaaactatttattgcttgtgtctgctttattttcaaaggtctaactcatcttattactatggatttacaccagaaggaaattcagggcttcttcaatattcctgttgacaatttaagagcatctcccttcttattacagtatattcaagaagaggtgagctagctcaaacttttttattttaacattctgattaaggttgaaagatgtatttccatttccttaggatacccctaaaggattaaaacttgatgtattgtacttaaagtaccattatactttatagctataatccaacgcattttagaattctgaatctgcagtttgtttctttagataagctcttaaaattgctttttcttttggacctcaagtacctagaattggactagatatgattgtaatgagtaatttactctcattactagtctatgcttgatcctggttctgttttatgtatccatctatccatcctgtctctctgtccatccagttataatagccagcatccatgatcccacctcccagcaagaaaactagagtcatcatcataacttagagctgctcatgggctccttctctgtcctatccccctgcctccttccaccctagggaaccactgtcctgaagcggtgctgaatctgtcagatgctttttctgtatcagtggagatgatcattttttttccttcattctgttaatgtggtttattaccacccttgaatcctgggataaatcagatgtttaattttaatatagctacatttgtttttctttgatatgagttagcatttttgtgacttactatttaagaaagcttttaaaatgttaatttatactgtacttagctattttgcttttagctgtttttctttctttttttttttttttggtggggggtgtgatggagtcactcccaggctggagtgtaatggcgcaatctcagcccactgaaacctccacctcccgggttcaagcaattctcgagtagctgggattacaggcatgcgccaacacagctggctaattttttgtatctttagtagagatggggtttcaccatgttggccaggctgatctcgaacgctgacctcgtgatctgcctgcctcggcctcccaaagtgctgggattacaggcatgagccaccgcacctggccttagcggtttttcttatataaattatttctctctttaataacttttctagataacttctttttacagtactgtatttaaaagaagataacttctttttacagtactgtatttaaaagatggcagtttataggtttctgaggaacttctttctggtaagaatacagggcttccccattctccagcaattgttataagtccttatagagaaaatgaatttaagtatttttgaaagagaaaaatgtaaaatattctgctttttttttttctttaaagttacacacaagaaacataaaaactctacgccaggcgcagtggctcacgcctataatcccagcactttgggagtctgaggcgggtggatcacttgaggtcaggagttcagaccagcctagccaacatggtgaaaccccatctctactaaaaatacataattagctggatgtggtggcgcgtgcctgtaatcccagttacttgggaggctgaggcaggagaattgcttgaacctgggaggtggaggttacagtgagccaggattgtgccacggcactcctgcctgggtgacagagcgagactatctcaaaaaaacaaaaaagaaaacaaaaatactctaacaaattaaaaaaataatagagactttaattttacctgaaaaattttatgttttttttttgagacagggtctttctctgtcacccaggttggagtgctgtagtgccatgatagctcactgcaaccttgaactcctgggctcaagagatttctcccacctcagccttctgagtagctgagactagaggtgtgccaccacacctagctaatttttaaaaaatatttccagagtcagaatcttgctgtgttacccaggctggtctcaaactcctggcctcaagcgatcctcctgcctcagcctcccaaaacagtgtgattacaggtgtgagccactgtgcctggcctaattttacctgaatattattcttagttgagagagaaggtgagataaaattggcaaatgtcttgatagggaaggatgaagaggtttaggcagagagagagtgagagggtgagcattgaacgtggttcagttagcaaccagccgcatggagaaacctgtcattttggaagaaatagagcagtcgctatagacttatgtgggttgctgtcgacatcttgttgttttaggggatgtttccattcaggacacaggcatgttgtgtgccaatgtctcaaggcacaaatggcaattgcacctcttaagggatgcccggtgggtgagcctaaagaacgaaggctggggcacccttgtgctggttgcaaggtcaggctggaagcctaacgctagtcattgcctgtagtgcaggcttctacctgaggatgacactgccttctacttgaaaaaatccccattttagtttcattgttgagaagaagtcagggctgagtgtggtggcccacacctataatcccagcactttgagaggctgaggaggttggatcagttgagtccaggagtttaagaccatcctcggcaatatggcaaaaccctgtctctacaaaaaatataaaaattaaccaggtgtggtggtgcattcctgtggtcccccctactcaagaggatgagaagtgggaggattgcttgagcctgggaggttgaagttgcccaggtggtcgaggctgcatcaagccgtgatctgggcgacagagtgagattccttctcacaaaaaaaaaaaaaaaaaaaaaaaaaattaatatgtgggaactcagtgttaaaaaggaatttttgtgtattgcttttttcttttttttggagacagtctctctctgtcactcaggctggagtgcgattttggcttactgcagcctccgcctcctgggttcaagcaagcatatctggctaatttttgttttttgtttttttttgagatggagtttcgctcttgttgcccaggctggagtgcaatggcatgatctcggctcacagcaacctccccctcccaggttcaagtgattgtcctgcctcagcctcccgagtagctggggttacaggcatgtgccaccacacccggctaattttgtatttttagtagagacagggtttctccttgttggtcaggctggtctcgaactcctgacctcaggtgatctgcccaccttggcctcccaaagtgctgggattacaggtgtgaaccaccgcacttggcctaatttttgtgtttttagtagagatagggtttcaccgtgttggccaggctggtcttgaacttctgaactccagtgatctgcctgcctcagcttcccaaagtcctggtattacaggcatgagctactacacctggcctgtattgcctttttatagtatacgtatcttgtctcttttgttttcgtgtgttagagcctcttaaagcaggggatagatattcatgtttcactgaatctaaggtgctgtcagtccaggcttacattattttacgtcaccaagaaagaagaaaacactgctaattatactgtggcactgtgccttcttgtcacttagtgatcctattctgcaggttttgatgctgacgctttctccatctcttgtgtttgtcactggaatttaagcaccttctgccagagtcagaaggaacattctggtactaggatgctcgttgccttgaaatttttgccatctatacttttttttttttttgagacggagtctcactctgtcgcccaggctggagtgcagtggcgcaatctcagcttactgcaagctccgcctcccgggttcacgccattctcctaggcctcagcctccccagtagctgggactacaggcacctaccaccacgcctggctaatttttttgtagttttagtagagatggggtttcaccgtgttaaccaggatggtctcaatctcctgacctaatgatctgcccgcctcagcctcccaaagtgctgggattacaggtgtgagccaccgcgcccagccaacttttgccatctcttctgagggcgtctgacagtgtctgttgccttccgctgcactgctggggatgtgtcaggcagtccttttcacagtttgacctactggtagggatcttcctttcttaagtttcataaagcatttgattgttgccttgcaagaaaatgtggaattgtatcatttttccagtgatgaatatttgattcatgaatatcaaattatactctgatggtctcttcctgtgtctttctgcatacatgataatttttcttttcttcttttttttttttttttttttttttgagacggagttttgctcttgttgcccaggctggagtgcagtggcgcaatctcagctcatcacaacctccgcctcccaggttcaagcgattctcctgcctcagcctcccgagtagctgggattacaggcatgggcccccatacctggctaattttgtatttttagtagaaagggggttttccatgttggtcaggctggtcttgaactcccaaactcaggttatccacccgcctcaacctcccagagtactgggattacaagcgtgaagccaccgtgcccggcttgataatttttcattttaatgaaaaattttaatgaaaagaatcatagtaattctttctggagacattttaaatgggttcaaacaattctcctgggttcaaacaattctccggcctcaacctcctgagtaactggattacaggtgtgcaccaccacgcctggctaattttgttttgcatttttagcagcgagggggtttcaccatgctggccaggctggtcttggctcagatgttctgcccaccttggcctcccaaagtgctgggattatgggcatgagccaccgtgcctggccatctttgggaattttttttaatctgttaagtatttcatcccttctatttcttttattattttcctttgggaactattaggtcctgaaaattttggatctagtctctataacttttaaaaacttattttactttttgcatacttatatatagcattctggggaaattccttgtcttgatcttccctggtttgttcttaaagttgtgtttattctgctgttaagccagccagctactgggtttctttagaccataataacttcttccccctagatttatttttggttctttttcataataacttgttctttcttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagtatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcctgggcggggcggctggccgggcggggggctgacccccccacctccctcccggacggggcggctggccggtcggggggctgaccccccacctccctcccggacggggcggctggccaggcagaggggctcctcacttcccagtaggggcggccgggcagaggcgcccctcacctcccggacggggcggctggccgggcaggggggctgaccccccccacctccctcccggacggggcggctggccgggcaggggggctgaccccccccacctccctcccggacggggcggctggccgggcggggggctgacccccccacctccctcgcggacggggcggctggccgggcagaggggctcctcacttcccagtaggggtggccgggcagaggcgcccctcacctcaacttgttctttcttgttgtatataatttcccattttaacctccgtagagacaatagacttgtttttgttagagtcctttcttttaggtcctttaattgttattaactgttttcttggttctgtcttttcttggctgggtttggtaatgtttgatgatgtttgatgagacaaggaaatacatgaaaaagtttagaaagactgccagcaaaaataatgaaagtgcccaaatggaaatatattttactgccttacttcctgagagtgttggataaattaggctttcctgtagatacagctgagccatgtgattatgccggaggcaactgtactaaattattcaaattaatcattttttgttcatttgctaagtagttattatttagtgcttgttgtatggtaggcattgttttatacatgttgctaggtgttattaactgctcatattaaaattcattggtgtaattgtgagaaaaaagcaatgagaatatagttaatatatttttttaaaatagtgctgggccgattatcctttaacaaattggttgcttcaacatgttatgactgcgatatgttaaatagccatttgtttggactgcagtaatttggaatttgacagtcagcttgtattcagattgaattggatatccttgtactttgaaattacatgtaattaggattcttgttgacgagatatatagaaacatctttacactgcatcattagtatttgctggcagagataagagctaatcaccaattatccctacttttttcctaaaagaagtctgtgtggctcacaagttagtaatattttttcataggcaggttcctttcttcattttccaaaggagaattttactttgaactttttctttttttggaaaactttcaactagccaagcatttttgggtctgttggaattttcctttttgttgacatgcagtaatacctgacttcttgtctgtcacagatcccagattacaggaatgcagtaatcgtggccaagtctccagcctcggcgaagaggtaggtgggaatctcacaacctctttctggatctacttctaaggattgtatccgtgatgagttccaggcattctaatttgaacttcagtggttcccagcgatatctcttatttttcttccatggactggtattttaagattgttctgtcaactccatttattaagtaaacattttaatttcctctcttttttttccaatcccactctatgattgccagacatacttccttttttaagttatcttccacttacactttcttttatttttattattattattatttattttattttatttctttattttttgagatggagtttcgctcttgttgcccaagctggagtgcagtggcgcgatctcggctcaccacaacctccacctcctgggttcaagcgattctcctgcctcagcctcccaagtagctgggattacaggcgtgcaccaccatgcctggctaatttttgtatttttagtagagatgaagtttcaccatgttggtcaggctggtctcaaactcctgacttcaggtgatccacctgccttggcctcccaaggtgctgggattacaggcgtgagccaccacactgggccttatttttatttttaatagtagaaacagagttttgccatgttgtccaggcaggtcttgaactactgaggctcaaacgatccacccacccgccttaccctcccaaagtgctgggattacaggcatgagccactgcgcctgacctcaatcatatttcttgaccaaagcaatccagttctggggaatacgatctagtgttttccccagacccagattgacaatcacatgtcagtctttgagtctggcgtttacagtactggcgaatatttacagtactagcagacaacttcatagttgtttactgccccttatttgaggaactcagaaattgattaacagaattttatccagctgagaggccagttatttgtatatgttaaaggtgacattttacaaaattgacacaacctgaggtgtaccaaagggggagccttgagagtcagtagagtgagttacatgtaacctggagtaactgatgtgtcactattgcatacttaaaattatatgtcggttgagaggatttcttatactaccagtgttttgtggagaagccactccactggagagggaaagaacaaaatcacttgtaggaataaagcctttttcctaaaaaagcccttttaaagttattttccagttgaatacctttgatcactggattgttgttgagtcctgtggaatgaaagaaagtgtagggtgcctccaccctgggctcgtgggctggcagtattgaaggatggaggagaacttgcacacagtaagccattgatttcaaaagtatttcacataagtcattgacgttatgaattaagaatagcactttaatatgtagacttagtatattaaataaaataaattggcatttgagataaaaccattacatggctgtgttcttgtggctgactttcccaacccagccgggcctgtgttcacccatgtgtccttcaagaagttgtatcacctgatctcctcttgtccatttgattaaattgtaagaaacagactgaattttagaatgtaaacatttcaaatagcttttccaaacatttcttcaaaggctgaattaattttacttaataatttttctctgatatacatgctttaaaaaaatgtaggtgaaaaatcacataatatacaataattttaaagtatagaattcactggcatttagtgcattcacaatgttgtgtaaccaccacctgtctctgttttcagaacattttcgtcttcccagaagaacatctagtacccattcagcaatcattccttatcccttcaccttctgtccctcggcagccacacagtatgtggccctctgtgtctggtttctttcacttagcagttttcaaggttcatctatggtgtagcatgtagtatctcagtgttttgttgtcgctgttattgttcgagacaaaatcttactctgttgccgaggctggagtgcagtggcacgatctcagctcactgcaacctccgcctcctgggttcaagcaattctcctgcctcatcctcccaggtagctggaattacaggtgcatgctaccacacctgggtaatttttgtatttctggtagagatgaggtttcaccatgttggtcaggctggtcttaaactcctgaccttgtgatctgcctgcctcggcctcccaaagtgctgggattacaggcgtgagccaccgcacttggccagtacctcagtccttttgatggctgagtaatattgcattgtatgtgtatactagtttgtttatccattcatctgttgatggacactttttttttttaccgtttggctattatgaataggactcctatggtcagtcatggattagtttttgtgttggcataagttttcatttttcctttcttgtggatatatattaggattggaattgctgggtcatatggcagtttcgtttatgttttgaggaactatcagtctcttttccactgcagctgcccattttacattcccaccagcagagtatgagggttccaacttctccacatcttcaccaacacttaattctctgagttttttcattataatcatcctagtgggtgtgaaattctaccttatcgtggttttcatttgcatttccctaatgattgatgatgttgagtatcttttttttttttttaatgagacagggtctcagtatgttgctcaggctgggctcaaactcttgggctcaatcaatccttctgcctcagcctgttgagtgtgtgtgtgtgtgtgtgtgtgtgtgtgtgtgtgtgtgtatttatttatttatttatttttttgagacagagtctcgctctgtcacccaggctggagtgcagtggcgcgatctcggctcactgcaacctccgcctcccaggtttaagcgattctcctgcctcagcctcctgagtagctgggattacaggcatgcgccaccatgcctagctgttgagtatatttttatgtgctttttggccatttgtatatatttggagaaatgcctgttcacaccctttgcccatttaataattgggttgtctttttgttgagttataagcactctttatatattctacatactaaaccttgttagatacatgatttgcagatattttctctctttctgcagattgtcttttcactgtcttgatggtgttctttcacacaaaaaggtttcaatgctgataaagttcaatttatctttttttttttttttttttgagacggagtctcagtctgttgcccaggcttgagtgcagtgtctcagctcactgcaacctctgcctcccgggtacaagcgagtctcctgcctcagcctcctgagtagctgggattacaggtgcccgccaccacacccggctaattttttgtattttttagtagagatggagtttcaccatgttggccaggctggtctcgaactcttgacctcgtgatccgcctgccttggcctccccaatcaatttatcttttttgtttgttattgcctctgcttctgatgtcatgtctaagaatccattggccaggtgcagtggctcacttctgtaatctcagcacttcgggaggctgaggcagaaggatcacttgagcccaggaatttgagaccagccagggcaatatagtgagacctcgtttttaagaaaaaaaaaaacattaactggatgtggtggcatttgtctgtggttctagctacttgggtggctgaggtgggaggattgcttgagcccaagaggtcaaggctacagtgagccgtgattgcaccactgcctggctaatttttgtgtttttagtagagacggggtttcgccatgttggccagactggtctccaactcctgacctcaagtgatcttgacctcaaatgatcatcccaaagtattgggattacaggcatgagccaccgcacccagccaccatagctttttaatttttttgagatggagtttcactcttgttgcccgggctgcacaatcttggctcactgcaacctctgcctcccaggctcaagcaattctattgcctcagcctcccaagtagctgggattacaggtgtgcaccacttcacctggctaattagtagagatggggtttcactatgttggtcaggctggtgaccaacctgatctcctgacctcaggtgatccacccacctctgactcccaaagtgctgggattacagacgtgagccaccatgcaggcctctatagcttttttttttcttttgagacggagtttcgctcttgttgcccaggctggggtacaatggcacgatctcagctcaccctgcaacctccacctctcgggttcaagtgattctcctgcctcagtcttctgactagctgggattacaggcatgcgccaccacgcctatctaattttgtatttttagtagagatggggtttctccatgttggtcaggctggtcttgaactccagacctcaggtgatctgcctgcctcggcatcccaaagtgttgggattattggcatgatccaccatgcccggccctctgtagcttttcaatagtcttttttttttttttttttgagacagagtcttgctctgttgcccaggctggagtgcagtggtgcaatcttggctcactgcaccctccgcctcctgggtttaagcaattctctgcctcacctcctgagtagctgggattgcaggcacctgccaccatgcccagctaatttttaatttttgtatttttagtagagatggggtttcaccatcttggccaggccagtcttgaactcctgacctcgtgatccacccacctcagtctcccaaagtgctgggattacaggcgtgagtcaccacgcccagccttaatagtcttcaagttgggtattgtcacacctccaactttgttcttcaatattgtgttggctattttgggtcttttgcctctccatataaacttcagaatcagttttttgaaatacacaaaataacttgttgggatttagattgggatttgcattaaatctgtagatcagattggggagaactggcatcttgacaatattgagtcttcctatccatgaacatgggatatcattttttaaaaattcatctttgatttctgtcatcagagttttgtagttttccccatatagatgtgtactttttttttttttttttttaaagagaaagtcttgctctgtttacccagactggagtgcactggtgccatcacagctcactacagccttgaatttttgggctcatggcaatcctttcatttcagcctcctaagtagctaggactataggtgtgcaccaccatgcctggctaattaaaaaaatatatatatattttttgttagagacgggggtctgactgtgttgcctaggctggtctctaactcctaggctcagcctcccagtgttgggattgcaggcatgagccatcacttccagcccatattttgttatatttatgcctaaataaatatttcatttctttgggtatcccttaattttttagacattgttttctttagttctgtgaacatatttatgatagctaatttattgtgtctagttattctgacattgggctttttcagagatcgtttctgttgactgcttttttactgtgtatgggccatgtttttcttttttttaatgtttaaaaaaacttattactttattattttaatttaatttaatttttatttttattttatgacagagtcttgctctgttgcccaggctggagtgcagtggcatgatctcagctcactgtgacctctgcctcctgggttccagcgattctcctgccttagcctcctgagcagctgggattacaggtgtgtgccaccaaacccagctaatttttgtatttttagtagagacgggatttcaccatgttggctgggctggtctcaaaactcctgacctcaggtgatccacccatcttggcctcccaaaatgctgggattacaggtgtgagccaccatgcctggccaaaacttcttactttaaaaaagaatacagaaacaagatcttgctgtgtttctggactggtctcaaactcctggcctcaagcaatcttcctgccttgggcctcctgaagttctagaattaaaagtgtgagccaccatgcccggcccatattttcctttttgtttgcatgccttgtacattttagttaaaaacaacattttaaattatgtaatgtgaaaaatctgagcatcagattctacctccaccaattcccagtgtttgttgttgctgttgtttctgtgatatgtttgtttagtggccaccctgtgccaattctgtaaagtctgtattctttgtagcattcagccactgaagtctctggttggttagcttactggccagctaatgattggacagagatttcctgaaatgccttgaagcaataaatctcccactctcttcaaggtctgtgtgtgtgtgtttgtgcatgtcttcaattctcccagcagcttacaactctgccttagcctttacttcttggttgcacagagccttaaggtcagccaaggttcaaggttaggggcttttcaggtccttcctgggtaagcgcatgttctttacatgcaggaataagcttttcaaggcccatgtggccatctcattccccagattttccttttttttttttttttttttgtctagccccttgttttactcaactggtattgtcacttcaggcggctgcagtgttaaacagttgctgttgattgctcatctactctggggatgggactattcacacagagtgactctaagtttgatcatattctccagccctgagtctcagcaagctgccagataggcataatagtgatggttacctgagaatgggcttcttgagaagctccaaacctgttcttttcccaccagtggttgctagtcttctgtttctcatggccaccatgattatgaggtttccaatttttgtcttttgcagaactggagagagaggcatgggaataatggaataatgggaatggggcaagttaaaacacacacagtttcttttttttgagacagggtctcactctgatgcccaggctggagtgcagtggcatcattatggtttactgcagcctggacttcctgggctcaggtgatccacctcagcctcccaagtagctgagaccacaggcatgcagcaccatgcctggctaattctcatgttttttttgtagagatggggtctcactatattgcccaggctggtctccaactcgtggcctcaagtgatctgcccatctcagcctcccaaagtgttgggatgatagtcgtgaaccagcatgcccagcccaaagtttgctctttaacaagattcagctgtttttcttaaacactcctcagattgttgcaagctgttggttaacttccacagttatgtaaaagttaatttttgcaaaattttttagagtttttctttctttcatggaggagcagattttttagggtccttattctgccattctagagtggtgcttctctatagtggtgttgttgttgttgttgttgttgtttagacggatttttatacttgtcacttaggctggagtgcaatggtgccatcttggctcactgcagcctccacctcccaggttcaagcgattctcctgtctcagcctcctgagtagctgggattacaggctcccatcttcacacccagctaatttttgtattcttagtagagatggagttttcactatgttggccaggctggtctggaattcctgacctcaggtaatctgcctgccttggcctcccaaaatgctgggattacaggcgtgagccaccacgcccggccctctatagtgttttgaatatcaccttatatagctgttttaatagttgttctaagtattttattacatatacaaaacatattacaatatactgatgtcattttatcagcctgagtgaaatatagaagtcatacctctctgtgtctctttactccccctgtttttaatatatttgtcttaaatatttctatacatacatttatagcagtatcaggctgttagaatttttgcttttttttttttttttttttttttttgaggcagtgtctcgctctgtcaccaggttggagtgcagtggtgcaatcttagctcttggtaacctccgcctcccgggttcaagtgattctcctgtctcagcctcccaagtagctgggactataggcgagcgccaccacgcccagctaatttttgtatttttagtagagatggggtttcactgtgttggccagggtggtctccatctcttgacctcgcaatctgcccaccgcggcctcccaaagtgctgggattacaggcttgagccaccacacccagccagaatttttgcttttaaacatcaaacataatttagaaaagtcagaaatgaagaaaagcttattatatttacaggtatttttgtttccttcttccttgctgatattccaaagtttagtttattgtttcctttctgtttagagtacctccttttgccgcttttaaataatagttctgttggtaacacattttgctggttttccttcatttgagaatgtctagagttccttttcattcttgaaggacatcgttgctgggtataggattctggagtaacggttcttttctctcagcacctgaaaagtttttgtgtcactttcttttggtcactgtggtttctgatgagaagttggttatcatgaattatttttcaagattatttctttgtctttagttttcaaaagtttaattatgatatatcttgagattgctttgggtttatcctgtttggtgtttgctggacttcttgaagctgtgggtttatgtctctgaccaatttgggaagctttcagccattgtctttttgagtacttttttagtcctaccgtctttctcctctttttctgggactcttatgacataaatgtcaggtgtttgtttgtttgtttgtttgtttgtttgtttgagatggagtttcattcttgttgcccaggctggagtgcaatggcgtgatcttggctcaccgttgcaacctctgcctcttgggttcaagcgattctcctgcctcagcctcccaagtagctgggattacaggcatgcaccaccacgcccagctacttttgtatatttagtagagacggggtttctccatgttggtcaggctggtcttgaacttccgacctcaggtgatccacccaccttggcctcccaaagtgctgggattacaggtgtgagccaccgtgcccagctgatcttttgttacaggtccatgggattctgtttatttttattttctagtcttttatatttttattttttagtgggtctcactatgttactcaggctggtcttgaacccctgggctcaagtgattctcccatcttagcctccagagtagctgaaactacaagcacatgccaccatgccctgccacagccattgttctctctgttgtccaaattggctaatttctgttgtctgtcttccagttcactgattctttccttgacctccattattattttcactgtaacttccattctgctgttgagtatatccaactgagttttttttttttttttttttttttttgagacagggtctcacctctgttgcccaggctggagtgtagtggtatgatcacagctcactgcaacctctgcctcctaggctcaagcaatcctcccacatccgcctcccaagaagctgggactacaggtgcatgccaccgtgtcttgcgaatttatttttggtatttttggtagagacggggattttaccatattgcccaggctggtcttgaactcctgagctcaagtgatctgcccacctcagcttctctaaagtgctgggattacaggtgtgagccaccacccccagcccaactgagctttttaatttggttattgtattttttaagttctaaaataagtttttggttctctttttttgagactgagtctcgctctgttgcccaggctggagtacagtggtgttatcacagctcactgcaacctccgctccctgggttcaagtgatccttatgcctcagcctcctgaggagctgggattacaggcatctgccaccacgcccggctaatttttgtatttttagtagagatggggtttcaccatgttggtcaggctggtcttgaacttctgacctcgtgatctgcccgcctcagcctcccagactgctgggattacaggcgtgagccaccgtgcctggctgctaattttgtatttttagtagagacggggttttgccatgttggccaggctggtttcaaactcctggcctcaagtgatctgcctgcctcggcctcccaaagtactggaattacagtcatgagacactacgcctggccttgggtctttttttataccttctatttttttgtcaatactttctttgtttagacttcttgttttttatttcacacatgctcataattgctgcttgtagcacttttctgatggctgctctaaaatctttgttatacagtttcagcatgtctgtcatcttggtgttggcatctgttaattgtcttttttcattcatattgagatttcactggcctttagtgtggcgagtggcttctgattggaatctggacttttagatattgtgtgtgagactctgggtctcatttaggccttctgattttgctggcttctcaggactctggcagggaaagtggtggtgttggggctcgtttctgctaggtaagggtagaagtcgagattcaccaccaggccttgtgtggaccacctaaggtggtccttgttactcatgggtggaaatgctccctccatgtcctccgctgacgccaaggaaaagtagcatcattctcattgggtggtggtggaattcctgactccaccaggctgcctctgataccactgcaatggagaggggaggggcacctctttactgctgagttgggggtagaagtccagatttcactctccactgactctggcagttgctccttactgctgagtgagggtgaaagtcccagctccctgtttggccttctgtgaaaccaccccattgggtttggggtgcctcattatagcctgacaagccaggaagtacaggctcacccctcaacctttactcatgcggcggaaatgtggcggaaacgtgggctgtggctttcctgcctgtgtggctagagtaaggcagttattgtctaaatattttctcactcactaggttgcccttttcttagtcctttgactagggagagccgacctttgttggagcttttcttgtctttgcccactggcatttttgggtcgcttcttctccagctacaaatctgggataataaggcaaaaggaatgcccaaggaagccaccaccgtgacgttgctcaggtcctgaggtcccttgctagtctgccttctctctaccttttagtgtcttctcatttttttttgagacggaatctcgctctgtcacccaggctggagtgcagtggcacgatcttggctcactgcaaactccgcctcccgggttcatgccattctcctgcctcagcctcccgagtagctgggactacaggcgtctgccactatgcctggctaatttttgtatttttagtggagacagtttcaccatgttagcaaggatggtctctatctcctgacctcgtgatctgcctgcctcagcctcccagagtgctaggattacaggcatgagccactgcgcctggccagagtcttctcatttttgtttgtatgtaacatccaggggttttagttgtgggtggcagaaggagtattaataatccttcctagtggaagcagaagtgacaatgttttgatacttttttttccttgagacaggttcttgctctgtcatccaggctggagtgcagtggtacaaccacggctcactgtagcctccatctcctgggctcaagagatcctcctgccttagtctcctgagtagctgggactgcaggcatgtgccaccatgcccagctggttttttccttatttttgtagcaacgggatctccctatgttgccaggtctggtctctaactctagggtacaagtaatcctcctgccttggcctcctaaagttccgggattacaggcatgagccactgcatctggccttgatacatttttttttctttcccactaaataccagaagaacatgatgaattttctgttgactttcccatctgggtggacttttagtaacctctagagtcctcagtttacttctgtcacccacctgttcacagagggatggatgtagtagccttttgctcagtttctttggcttttgtcagtgatgtttgtcattcatctgttcaaatgtttattgagaacctattttgctggggctgatgaggcctaggaagatgccctgtaggaatgcatgtgtagcgtcagatgttttttatctatgttatgttatttgatctttgcaactttggaagtcagcagttataatctctcatagatgaggaaacagacccacagagatgaaggaaccaaggtagttccaccaaatgttgtttccttgaaggtagtggggcaactatttacttccaagaatgttttctataccagtgattaggggacttgagtgttggccaaatatgattgaaattgggccaggtgcggtgtcacacctgtaatcccagcactttgggaggccgaggggggtggatcacttgaggtcaggagtttgagaccaccctgaccaacttagtgaagccctgtctctactaaaaatacaaaattagcggggcatggtggcgcacgcctgtaatcccagctacttgggaggctgaggcaggagaattgcttgaacctgggaggcagaggttgcagttagtcaggattgcgccattgtactccagcctgggtgacaagagcaaaactccatctcaaaaaaaaaaaaaaaaaaaaaaaagaaattgacttgcccccctccactcagtctttaccgagtacatatttgagtgctgctgtgccagccatcgtggatgtggtggtgaccagtgcaggcagggctgtgttcccatggcacttgcagactgccctcatgtgctctttgactggtaggtcagttgggtagattggaacgaaagacccagtctctttttctcccagtttcagtaattgaatccacatagatcatactacattaaatgaatgttttagaggctgggcgcattggctcacccctgtaatcccagcactttgggaggccgagatgggtggatctcctgaggtcaggagaattgcttgaacccgggaggcggaggttgcggtgagcccagatcgtgccattgcactccagcctaggcaacaagagcaaaactccatcaaataaataaatgaatgaatgaacgtgtgttttagtatggagatgagtgctacaaaaggttcagttttatatggaacaggtagtaaaataacacagtcaaggcttaggagtttggtctgtgagtttaaggtattgtgagtgggctaggctcgatggctcacacctgtaatcccagcactttgggaggctgaggttggaagatcatttgagtccaggagttcaagaacagcctgggcaacatgttgaaaccccatctctaccaaaaatacaaaaattagccgggtgtggtggcgtgtgcctctagtcccagctactcaggaggctgaggtgggaggatcacttcagcccagtaggtggaggttgcagtgaggtgagatcacaccactgcactccagcctgggtgacagccagaccctgtctcaaaaaaacaaagtaaaataaaaaggtattgtgagcaagagctctgtcgacatggcatcaacacagtaaagtcagttctggttgtcttatatcccgtagctatgtggtggtgattttcttgtgttctaatgtcctgataaacacattcacccagacttcgagcaggagatggcactttctggctcagccacatgcaaattctgatcctattatttctagttccctcctccaagtttttcatttggcagccaaccttagaaaatagctgtaatcaatgtagaagtcagactggggctgacttttatcagtcaggaaggtattaaattagcagtccaagacttgggcttccacttgtgccttagccagtctttgtgagaaccttggtcaaggctgtctctccaagcctcagtttcctggggataacacctgcttggcttatcttacagagttaataagcatcaaagaacttactgaaggactttataaattaaataccattatgtagaatggtggtggttagtgcctttatttatttattttttgagacagggtctccctctgtcgcccagtctggagtgcagtggtgtgatctcggctcactacaacctccacctcctggattcaagcgattctcttgcctcagcctcctaagtagctgggattacagacgtgcgccaccatgcccagctaatttttgtatttttggtagacatggggtttcaccatgctggtaaggctcttctcgaactcctgacctcaagtgatctgcctgcctcggcctcccaaagtgttgggataacagacgtgagccactgttgggataacaggcgtgagccactgtgtttagtggttagtgcctttagaatcctgaagttattgatgaataggtcgaagtccagagctattgttttggagttgtttgacaatgagcagttgttttgactaaaagggatcatcagagaaagtgttgcttttgtaaggaacagaacttgcttgaatgagttgtttgaaattgttttctctgaataactgagtgaataggaaacaaaaggatagctgaggccctgtgtcttgttctttctcacccatgatgtaaattaactcattatcgtacaatcaggatcaagttgctttagaattcctctctgtcagtgcatgaaacaaaatgacacagagaaaccatcctgattgattttggaattagatgggaatgcaaagtatctgattaagttatatggagtatccagaaactcccattgctgtgcaggtaataattttatttatttattattttacttatttatttttttgagacagagtcttgctgttgtcgcctgggctggcatgcaatggcacgatctcggctcactgcaaccttcgcctcccggattttagcaattctcctgccttagcctcccgattagctgagattacaggtgcctgccaccatgcctgggtaatttttttgtatttttagtagagacggggtttcaccacgttggccaggctggtctcaaactcctgacctcaggtgatccacctgccttggcctcccaaagtgctgggattacaagtgtgagccaccgcacccggccatgattttatttatcttaagagcattgtgctttgtagaggttggtataattgaaatattattctaggaattggcaaacctccacagatcccagatggaaaagacttccttagaggataactaacaggtcagtcatttggccaattttgtttgcaaagccaatcttgaatttcaaggaggaactaataatctatgtgatgccaactcttttgaagactctgccccattgttctgtctgaaatttttttctcttgagaattttttttttttttgagacggagtttcgctcttgttgcccaggctagagtgcaatggtgcgatctcggctcaccgcaatctccgcctcccgggttcaagtgattctcccacctcagcctcccaagtagctggggattacaggcatgtgccaccacacccggctaatttgtttgtgtttttagtaaagacagggtttctccatgttggtcaggctggccccaaactcccagcctcaggtgatctgcccgcctcggcctcccaaagtgctgggattacaggcgtgagccactgctcctggccactctcttgataattttttaaaaactattttgattttttttgtaaggatgaattcaaagttatatgaatactaaatcttacatcttgggatatttatcaaatgttattaaaatattctgtgtttatgatgctccctcttttcccttaggacaaatattctgtcttacacacacatagataaatatattttactgacttcactgtttttgacctgaacagtcttgctcctgtgaaggtttatcatcttttccttggaaatataaattacattcctcatagataggaccagaccaataaatgtttacttacgtgtgtctgagattgtttgtttgtttgtttgtttgtttatttgagacagggtctttctctgttgcccaggcaggagtgcagtggtgcaattatagctcagtgcagccttgaccttctgggctcaagtgattctcccacctcagcctcccaagtagctgggactacaggcgcgtgctaccacgcccagctaatttttgtatttttagtagagacagggtttcaccatgttggccaggatagtttcgatctcttgaccttgcgatccacccgcctcagcctcccaaagtgctgggattacaggcgtgagtcactgtgcctgggccagctaatttttttttatttttgtagagacgaggtctccctgtgttgcccaggctggtctcaaacccctgggctcaagccattctcctgccttcgtctcaaagtgctgggattacaggtgtgagccatcacccagctttaaaaagtatattgaaaataggatgatttaagcatgagttttttgtgtgtttgtttgtttgtttgttcgtttttcagtagagatggagtttcaccatgttggccaggctggtcttgaactccttgtcccaagtgatctgcccgccttagcctcccaaagtgctgggattacaggcgtgagctgccgtgcccagccaaatttaaatttcttgaaataattgctaacactgtagcaaagctttcctttgttgtgtagtgcatataggaaaccaggttgatgtgaaatttctaacagctcataagagtctacatactaatagtatttagtactttctagtgccctgctcttcatatgtcatgtaaatgccttggctgtatctagtatagatagtactagtgggattcagtataatccttaattttttgtttgtttttagtaattcttgtaagcagttagttaagaacttgttttgaatttttggtgctggtaagccaagactgcgagaacttgttggattcttaaacacttgaacatttaccatgcattaggtgctgaggatggaaaaaagagtaagactcagcatggcccccaggaatcaggagtggctgtattaatatcagacaaatcaaggcaaataattttgccatggttgaagaaggtcttttcctaatgataaaggggtcagttcttcaagaggacaaaacagttctaaacatttataaactaaatgacagtgtttcaaagtatatgaagcaaacactgataactgcaaggagaaatagatatatccataatgatagtgattccattattcttctcttagtaattgatagaataaggagactgaaaatcattaaggatgcgggagacttgaacaaccccttcagcctgctggatctgactgacagtcatagcacaccatccagagagagcagaatgtagttcttttttagtataaacacaaagatagatcatattcttgtgagccataaaataagccccaaattgataattatgcaagccatacaaaatatattctctgaccacagtggaattaagaataattctaataacagaagtatctttggaaatgtcctgaatatttagtaactaaataacatacttttagataacccataggtcaaagaagaagtcaaaagtgaaattaaaaagtatttagaaccaaatgaaaatgaagacacaggccaggcgcggtggctcatgcctgtattcccaacactttgggatgccaaggccggcagattacctaaggtcaggagttcaagaccagcctggccaatatgatgatgaaaccccatctctacaaaaaatacaaaattagccgagcgtggtggcacaccctgtaatcccagctactcgggaggctgagacaggagaatcacttgatccagaggtggaggctgcagtgagccgagatcatgtgaccgcactagccaagatcacgccactgcactccagcctgggcgacagagcaagactccatctcaacaacaaaaaaaagccagatgcggtgggaagaagctcctgcaagaggccacggagccagcgacgggaggccttgaagccagtgacgacccactcagccgagctgccgctttcgcagcacgccaaggacactcatgaggaccatgatacttccactgagaatgcagatgagtccaaccatgaccctcagtttgagccaatagtttctcttcctgagcaagaaattaaaacactggaggaagatgaagaacttttaaaaatgcagacgaaactgttctgatttgcctcagagaaggatctcccagaatggaaggagtgaggcaccggcaacgtcaagctcctgaaacacaaggagaaagggaccatctgcctcctcatgcggagggacaagaccctgaagatctgtgctaaccactcttcacgctgataatggagctgaagcccaacatgggtagtgaccatgcctgggtctggaacacccacgccgacttcgccaacgagtgccccaagccagagctgctggccatccacttcctgaatattgagaatgcacagaaattcaaaacaaagtttgaagaatgcaagaaagagatcggagagaaaagaaaggatcgggcaaaaacgatcatgccaaaaaaagtggcggaaaagctagaagctcttttggtggaggaggaaaccaaggaggatgctgaggagaagcaataaatcatcttattttatttccttttcctccctttcctttccttttcaaattttaccctgcccctccttttcggtttgtttttattctgttttgtttttacaagggatgttatataaagaactgaattcaacattcaaaaaaaaagattaaagcataaatcaatgaaatagaaaacaaaaaccagaaaaaagctaaaaagctgattctttgagaaaatcaatgcaattgataaacctttatccagactggttaggagaaaacaagacacaaattacctaccgtaccaagtgttggtgaagatgtggaggaactggatctctcatgttctgctcatgggactgtaatatggtataaccactttggaaaacagtgtggcctttttttttttttttttttgagatggagtctcgctctgtcgcccaggctggagtgcattggcactatctccactcactgcgagctccgccttccaggttcacgccattctcctgcctcagcctcctgagtagctgggattacaggtgcctgccacccagtccggctaatttttttgtatttttttagtagagacggggtttcaccgtgttagccaggatggtcttgatctcctgacctcatgatccgcccaccttggcctcccaaagtgctgggattacaggcgtgagccactgcgcccggcctatgtggcctttttataaagagttaaatatacacctactatatgatccagccattccactcttaggaatttatcaggagataagaaagcatgtggctggacacgtaattccagcactttgggaggccacggtgggcagatcatctgaggtcaggagttgaagaccagcctggccaacatgacaaaaccccgtctctacaaaaaatacaaaaattagccaggcgtggtggcacgtgcctataatcccagctacttgggaggttgaggcaggagaatagcttgaatctgggaggtggaggttcacaccactgcactccagcctgagcaacagagtgagactctgtctcaaaagaaaaagaaagaaagaaggaaagaaagcatgtgcccatacagagatctgtgtatgaatgttcacagcagctttgtgacagccaaaaactagaaacaaccggaaagctcagcaatacataaatggatacactgtgatatattcacccagcagaatattactcagcaatgaaagggaatgaactattgatatgttattccatggatgaatctccaaaacatgtgctgcgtaaaataagacaaaatggccaggcgcaagtggctcacacctgtaatcccagcactttgggaggtcgaggtgggtggatcatttcaggtcaggagttcgagaccagtctggctaacatggtaaaaccccatctgtactaaaaatacaaaaaagttagccagatgtggtggtgcatgactgtagttctggctatttgagaggctgaggcaggagaatcgcttgaacccgggaggcagaggttgcagtgaactgagaaatcctgccaccacacttcagtctgggcgacagagcaagactccatctcaaaaaaaaatcagacaaaaaaaggcaactttatgatttcacttacgtgaaattctagataggtgaaactatagtgacagaaagcagatcagctgttgcctggggcaacacttagtgaaaaatcactaaggggcataaggagatgcttgtggtgatgacgttccttatcttgattgtgctaatgcttatatgggcacatacagccttcagagctcatgaaattatatactttagatatgcacagtttctcatatctcagttttacctccctaaaactattaagaaatttgtgcttaatactttggtgagcattttatgccctttgccccatgtagttggttctcactggtaggtaggcaggcaggtagaattagcagctttaggtgagacagagctgagcggaggttccttcactcagtcaggctctcccggccagtggcttgcagaccaggccaggctgctgcccttctttggtgctgctgcagagggaagtgtttggcatgtggggtctctacagttagtcctggtttctaagagtctaaggctgttttattctctcttttctttagtcctttgggagacaacattctacttatgttctcttaatgttttgtcccctaggcattagcagaaccaagggctgcatgagttttgagcttgtgtctggtgttttccctcagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccagtaagtgtgctgctgcctctttcccactttcctctgattttaaggctgactacactgttgtctgtgtggtttttttcctcattcttcgtttttttttagttggcaaaaactcattaacacctttcttggccagatagtagcgaatgcatttctgattaccttgtaaattgtaaggccgtttagaagcagtctgtccttctttgcaagacctgtgaaaatgtttggactattgagacagttgcaatgcttcagggaagtccattcattcattcagcagtatatactagagtgtagtttaacataagcaaaaagctttttatatacaaagttattgactgtgatgttgtttttaatgcaaaatattagaaaggtttaaatggtttaccagagtgtagggcttggtaaattatactgtgtcagtacagctaattatgcagccctttgaaataatcaagactatctggaaacgagaaaaatatatggaatatatatgaacaaggcagaatataagattgtatacctatttgtcttagttcaggctgctgtgatgaaataccttagactgggtaatataaacaacaaatttattgctcacagttctagaggctgtgaaggtcaagataaaggcgccagcactgaccccgtgatgggccgggcacggtggctcacgcctgtaatcccaacactttgggaggccgaggcgggtgaatcacctgaggtcaggagttcgagaccagcctgatccacatggagaaaccccctctctactaaaaatacaaaattagccaagtgtggtggcgtatgcctgtaatcccagctccttgggaggctgaggcaggagaatcgcttgaacccgggagacagaggttgtggtgagccgagatcgcgccattgcactccagcctgggcaacaagagtgaaactccttctcagaaaaaaaaaaagataaaggcgccagcagatttggtgtctgtcgagggcctgttcctcgtagatggtaccttcttgctgcatcctcatgtggtggagaaaggtggaagactccctcaagcctctctgacaagggcactgacccccttcgtagagcagagtcctaacaaactagtcacctaaaagccctacctcttaataccaccacagtgggttccagcatgaatttggaaggacacaaaaattcagaccatagcattttgccccggcccctcaaaattcatgttcatcttacgtgcaaaatacattcattctatcctaatagcccccaaaatgttaactccgggtaagtcttaacttaatttcagcatcacctcaaaagtctgaagtccaaagtcccatctaaatatcatctaaatcaaatatgggtaagactccagctctgggattcactctgacgcacgtttctctccggctgtgagcctgtgaaatcaaacaggttgtatgcttccaaaatgcaatggtgggacagacattggatagacattcccattccaaaaaggagaagtgaggcccagtgtggtggttcacgcttgtagtcccagcgttttgggtagccaaggtgggagggttgcttgaggccaggagttcgagaccaaaagggagaagtaggaagaaagaaaggagtgacaggtcctgaccaagtctaaaacccaaccagacaaacaacattaaatcttaaggcttaagttgactcaaagccccgccttccacaaaaactggggcaggggttggtcttgcaaagctctggatggccccactcccacagctttgctgggagcagcccatgcagcagctctcagtcactggattctcatgcctgcatctctcaggctggagttgcactctagtggttctaccagtcttgggtcttggggtggtcttgccccacaactccactgggcattgccctagtggggtctctctggtggccctgcccttgtgacagttctctgcttgggccctggcactctttggggcatcctttgaagtctgggtagaggtagatgtgcccccacagctcattcactctgtgcactgtggagatggccctgcacggacaccactgtggtttgttgcctgtgccttccagaggggtggcccgagctatagttggacctgcttgagctatagctggagtgggtaaggagtattctggaatgtgggaagtggagccttgaaatcgttctgcccccaagaccctggcattctaggcttatgatgagatgggcagtcacaaagatctcagaaatgcctttggggtcattgagtcactgtcttgatgaatagcgtctggttctttttttttttttttttttttttttgagacaaggtctcactctgtcacccaggctggagtgcagttgtgcgatcatggctcattgcagtctcacctcctgggcccaagcagtcctcccacttcagcctcatgagtagatggaactacaagcacttgccaccgcacctggctaatttttgtattttttgtagagacaaagttttaccatgttgcccaggctggtcttgaactcctgagctcaagtgatccacccgccttaacctcccaaagtgcttacaggtgtgagccaccactcctggccgtctggcttctttctatccatactaatctccttatcaaatgtttgcttggtggctgggcgcggcggctcacacctataatcccagcactttgggaggccgaggcaggtggatcacgaggtcaggagatcaagaccagcctggccaacatgatgaaaccccgtctctacaaaaaatacaaaaattagctgggcatggtggtgcgtgccttaaatcccaactactcgggaggctaaggcaggagaatcacttgaaccagggagttggaggttgcagtgagctgagatccaagactgtgccaccgtactccagcatggcaacagagtgagacaccatctcaaaaaaaaaaagaaaaaagaaaagtttgcttggctacacacttggagttctgtcctgaacatgtttttgcttttttttttttttttttttttttttgagacagagtcttgatctgtcttccaggctggagtacagtggtgcgatcagatctcactgcagcctccacctcccgggcccaagccattctcctacctcagcctcccaagtagctgggactatagatgtgtgcaccaggcctggctaattttttttttttttttggtagagacggggtcttgctttgttgcctaggttggtcacaaactcttgggctcaagcaatcctccctccttggcctcccaaactcttgggcttataggcctgagccattgcatccagccttgcttttacattctttacaagatggccaggctgataattttccaaatatttaagttctacctcccctttgatgataaatctcatctttaattcatcttcttggattttagtataagcagtcaagagcagccatgcaccctcttttgccaaagattctatttcactgccctttttttttttttgagatggagtctcactctgtcacccaggctggaatgcagtggtgcaatctcggctcactgcaacctccagctcccgggttcaagcaattctcatgcctcggcctcctgagtagctagcactacaggtgcacaccaccacacctggctcatttttgtatttttaatagagatggcattccaccatgttggccaggttggtctcaaaactcctgaactcaagtggtccgcctgcctcagcctcccaaagtgctggggttacagacatgaaccactgcacccgacctttttttttttttttttgagacagtgttttactctcttgctcaggctggagtgcagtggtgtgatcacagctcacagcagccttgacctcctgggctcaatcgatcctcccacctcagcctcccaaatagctgggactgcaggcatgtgccaccatgtctggctaatttttgtattttatgtagagatggagttttgccatgttgcccaggttggttttgaactcttgggctcaaagcgatccttccacctcagcctcccaaagtgctgaaattacaggtgtgagccaccatgaccagcctactgtctgtttttctactagcattgtgatcatgaccacttagatcatttctaagaagattgaggctttctttacagctgttttcttctgagcctgtcttagtctgttttgtgttgctataacagactatataagactgggtattctataaagaagacactttatttagctcacagttcttcgggctggtaagttaaagagcatagcatcacatctggcagtttctggtgagggccacacactaggttgaaacatggtggagaagaaaagtgagcaggcgggtgcagagaaatcacatggcaagagaggaaacgagagagcctgggaagccaaactcatttttataacaacctgttctcatgggaactaagtgccctgagagcaagaactcactcacccccataggaaggcattaatccattcatgaaggatctgcctctgtgacccaaacatctcccactaggccccacctctcaatagcgcacactggggatcaatttttttttttttttgagacggagtcttgctctgtcgcccaggctggagtgcagtggtacgattttggctcactgcaagctccacctcctgggttcaagcagttctcctgcctcagcctcccgagtagctgggactacaggtgcatgccaccacacccggctaattttttgtattttagtagagatggggtttcaccttgttgcccaggctggttgaactcctgagctcaggcaatctgcctacctcggcctcccaaagtgctgggattacaggcgtgagccactgcgcctggcccaaatttttaacataagttttagtggagacaaactacatccaaaccaaagcagaactctcaccagagctcccctttacggtctgtacatagcaatacagtctttttctagccttttcctcttccagcctctgcccattacccagttccaaagccactcctgcattggtgggtatttaatacagcagcaactcacttctcagtaccaatttctgtcttagtttgttaaggctactataacaaaataccttagacttggtattttttttttttttttgagacggaatttcgctcttgttgcccaggctggagtgcaatgacacgatcttggctcaccgcaacttccacctccacctcccgggttcaagcgattctcctgcctcagcctcctgagtagctgggattacaggcgcgcaccaccacgactggctaatttttgtatttttagtagagacagagtttctccatgatggtcaggctggtcgcgaacccctgacttcaggtgatccgtccacctcagcctcccaaagtactggaattacaggcatgagccactgcacccggccagactgggtaatttataaacaacagaaattcattgctcacagttctggagactgggaagtcctggatcaaggcaccagcagattggtgtctgatgagggctcactctgctcctgaggtggcaccttgttactgtgtcctcagatggtggaaggagcaaggcagctctctgtaagggcactaatcctgttcatgaaggcagaggccttgagccttaatcatttcccaaaggccccactgttaatactatcacattgggtattaagttccaacatagcattttgagaggacaccatcttcagaccacagcactctctttgtctatgcaaagaccaggaggaaataggaagaatgaatgtagttgggttggggtggtagagttatgcatgaatttgtttttgtgtttaagaaacttccccatgccttaataacatcttcttaattaaaaaaaaaaatgccaccttcgagttgttggggaagaaccctaaccccctgccctcatagattcagtgtttggtggcatatggactaaactggcaaaagacagatgaggaagaggaaaggcagtttaatcacatacatacagatgtgtgtgattaaactcttttgtgagtcacaaaaatgtgactcgaagtggttacaatttggggcttatatagcatcttaataggggaacaggaggggcagaaaaggcccctgtgggaaaacagatgacttctttttttttttttttgaaacgctcttttgcccagcctggagtgcagtggtgcaatcatggcacactgcaacctcggcctcccaggttcaggcgattctcctgggtagctgggactaccggtacatgccaccatgcccaggtaattttggtattattattattattattattattattattattattatttttttttttttttttttttttttttttttttttagtagagacagggtttcgccatgttggccaggctggcctcgaactgactgcaagtgattcgcccgcctcggcctcccaatgtgctgggattacaggcgcccggccaagatgactccttaataggggaagaggaggagggaggggactgatgggaagtgggcgctgaggagaaaagatgggagagaggctagtttttgacagcgtctgtttaggtgtggtctggacttcttctggtcttaagcgataagagtcagtcttccctggtgttcccagggaggagatttatcacagttgagttctttggagttattttgtgaggctctgcttttcagcatataagggacttcaggaactcaaatgctttcagctcaaaataatttttaggtcacagaggtatattctggactgttaggtttttgccttgcccaggagtttgctcatttataaatagagggaaaaaaaaaccagagaaggaactagtgtggttgggatagccatgcacgcagctgggattccagctatactttgtagatcccaactgaggtggaaagggaaggccatctgggcaggggttaaatctcctaaggggtgggggactgagcttgagtttgcatctggctccatcacttatcagctgtgtgttcttgggcctgttgtttttctgaaaaagagcgacagcaagaggccatcctcagagtggacccatgataggccaagatggtggaaagcccaggacgagccctcaggacccagcactgcctgccttatgtgagtgagataggactgcagtggtgagacgttcagtgatgggccatggtgtggccaggaagacactagcctgactaccaggaggcccctggagggaagagatggactaagatagcagtatctgcggggagccaaccaaggaggactttgaataccagtaaatacactcgtgtcctagaaggcagcccacaaaggctctcgatccgggccatttagtgttcagcaggccaggcctgcatctgtgtttgggatagggctgcaagtgcagaggccagatccgggaggctgatgaagttgagcaggcacatgggaggagagcttgatctcttgggctatgctgtccagtcgggtggccactggctacatgtggctcctgcacactgggaacggggtggggagcagtgggagtgtgaaggacacacccctaatctgaaaactttaatgtaagtatctcattagtgaagttttattgactctgtgttaaaatggtaatattttgatatgttgaatcaaatcaaacatgttattaaaattaattttacctttttttgtgcttttgtaatgtggctactagaaaatctgaaattgcatatgtggctttcatttctgttgtgcgttattgctctaggggttggtaacaatgggaatgaaagtgacagagcacattgagaaatgttaaaaagacgatgggagggaggccaggtactttggcgcactcctttaatcccagcactgtggaaggctaaggtggaaggtttgcttgagcccaggagtttgagaccagcctgggcaacatagcacaaccccgtttctacaaaaagtttaaaaattagccaggcggctgggcgcagtggctcacacctgtaatcccagcactttgggaggccgaggtgggtggatcatgaggtcaggagttcaagatcaaactgaccaagatggcgaaacgctgtctctactaaaaaatataaaaattagccaggtgtggtggttcgtgcctgtaatcgcagctactcaggaggctgaggcaggagaatcacttgaacccaggaggcagaggttgcagtgagctgagattgtgccactgcactccagcctgggcaacacagtgagactacctctcaaaaaaaaaaaaattagccaggcatggtggtgtgcctgtaatcccagctacttgagagtgaggtgaaaggatcacttgaacccaggaagtcgaggctgcagtgagccatgatggtgccactgcactccagcctgtgtgacagagtgagaccctgtctctaaaaaagatagcaggagggaatgaacatttttagtgtattagtctccagtacagcccttttaattgagtgatgattttccactttatagataaacaggatcagaaagagaaagcgacttccctgcagtcacatagtgacaagctggacatgtctgactaaaacctgtgctttttccactgtgttcttgggtctcttggacttagtaatggggatttaaggaggaggaaggcagtgagatagagccagggttcaggatttggggctgggagggtgttaataaagcgtttggctcaggacctcaaagccttttgcttgtgtgtgcatttctcacagcctcacgtgcccaggctgttggtgctggggggtaggcctggggctgccgctccctttcagaatccttgcctggcctcagaggggcttgtgtctaggaacctcagcagaaccctgcaagggctggctgggaccattggtgagatgagccatgcccgggagcatggaagaatatatgttcctcttcagtcctgtaagcacatgggctgtgatgaggaacgcgttggcagtctttagatgaacgctgcttctttggaacttgctgggtgttagcttttggtgtggcctttgggagtggactctggactgcagacactgaactacaggtttcccatctggaaatgagttcataggactggatgatctctatgttctttctaatatttctttactcgtgggatctttatgtttcattcataattttaattataatgtttctatgtttatgttttgactcaagtagtgatcactacaggccgtctttgggaatgcagtagaattttagtttcatagatcctaaatatttgattgtttttatacatttgatgattggacaccctacatagaatacttttttaaggtactagcaaataatatatgaagggaaaagaaagcattcttcctgtagcatctcgaatataaagattttgttatttagtattagattttaaaaattattttgtatcctctgatttcttatagatgaaaatatgcctactaaaaaacaatgaaaatactttttcagaatataagcactatatataatatttgaaaatattatccataaaagttagaagaaaataataattagtgcttgatgccactattcaaagacacaccactttaatttggtgagcctctttttggtttttcacccttattttcataaagctgcgatgcatgcttcatacataattgtgcatgttgctgcctccttctcccagctgcccgacgtgtcatctcaggtcaccagaaactttgacaggaaacagcaatttcttttttttttctttgagactgggtctcactttgtcacccaggctggagtgcagtgacaatcacggctcactgcaaccttgacctcccaggctcaagcgatttgtccacctcagcctcttgtaaacagcatttttatggctaataacccatcgtatgaatgtggcttagactgcccaaccacagcctaatttggggtttttatgttttcttctgttctttgcccttataatgtggcaggaaatatatgtggataaaacacttttcccatactttggcttatttcatttcaagcttctaaaagtgagattaatgagtcagaaggtatgaatataaggctttttgtcaaattgatttcctagagggtgattcattatactttttcaccggcattgaggtcaagtgtcctgggagtaggactgttgaaaatgtaaaaagtcacttcagttctggaatttatcttgctttgctttgttttgttacacttttttgccctctcctgatgctcacctggggtcacacattgcctctggttgtcatatgtctttcatctctttcaatctagagcagtggttctcaattagggagtggatattgtctcctagaggtcatttggaaatgtctggagatagttttgattgtcagaatcaagggggtggctactggcatctagtgagtagaggccaaacatgctgctaaacttctcacagtacgtagggtggtcccttgcagcataaacgtgtctggcccaagatctcagcagttgaaaagtcccaatctagaacagtattttaactttttctttttgtgacattgccttaaaagaaaattgaagtcaaagtcacataacatagaattaaccattttaaagtataaaatttactggctttcagtatattcacagttttgtgcagttaccatttctttctagtttcaaaacttctcattaccccggaagaacaccctgcacccattaagtagtttcaccatgcccccatcccccagcccctggcaaccacttacctcttttctgtttctgtggatgtttgcctaatctggacacttcatataaacggaatcatataatatgtgggcttttgtatctggcttctttctttgagcatgtttttgaggttcatccatgtgatagcacttgtcagtacttcattgcttttggtggctggataatatttcattgtcagcatttgaaaggaatttgggttgtttccacttttggctatgctgctctgtatattcatgtatgagttttctgtgtggatagatgattcatttctcatggtctatacctggtatcggaattgctgcgtcacttggtgtatgtttaactttttgaggaactgccagactcttttttcacagcagctgcaccattttatattcctaccagtaatgtacaaagatttcagtttctccacatcctcatcaacacttattttctactttttattgtagccagcccagtgggcataaagtggcatctcattgtgattttgataaacatttccctaatggctaatgacttcatttgtatatcttctttggagaaatatctgttgaaatcctttgcccatttttgaactaggtttgtctttttttgttgaattataaaagttctttatatattttggcatatggcgcatatatatatatataatttttttttttttttttttttttgcgacagggcctcactctctcacccaggctggagtgcagtggtgcaatcgtggctcactggagccttgacctcccgggcccaagtgatcctctcacctcagccccctaagtagctgtgactactgtcatgcaccaccacgccctgctaatttttgtatttttttatagagacagggtttcgccatgttgctcaggctggtctcaaactcctgaactcaggcaggcaatctgtccacctcggcctcccaaagtactgggattacaggcatgagccaccatgcccagcctactttatatattttggatactagactcttaccagatacatgatatgcaaatattttctgccattctgtaggggttttttttacttttttatttttatctatttatttatttttatttatttattttttgagacagagtctcgctctgtcacccaggctagagtgcagtggcatgatctcggctcactgcaagctccacatctcaggttcacgccattctcctgcctcagcctcccaagtagctgggactacaggcgcccactagcacacttggctaatttttttttttttttttttttttgtatttttagtagagacagggtttcaccatgttagccaggaaggtcccgatctcctgacctcgtgatccgcccgcctcagcctcccaaagggctgggattacaggcgtgagccaccacgcctggcgtggaattgctttctcaattccctcttttgattgttcagtgctgctgtgtagcagctgattttgtgtgttgattttgtacttggcaacttggctgaattcatatattattagctttggtaggtggatttgtggattcttgggtattttcaatatgtaggaacatgtcatctgctaatagagatagttttacttttcctttctgatctggatgcctttcatttcgttttcttgtctaattacccttgctagagtatccagtatgatggtgaatggcagtggtgcagtgggcatccttgtcttgttgctgatcttaggggaaagcttttggccttcggccataaagtatcaagttagctgtgggtttttgtagttgcccttaatcagattgaggaaattcccttgtattcctagttggttgaatgtttttatcttgagatattaacttctttaaagttttgttttactttttaatataaaaattttggtgtgtgtgttttattccaaccagtgctgattcctaaagaaaagcccccaatcacggttgtgggtgatgttggaggaaggattgccatcatcgtggtatgtagacctcttttattattaattctagtatttgccattgttattctgttgattgattgattgattgattttattacagagactcactgtcgcccaggctggagtgcagtggcacaatctcggctcactgcaacttctgcctcccaggttcaaacgattctcctgcctcagcctcccaagtagctggaattacaggtgcctgctaccacgcctggctaatttttgtatttttagtagagatggggtttcaccatgttggccaggctggtctcaagctcctgaacttaagtgatccacctgcctcggcctcccaaagtgttgggattacaggcgtgagccactgcacctggccaatttatttgttaattctgggcatataaaggcctaaggatagtagtatggccagataattcttattaaatttgtgccttgtgctaaatgtttgctttggcccagaaattggaaaatgctattgtttattttaaaattgctcactactggctgggcgcgttggctcatgcctgtaatcccagcactttgggacgccaaggcaggccaatcgcttgggctcaggagttcaagaccagcttggacaacatggtgaaaccctgtctctacaaaaaatacaaaaattagctgaacttggtggcacatacctgcagtcccagctacttgagaggctgaggcgggaggatcacttgagcctggggctcagaggttgcagtgagccgagatcatgccactgcactccagcctgggtgacagggtgaggctgtgtctcaaaaaaaaaaaaaaaaaaagtcatcctgtcataacatgagatattgttctgtgatcaaagtaaagtacaagctgggcacagtggctcatgcctataatcccagcactttgggaggccaaggcaggcagatcacctgaggtcaggagttgaagaccagcctggccaacatggtgaaaccccatctctactgaaaatacaaaaattagctggacatgttggcgcacacctgtaatcccagctacttgggaggctgatcttggagaatcgcttgaatctgggaggcggaggttgcagtgagccaagattgtgccactgcactctagcctgggcgaaagagtgagattccatctcaaaagaaaaaaaaaaagtaaactacaaagttgattataactgtttgaaacatgcatcctttcacacatcataagaccagtgcacaaaaagagtgcacttcatgcctgtatattttaaagaatagaatgaacactgggtacccgctagctcacttgaggcatagatcatcaccaggtacctagaggcctcctctgggcttaccctggtctctttgcctcagaggttgtcactgatgtgaaagctgcccatcttgatcctgtagtcagccatgagggcttgtggccttaaatgctgcctttttttcttgtctttgatgtttatgtaaatgatgtctttgtgtactttgggactttcttgctcaacactgttattgaaatttacctgtgtagtggcaggaagttgtacttcattctttttcactgctatgtgttgtgtctttggtataactgctacacaactgattgaggcaatggtactgctttgaacatcctcgtgcctattttctggtgcaaaagtgtgagagtttcaaggtgcctgggagtggggttgttgggtctgaaggtatgcacatttttaactttacaaggtgctgccaaattgtttccaaagtggtcacacccatttcccaagttccatagtgggtgccccacattatccccagtgcttgataattttgtacgcacccttttcaggttagaaaatctctctggggccgggcacggtggctcacttctgtaatcccagcactttgggaggccgagacgggtgtaggtcaggagatcgagaccatcctggctaacacggtgaaaccttgtctctactaaaaatacaaaaaattagccgggcgtagtggtgggctcctgtagtcccagctactcgggaggctgaggcaggagatggcatgagaggcggagcttgcagtgagccgagatcgtgccactgcactccagcccaggcgactgagcaagactctgtctcaaaaaaaaaataagaaaatctctcacgtcaccctccagggtaatagctgtccattacttattccttagttggcaaagtctatagtaacaaggtgctgtggattcagtagcacctttccccccgttctagtgccactgcattatttatttatttatttatttatttatttatttctatttttttttttgagacaaagtctcgctctgtcacccaggctggagtgcagtggcgtgatctcagctcactgcaacctccacctcctgggttccagcaattctcctgcctcagcctcccaagtagctgggactacaggtgcacgccaccacgtccggctaatttttgtattttttttgtagagacggggtttcaccatattcaccaggctggtttcgaactcctgacctcgtgatctgcccgccttggcctcccaaagtgctgggattacaggcgcaagccactgcacccagccgccagtgcattttttaaaaaaacgtttttattttgaagtaattatagatccacaggaagtagggggcaatacacagggacatcctgtgtattcattacccagcatcctccatcttgcttaactatagtacaataacacagactgaaaattctcggtgccacagccacagaggtccttcagacagcaccagttgtgcatgtagtgagtgtgagtgtgtgtgtgtgtgtgtgtgtgtgtttgtgtttgtgaatgcagtcttaccatgggtagctttgtggaaccaccaccacagtcaggacacagaattgctccttcactgcaaggcaccctcatgcttcctttcatagctacactgacatccttcccacccaatctgcaaccccttgtgtctttgtccactttgtgctgctgtaacacctgagactaggttgtttataaagaatagaagaaatttattctctaacagctctagaggctgtaagtccaaatcatggcaccagcatttggtctggtgagggccttcttgctgtgtcctcacatggcataaggcagaaggacaaaaaggaatgaactttccttcagaaggccaggaaagaggttaacccactcccacaagcctttttatagcgacatgaattcattcctgatggtggatccctcacaacctaaacactttcccaaagaccccaccacccaacactgttgcactggggaataagtttccaacacatgaattttggagggacaaaaacattcaagccacagcactggcaaccactgatctgtcccctgtctttctaattattatttcaagaatgtcatataaatggaatctatggtatataaccttttgagttttgtttaacctaccatgattcccctgagatccatccaggttgttttgtatattaatatgttattcctttttattgctgggcagtatcccatggtatagaggtaccagagtttatttgttgaaggacatttggatgatttccaggttggggctattatacataaaactcgctatgtacattcatgtataggtttttgtgtgaacagagttttaatttctctgggataattgcacttacaaatgcagttgttggtttgcatggtagttgcagatatactcttataagagactgtcaaactgttttccaaagtggctgtaccattttactagtaggacttttaaagtagcgtgtgtgtgtgtgtatgtattttttttgaggtatggtctgggtctgctgcccaggttggagtgcagtggcttgatcacagatcactgcaacttctacctcctggctaaagcaatcctcctgcctcagcctcccaagtagctaggactacaggtgcgtacctccatgcatggctaatttttgcttttctgtttttgtagagactgggtttcgtcatgttgctcaggctggtcttgaacccctgagctcaagcaatcctcccacctcagcctcccaaagtgctgggactacaggcatgagccaccacgcctggcctttatatgtatatttttgatcatagtaacatcagtatgcaattaaagagtaataatatgtatgtaaaataaagacacgaatatttattcaactctagacaacgtttgatgccataatgggtttaaaataactctgggagcctgggaatctagtctctagattggaaaccactgaactgggtattttattattaaaaacaataatcattattattttttccattgtaataacatgtaaaaaaacatatttcccatatgctcagtggagaaaatttggaaataaggaaagtagcaagaagaagtggggggaaagaggcacccataattctattacccagagtcaaaaacatcttttaacactttttctgtgcattaaaaacaaaaaaagaaaattatacctccatcatttctggtgtgacctgcattgtgacagcacaatgttggccagttatggtgcagaaaacagtgctacccctgggagcctggagtgtggtgggagatagctccaatagtggcaggtgctgtgcaggaagaggctcgtgtgaaagtactggagggctgccatggggcacggtgatggggacatggggccatgccgtctgcacaaggccaagtggaagagcagatttttcacggtaaatgtaggcagaccctttttttttcctggttgtctaacctattattgtagaagtgctcatatacattcttttccatctgtgctttggcaggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtaacagggtctgggtgtgtgtgggtacagctgcctgggcttttggcacatcttgatctttagttacagagagtcaggacaagactgagatcttttgtggctgagaaacgattcaagggctgggtgcagtggttcacgcctgtaatcccagcactttgggaggccgaggcaggtggattacctgaggtcaggagttggagaccagcctggccaacagggtgaaaccccgtctctactaaaaatacaaaaattagccgggcgtggtggcacacacctgtaatcccagctacttgggaggctgaggcaagagaatcactggaacccagagggcagtggctgcagtgagccgagattgtgccactgcattccagcctgggtgacagaatgagactcttgtctcaaataataataataataataataataataataatgtgtacaactcattggtttttagaatgttcagagttgtgcagtcattaccatagttggttttagaacattttcttcttcctagaaaggaaccccatacccattagctgtcacttcacattttctctcactgccattagtccctgggaaccactaatctgctttctgtctctctagatttgcctgttctggacatttcatataaatgagattatacaatgtgtggtcttttgtgtctggctgtcttcactcaacataatattttcaaggttcatccatgttggagcatgaatcaatacttcattttatgatcaaataatgctgtgttacatggatagtccacattttgtctctctcttcgtatttcatgttgatagaaaaaattttttttctactttttaacttatgaatggtgctgcagtaaacatttgtgtacaagtttttgtgtggacatgtgttttctcttctcttggatacgtacctaggtttagaactgccaggtcatacagtaacttcatgtttaaactttcaaggagctgccagactgtttttcaaagcagctgcgccattttacattcccacagccgtgagttgggggggggctccagtttctctgcatccctccagtacttgttattatcttttttgccatacctatcctagtgggtgtgaggttatcaaatcttaacctaagaaacacaggctgggcgcggtggctcacgcctgtaatcccagcactttgggaggccgaggccggtggatcatgaggtcaggaggtcgagaccatcctggctaacgcggtgaaaccccgtctctactaaaaatacaaaaaaattacttgagcgtggtggcgggcgcctgtcgtcccagcttacttgggaggctgaagcaggagaatggcatgaacccaggaggcagagcttgcagtgagctgagatggcatcactgcactccaggctgagcgacagagcaagactccgtctaaaaataaataaataaataaataattgaaacattgacttgagacatagatccactgtgttttcctgtcgtggcaagcctcagatttgagaagctgtcacatttccagatcaaaccatgaagctacttggctttctgatgctgtggttttttttcttttgcttcacaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataactaaaataaaatgaaagctaaatctacacgctgtgaatgttgaa

SEQ ID NO: 1250 - DNA, 73220 bp, Homo sapiens; identical to SEQ ID NO: 1249

SEQ ID NO: 1251 - DNA, 65819 bp, Homo sapiens
ggaggaattttgttgtcagagaataaaaggaggttgtccataattgactttaagcagcaatcagtaaaacattgagctcttcagctccgcctttcttgtaagtttatcatttcttcttagtggttgtgaacatcatgtgataatgtatttccataaatttaggaccctgaaatccaactgaactttctgtttgtccatatatatctaatatttaaaaaatactattaggatggaaactaatttccttcagctgaagtcatttcctttaaaaaaaattcattcaggtatatttcatatcatatggcagtttttaataagtattatatccttctaggctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagtgagttataattgtaccattaaaatctatattcattatgtgatgctttaaatttgataatcagattagcagttattgttaaatttgaaagcagatattttataattataaaataattatatctttttttcatcatgtatcttttttttcatcatgcaagatgttcatgtagtatgtctcatctgtatatattaagggctattctttttgtaaactatcccatctccctacatattctttcagcagacatttattgagtgccttataagtgccagggattgtgttagatgctatatatatatataattatttgagtataaagcacactggggccaggcgcggtggctcacgcctgtaatcccagcactttgggaggccaaggcgggtgtatcacgaggtcaggagattgagaccatcctagttaacaaggtgaaaccccgcgtctactaaaaatacaaaaaattagttgggcgtggtggcgggcacctgtagtcccagctacttgggaggctgaggcaggagaatcgcttgaacgcaggagggttgcagtgagctgagattgcaccactgcactccagcctgggcaacagaacgagactctgtctcaaaaaaagaacattaacatgtatattatatgaaataacttatagcttatagtttagtataattttagatatttattaaacaaatattgtacccctactactgtgtactagaccttgatctagatgttggggattatcagtgagtcaagatccatcctttttatgaaatttacattttagtatgggagccaaacagaaatcaagtcaacaaaacaaacaaggtaatttcagatgatgtcaatgctatgaagaaaactgtgtgaaagtaatgatggggcaggttgttctgctttagcatgtgtgctgaagtgcttttaaactgaagggatggtgtgtgagttgagaaacctgaatgagccaccaagtgaaggtctggaggcagaacccccccaagcagaggggacagcagattccaagcctctgcagcatgcaggaggagttcttggtgtgtctcaggaacgtgggctggagtacagagtgtccaaggaagatggctagtgaggcaggcagagcgggactgcatagtccttcctggggagacatggggttggggtgaggggctaggtaatggattgatgtaacaatttaatgttgactttaaattttataagaagaataactttattttattttactcttatcgatttacgagtctccttaaatagtaaagatactgggtttcttctattactttttcagctttttccccctttctcttctctaggcggctaggggtggagatgggcaaagtgcaggtttaccaggaacctaacagaggtgagctatcttgggcatgtggaacattgacctttttgtgaaatgtggcatattggctccgtccttcatcctttactattgaaacgatttgattcagttgtacatttccattagcaagaagtcaggcaggcaaggtagaacagagtggttttttagctctcactaataccagctagatatctaaccctggtgcaagtcatttctggggcttgaactgcagttctgagacttcattcagtaaaagctgcagacatatttgaaccagctggtcaactgaatgaacatgagctcaactgttgcttaaatttatgtcaccttaggaaggatgagtaaatcctgtcaccttagacaggatgactaaatcctgtgtgaccgcagttttagttagtctttatttgcacctaagctgccttgggttagacttcataaaatattgttaagaaatactttttgctaattgatacatgtcattacataattctcccaagttgtaaaaagaagtgttatttaacctttgtaggtccaggtgtgctggctcatgcatctaatgccagcactttgggaggctgaggcaggcagattccttgagctcaggagttgagaccagcctgggcaacacggcaaaaccctgtctctactaaaaatacaaaaattagccaggagtggtggtttgcacttgtagtcccagctactagggaggctgaggtggaaggatcgcttgagcccaggaggtggaggctgcagtgaagtgtgatcataccacagagtgagaccctgtctcaaaaataaataaataaataaatagaaagtgatctttgtaatttctttagcaatggtggatatttgaaattattttaggccaggcgtggtggctcacgcctgtaatcccagcactttgggaggccgaggtgggcggatcacctgaggtcaggagttcgtagaccagcctggccaacatgatgaaaccctgtctctactaaaaatacaaaaatttgctgggcttggtggcaggcgcctataatcccagctcctgggaaggctgaggcaggagaatcgcttgaacccgggcggtggaggttgcagtgagccaagattgtgccattgcactccagcctgggggggaacaagagcgagactttgtctcaggggaaaaaaaaaaaaaaagaaattattttagcaggagcgatggacagcttgcatgggcttgagagttacacaccttatccttgacaagttatttaacctttctaaactataaataaactgtaaattagggctgttttgaggattaagtgggataacttgtgtgcctaccagtttttggcacacagtaggtgctcaatatatacttattcctgttccttttccactagaagatttaaaaaaacattttttttttttttggtagaacaagggtctcattatgttgcccaggcttatctcaaactctgggcaaaagcagttctcctatttcagccccccaaagtgctaggattacaggtgtgagccaccaggcctggcccctctacaggattttatcaaatatttacatattataaagcctacaggaggctttgataaaaaggcacaagttttgctgttcccatgtttatctccgttcctgcctcttttctgtctcccaagatccctatgtggcgtcagtagggaaaaagtataattaaactctgcaaggagagtttggagaagattcttcctctagaggggattgaatgatgttctttgtctggagtctaggagggaaggtgaaagggagaagcagtggcataagactccaggagactggtccactctccaagtttctgaataaagggagagaaaatacttggtgtttattgggaaggaaggaagtaatatttgtgaatttcttactgttaccagatactgaaaaactgagttcaggagttcagggattgatgttaggtacgaggtccagtttgaatccagatctccctgactctaaagctcattttcttttcttttcttttcttttttttttttttgagacagggtctttctgtgtcactcaggctggggtgtagtggcatgatcagggctcactgcagcctctgcctcctgggctcatgtgcttctcccaccttagcctccccagtagctggtactacaggtgggcaccatgctgccaggctattttttttttttttttaaatatggagtcttgctctgtcacccaggctggagtgcagtggggcaacctcggctcactgccacctccgcctcccaggttcgagtgattctcgtgcctcagcctcccaaagtgctgggattacaggtgtgagctacacacacacacccagccataatttttttttttttttgatacggggctttgccatcttgctcaggctggtaaagctcattttcttaacatcataccacatttcttttgtaaacttgtattctgttttttccaacatttttttttttctcttatcctcacaatctgttcccattttgctactttttttttgtgtgtgtgtgtgtgtgtgtgtgagacagagtcttgctccattgcccaggctggagtacagtggcgcaatcttggctcactgcaacatccgcctctcaggttcaagcgatactcctgcctcagcctcccaaataggtgggcttacaggtgtgtgccagcacgcccggctaattttttgtgttgttggtggagacgggctttcaccatgttggccaggttggtctcaaacttctgacctcaaatgatcatccacctcagcctcccaaactattttcctacatttttaatgaaaatgttcaaacatataaaaaagttgaaagaatagtacagtgaactaccgcctagcttgaacagttaacattttgccatatgaatatgtatgtggcgaaccatttgaaattaagtgcaggccgggtgcggtggctcactcctgtaatcccagcacgttgggatgctgagctgggtgaatctcttcagcctgggaggtcaagactgcagtgagccatatttgcaccactgtaccacagcctaggcaacagggcgagatgtgtcccaaaaaaagaaaaaaaatgtaagttgcagacagttaatccttgaatacttgaccatgcatcctctaggaataattactttcacctaaataaatatgataccattatcacatttaaagaaattaactacaggcagggcatggtggctcacacctgtaatcccagcactttgtgggggtcaaggtgggtggatcacttgagaccagaagtttgagaccaacctgggcaacatggcaaaaccccatctttaccaaagataaagaaattagccagggttggtggcacacagctgtaatcctagctacttgggaggctgaggcaggaagatcacttgagtccgggaggtggaggttgcagtgagctgggatcacgccgctgcactccagcccgggcaacagagcaagaccttgtctcaaaaaaaaaaaaaaaagaaaaggaaaagaaaattaacttaacaattaaggacaattctttttttttctgtggcctcaagtgatctgcccgccttggcctcccaaagtgctgggattacaggtgtgagacaccgcacccagcccaacaacaattctttaatcatctaatatatggcctatattcacatttccctaattgtcctaaagggtcttttattttttatttttttgagatggaatctggctttgtcacccaggctggagtgcagtggtgcgatcttggcttactgcaacctctgcctcccaggttcaagcagttctcctgcctcagcctcctgagtagctgggattataggtgtgtgccaccaagcccagctaatgtttgtatttttagtagagacgaggtttcaccatgttggccaggctagccttaaacacctaacctcagattatccgcctgcctgggcctcccaaagttctggtattacatgtgtgagccaccgtgcccagcctaaagggtcttttatagttgttttttccaacacctccaccccaaaccaggattcttagttcaagggattttttttaaaaaatatctctttagtctcttctattttagaacaatcccctcacctcttccgttttcttcctgtgacagtgaagaggttgtcttgtagaatgtcccattatggatttgtctaattgtttctttatgactgatcacacatattttgagagtagggatattaggtcttatttatctttgtttctcacaacatacaatgttttgtacctaatacattctgaattgataattgatgctgattgaatgagtatataattttcttttttttttttttttttttttttgagacggagtttcgctcttgttgcccaggctggagtgcaatggcacaatctcggctcaccgcaacctccgcctcctgggttcaagcgattctcctgcctcagcctcccgagtagctaggattataggcatgcaccaccacgcctggctaattttgtatttttagtagagacggggtttctctatgttggtcaggctggtctcgaactcctaacctcaggtgatttgcccgccttggcctcccaaagtgctgggattacaggcatgagccactgtgcctggcctatgattgtctataaagatactgtgctcaggctgggcacggtagctcacacctgtaatcccagtactttgggaggctgaggcaggcagatcgcgaggtcaggagatcgagaccatcctggctaacatggtgaaaccctgtctctactaaaaaaatacaaaacagttagctggatgtggtggcgggcgcctgtagttccagccactcgggaggctgaggcaggagaatggcatgaacccaggaggcagagcttgcagtgagccaagatcgcaccactgcattccagcgtgggcgacagagcaagactccgtctcaaaaaaaaaaaaaaaaaagttaccatgctcggagtggtacagcactcaactgtttgtatatataaggggtgagaattatacatttacttatttcaagtcagaaatgtaattctctcttaaagctgtgttttaaaaagtgattaatggcagtatgtgtattatcccttgtaacatctaaagcctactgagtcttataacagtttgagttgccatattctattacattagggaataatacagatttttttgtgtattttgaaaaatttgaactatatgcctttccctctcttctttttccttttcctgccagaaacaagagtacaaattcaagagtctgtgaggggaaaagatgttttcatcatccaaactgtttcgaagtgagtatccagcaaaagtgttgctttctgggtttcagtttaggcatgagtgtttaaaataatgatagatggctagccaggaagagttataatagtcttaaaattagtatatcttaccaatttagaatttagaaaactaagttttctgacataactgctgacttttacatgttctttcagtgtttttccttctttctttctttttttttttgagacaaagtcccactccttcacccaggctggagtgcagtggtgcaatctcagctcactgtaaccacctcctcccaggttctagtgattctcttgcctcagcctcccgagtagctggtactacagttggcgccaccacgcctggctaatttttgtatttttagtagagacggggtttcaccatgttggccagactggtcttgaactcctgacctcacgcaatctgcccgcctcggcctaccaaagtggtgggattacaggtatgagccaccgtgtccagccactcagtgttcttaacgggtggaaataaccaagtattggagtagaggctctttttttttttttttttttgagacagaatttcactcttgttgcccaggctggagtgcaatgacgcgatctcggcttaccgcaacctcagcttaccgcaacctctgcttcccaggttcaagcaattctgcctcagcctcctgagcagctgggattataggcatgtgtcaccacgcccggttaattttgtgtttctagtagagacagggtttctccatgttggtcaggctggtcttgaactcccgacctcaggtgatccacctgcctcagcctcccaaagtgctgggattacaggcgtgagccactgcgcccagcctggagtagaggctgttaatgataatagtatacattaagtttcctaacaattaacagccagaattttgtaaaacttgcaaggaagcatttctagttccctcctctccccaaaagaaacagaggctaggggaggagacctttcttagttggggttctttaagcttttattgcatataaaagtgatcattatttactgttttattacataaattagctgagaggataaaaaactgtactgaaggaatgtgtattcctgtctggtgtgacctttgacacacctgtgttctggaaattgtttggtcacatatgtttaagctaggtatagaagattcaatgcagcaaggctgtctctggcactctggaagggagggtgatcacctggagccctactttttttttttctttttcttttttctaagaggtagagtcttgctctgttgtccagtctggagtgcagtggtgagatcataactcactacaacttcaaactcctgggctcaaactatcctcctccctcagcctcccaagtagctgggactacaggcatgcaccagcatgctcacctcgttttttcattttttgtagagatggaggtctcactgtattgcccagctggtctcaaacttttggcctcaagtgatcctcctgccttgacctcctatattgctgagattccagcaatatagaaggtgagcctatcacacctggccttaaagccccactttccattgtgtgtttgtccacaaatgtccctaaatgcttctgtgtatgaagttcttcgctcagaacaatttttaatgtctagaaatcagtttgtctagtgcattattttttagcttagagagtctgaaagttgctgcatgcttaatttgtgtatatacatatataaaaccaacgaaagggaaaaagaaggccatttcgggagactttagtcttggaacacacatttttttcacctaaattttgaacattttctctcctggtctttggtttattgggatgaagtcacaaaacccccatctctcctgggaagaggagtggcaggggagacctgtccttgcatcctatagccctggcaaacgggtgtgctctgaaggaggaagggtgtggagggcctttgccacggtgccctagcttcaccttctgctgtgacacccaggattctcagcagagctggaggtgggggcacggagcgccaactgcccctgctgctgctgtcctctttcccctttcccacgtctgccaccaaaccagggtggaagtggaggactcacctgtgcccacatcttaaccctttacctccagcatcggggtagggaaggggcgggcacagaacaacttaaacggcttctggctccttggtttctgtgtctgtggtacttttatgtccttacagacaagtgtgattccattggataaatgcacagaggttgtgtggattacccaaggggatgggtaggcattgagggcacccctggacttagaatttaggacttcagaagggtgactgctgatccttctcattttcaagtccttctggttgtttatttttgtacatttcaatacttatcctgtgcccctgtcttttgtcagtttcatattcctctaatcagaatcactcagcacccctttcattttctctccgtgtctcattttgcattgttccatacctgacataagcttgtgttaactcgggttctcagtcttgtccatgttgcagagtctggacgtcatggtcttctttgtgaaataccatgaaataacatttagtgttgagggccagatgtggtggctcatgcctgtaatcctagcactttgggaggtcgaggtgggcatatcagttgaggccaggagtttgagaccagccaggccaacacggtgaaaccctgtctttactaaaaatacaaaaaattagctgggcatggtcatgagcgcctgtagtcccagctactcaggtggctgaggcacgagaattgcttgaacgcaggaggcagaggttgtagtgagctgagatcacgccactggattccagcctgggtaaaagaacaaggctccatctcgaagtaaaaaaaaaaaaggctgggcgaggtggcttacacctataatcccagagctttgggaggccgaggcgggcagatcaggagttcaagaccagcctggccaacatggtgaaaccctgtctctactgaaaatacaaaaattagctgggcgtggtgatatgcgcttctaattccagctacttgggaggctgaggcatgagaatcgcttgaacccaggagacagagggtgcagtgagccaagatggcgccactatactccaggctgggtgatagagtgagactctgtctcaaaaaaaaaaaaaaaaagcctgtaatcccaccactttgggaggccccaggcgtgcagatcacctgaggtcgggagttcaagaccagcctgaccaacatggagaaacgctctctctgctaaaaatgcaaaattagccgggcatggtggcgcatgcctgtgatctcagctactcgggaggctgagacaggagaattgcttgatcctgggaggcggaggttgcggtgagccgagatcatgccattgcactccagcctgggcaacaagagcagaactccgtctcaaaaacaaacaaacaaaaaaatgatttagtgttgtcagatacatcttatacttcattttactacagattagtgctagcactaaaaataaaagagaaatttaaaattaagaaaattccatccattaactgaagttttcctgtatttcaaacaagactgtccttatctgagttcagtaatggaaagccttgttcctccactcttatccttcccatagaatacttttctgaaaatctttttttttcctaagttaattaacagggtgaaagtctcttttaactcatcagatgtcagacttgttgtatagtgacagagaacctactcacctgaatgttctgtgtttccattcactccttctttcattaacaaatacttattttgaatgtctacaatatgtgaattacagttagttacacgtatgcaggatgcctccatgattaaaacagagaaagtccttgtccttgtggagtttatattccagtggaggaagacataaagtgagcataataaagacatagattatctagaaggtgatgaatggtttggaaaaaaataagacagcatggtgagatgatagtggtgagagggcagagagaggcagacagggtaggcctcattgtggaggtgacatttgaacagagactagagaaggtgagggagagtcaggtgactaggtggggagaaaagcattgcaggcagtgggaacgcctagagcaagccccttagcggtgtgagctgctgtgggaggactgaacagggtcaggtgtggccaggcaggaggggaggggcagatcctcaagtttggactggagttgtaaatttgagagttgccaccatctatgaagctgtgaaattagatgagaagcccaaaggacgagagggaacagaaagagaggacacatgagcaagtcctgggacgtgaggctggggagaagaggaaccagcaaaagaaaccaagggtggaaggaggacaccagagaggggcattctggaagccaagtgaccgtggacatggccgcatggaggccactgatgacctttatgaaaacaaagcttcactggactatttgggagagactgagagtagataaattggagatagtgtaagatgtacagcaaaggggagcagaggggagagtggttatgagtcgtgttaatggaagtaacagaatgtttgtggccgatgggttatcagtggtggaggcaggagaggagagagaattccttacataggtgtgccatttggagggattaattttagggccactggcatggaaatttcctctgactgatgactgagggcaggccgactcctggggcacagatgcacatagtgggagcttgtggacacgctcctctgagagtacttaagtagggtggtcagttgagagcagatgatgggggatcttatggaggcctgagaaaagaggaatttattggttggtttttttctgccttgcaccttaggttgtataaaggcatgagtaacacactgctgacactttttggaacagggaatactgtgttgtagatcccttgatgagatttgctgtgtctttgttacagggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtaagaatggcagatgtttcacaattaattgggggcctgggagttttatttatttattctctcttttttaagacagggtcttgccctgtcacctaggctggagtgtagtggcgtgatcatagctcactgcaacttgaactcctacagtcaagcagtccaccagagcctcccaagtagctaggactataggcacataccaccctgcctgctaatttttaaattttttgtagatactgggtcttactatgttgttcaggctggttttgaactgctggcctcaagggatgtttctgctccagcctcccagggtgctgagattatagtcatgaaccaccataccctgctggagttttatttttaccttagaaatatcaaagtaatggctgggcacagcagctcacgcctgcaatcccaatgctttgggaagctatgtgggatgatctttgaactcctgggctcaagtgatccccctgagtagttggaactatggacatataccaccgtgcctgcctagataggcatatattggaaaagatacatattattctgtgtcaggcattttcaggtaacaacctaagtatttttcctgtgtttctaaataaccttcatagttgttattgggtatttgtgtcaatatatttgtgtttgtgtgtgtgcgcgcttgtataagtgtatatgattttatttatttatttatttattttgagatggagtttcgctcctgttgcccaggctggagtgcaatggcatgatcttcgctcaccacaacctccacctccccggttcaagcgattctcctgcctcagcctcccaagtagctgggattacaggcatgcgccaccacgcccggctaattttgtatttttagtagagacagggtttctccatgttggtcaggctggtctcaaactcccgaccccgcctcagactcccaaagtgctgggattacaggcgtaagccactgcacccggcctatgatttttttattttaatttttattctgtttatttattttttgagacggagtcttgctccgttgcccaggctggagtgcagtggtggcacctcggctcactgcaaccactgtctcctgggttcaagcgatttttgtaccttagcttctctagtagctgggactacaggtgcctgccaccacactcagctaatttttgtatttttagtagagatggggttttgccatgttggccaggctggtctcgaactcctgacctcaagtgatccacctgctttgggctcctaaaattctgggattacagacacaagccaccatagccagcctgaatgtatatgattttagaaggtatgtatcacggagcatttgcacagagtgaatagaataaaagtccccatatcactgcattttaagacaggtacttactgtagaataaacctttttttttgtttgttttttgagacggagtcttgctctgttgcccagtctggagtgcaatgacgtgatcttggctcactgcaacctccaccacccgggttcaagcaattctcctgcctcagcccccagagtagctgggattgcaggcacacaccaacatgcccaactaattattattatttttattttttatttttgagtctcacctgtcatccaggctggagtgcagtagcgtgatctcggctcaccgcaacctccacttcctgggtttaagcgattcacctgcctcagcctcctgagtagctgggattactggcgcccaccaccacgcctggctaatttttgtatttttagtagagacgaggtttcaccatgttggccatgcttgtctcgaactcttgacctcaggtgatccaccttcctcagcctcccaaagtgttgggattacaggcgtgagccaccacgcccagcccagaataaactttctaagatagtttttcagtaaaggcaaacgtaaaacaaacatttaaaaactaggcagggtgtggtggctcacgcctgtaatcccagcactttgggagaaccagggggcgatcacctgaggttgggagttcagagcagcctaaccaacatggaaaaaccccgtctctactaacaatacaaaattagccgggtgtggtgacacatgcctgtaatcccagctactcgggagtctgaggcaggagaattgcttgaacccgggaggtggaggttgtggtgaaccaagatcatgccgttgcactccagcctgggcaacaagagcaaaactccgtctcaaaaaaataaaaataaaattaaaaactcaacccgaagcaacctcaggagcctaccccattgtaaacactatgacaggcagctggtgaggagagcaggcttgcctgctgaatcttcaggaaagggcccatcttctctaccagccttgcttgatgggcctccagacttactttcctgttcttttgggcaagtaatgctttaaacaatttttcatactgaattttccttacacttttctggtgatcgttacaaaggtggtgaaggttttctgttttctccaatttccaggctggtgcagtttgtcttgatatctttttttttccccatgggtctcagtcctcttgcccgggctggggtgcagtggtgtgatcactgctcactaccaggaggtagccttgacctcctgggttcaagtgatcctccgaccttagcttccagagtaactagggactacaggcatgcatcaccatacctgactagttttttgtatttttagtagaaatggagtctcaccatgtggcccaggccattttcaaacacctgggctcaagtgatactcctgcctcggcctcccaaagtgctgggtttacaggcatgagccaccacacccggctgacttgttatcttaagactggactttgccatgcctgttaaacttcaagaagatttgatctgctctaatataatttttaaagactcttctgtattactgttatctttgctatattatgactattttttatttatttattttttcgagatggagtctcgctctgtcgcccaggctggagtgcagtggcatgatctcagctcactgcaacctccacctcctggattcaagtgattctcctgcctcagcctccctagaagctgagattacaggcacatgccaccacacttggctaatttttgtatttttagtagagacggggtttcaccgtgttggccaggctggtcttgaactcctgacctcaggtgatccgcctgcctcagccttccaaagtgctgggattacagctgtgagccatcgcacctgaccaagactttaaattgatgtgaaaatcaggcatctcacagtactaaaaaaaaaaaaattttttttgaaaaatacaagtgctgagtttttttgatggtagaacaattttgtctttttttttttgagaccaagtctccccctttcacccaggtcggagtgaagtggtgcgatctcggctcactgcaacctccgcccccccaggttcaagcgaattctcctgcctcagcctcccgagtagctgggattatgggcacgtgccaccatgcctggctaatttttgtgtttttagtagagatgaggtttcgccatgttggccaggctggtctccaactcctgacctcaggtgatccacccgcctcggcctcccaaagtgctgggattacaggcgtgagccaccgtgtccggccttattttttatttttttgaggcaagatctcactctgtcacccagactggaatgcagtggctcaatctcagctcacttgcagccttgaccttctgcactgaagcgattctcccaccttagcctcctgagtatctgggactacagatgtgcgccaccatgcctggctaatttttgttttgtagaggcggggttttgccatgttccccaggctgatctcaaactcctgagctcaagcagtttgtcagccttggccttcaaagtgctaggattacaggcgtgagccactgtgcccggccatgagagcaattttttttttttttttgagacggagtcttgctctgtcacccaggctggagtgcagtggcatgatcttggctcactgcaacctctgcctcccggattcaagctattcttctgcctcagcctcccaagtagctgggactacaggcacacgccaccacgcccagctaatttttgtatttttagtaaagatggggtttcatcatattggtcaggctggcgttgaactcctgaccttgtgatccacccacctcgccctcccaaagtgctgggattacaggcgtgagccacagtgcccggctggagagcaattttttaatagtaacttattgtatatagtattttatgtagtacctattttatacagtgcaacttgtttttaaactgtttataggctgggtgcagtggctcatgcctgtattcccagcactttgggaggctgaggcaggaggattacttgaggtcaggagttcgagaccaacctggccaatatgatgaaaccccttctctactaaaaatacagaattatctgggcgtggtggcatgcacctgtattcccagctactttcaaggctgaggtgagaggattgcttcagcctaggagttcaaggctgcagttagctatggtcatgccactgcactccagcctgggtgacagaatgggatcccatcttaaaaaaaaaaaacaaaaacaaaactatttattgcttgtgtctgctttattttcaaaggtctaactcatcttattactatggatttacaccagaaggaaattcagggcttcttcaatattcctgttgacaatttaagagcatctcccttcttattacagtatattcaagaagaggtgagctagctcaaacttttttattttaacattctgattaaggttgaaagatgtatttccatttccttaggatacccctaaaggattaaaacttgatgtattgtacttaaagtaccattatactttatagctataatccaacgcattttagaattctgaatctgcagtttgtttctttagataagctcttaaaattgctttttcttttggacctcaagtacctagaattggactagatatgattgtaatgagtaatttactctcattactagtctatgcttgatcctggttctgttttatgtatccatctatccatcctgtctctctgtccatccagttataatagccagcatccatgatcccacctcccagcaagaaaactagagtcatcatcataacttagagctgctcatgggctccttctctgtcctatccccctgcctccttccaccctagggaaccactgtcctgaagcggtgctgaatctgtcagatgctttttctgtatcagtggagatgatcattttttttccttcattctgttaatgtggtttattaccacccttgaatcctgggataaatcagatgtttaattttaatatagctacatttgtttttctttgatatgagttagcatttttgtgacttactatttaagaaagcttttaaaatgttaatttatactgtacttagctattttgcttttagctgtttttctttctttttttttttttttggtggggggtgtgatggagtcactcccaggctggagtgtaatggcgcaatctcagcccactgaaacctccacctcccgggttcaagcaattctcgagtagctgggattacaggcatgcgccaacacagctggctaattttttgtatctttagtagagatggggtttcaccatgttggccaggctgatctcgaacgctgacctcgtgatctgcctgcctcggcctcccaaagtgctgggattacaggcatgagccaccgcacctggccttagcggtttttcttatataaattatttctctctttaataacttttctagataacttctttttacagtactgtatttaaaagaagataacttctttttacagtactgtatttaaaagatggcagtttataggtttctgaggaacttctttctggtaagaatacagggcttccccattctccagcaattgttataagtccttatagagaaaatgaatttaagtatttttgaaagagaaaaatgtaaaatattctgctttttttttttctttaaagttacacacaagaaacataaaaactctacgccaggcgcagtggctcacgcctataatcccagcactttgggagtctgaggcgggtggatcacttgaggtcaggagttcagaccagcctagccaacatggtgaaaccccatctctactaaaaatacataattagctggatgtggtggcgcgtgcctgtaatcccagttacttgggaggctgaggcaggagaattgcttgaacctgggaggtggaggttacagtgagccaggattgtgccacggcactcctgcctgggtgacagagcgagactatctcaaaaaaacaaaaaagaaaacaaaaatactctaacaaattaaaaaaataatagagactttaattttacctgaaaaattttatgttttttttttgagacagggtctttctctgtcacccaggttggagtgctgtagtgccatgatagctcactgcaaccttgaactcctgggctcaagagatttctcccacctcagccttctgagtagctgagactagaggtgtgccaccacacctagctaatttttaaaaaatatttccagagtcagaatcttgctgtgttacccaggctggtctcaaactcctggcctcaagcgatcctcctgcctcagcctcccaaaacagtgtgattacaggtgtgagccactgtgcctggcctaattttacctgaatattattcttagttgagagagaaggtgagataaaattggcaaatgtcttgatagggaaggatgaagaggtttaggcagagagagagtgagagggtgagcattgaacgtggttcagttagcaaccagccgcatggagaaacctgtcattttggaagaaatagagcagtcgctatagacttatgtgggttgctgtcgacatcttgttgttttaggggatgtttccattcaggacacaggcatgttgtgtgccaatgtctcaaggcacaaatggcaattgcacctcttaagggatgcccggtgggtgagcctaaagaacgaaggctggggcacccttgtgctggttgcaaggtcaggctggaagcctaacgctagtcattgcctgtagtgcaggcttctacctgaggatgacactgccttctacttgaaaaaatccccattttagtttcattgttgagaagaagtcagggctgagtgtggtggcccacacctataatcccagcactttgagaggctgaggaggttggatcagttgagtccaggagtttaagaccatcctcggcaatatggcaaaaccctgtctctacaaaaaatataaaaattaaccaggtgtggtggtgcattcctgtggtcccccctactcaagaggatgagaagtgggaggattgcttgagcctgggaggttgaagttgcccaggtggtcgaggctgcatcaagccgtgatctgggcgacagagtgagattccttctcacaaaaaaaaaaaaaaaaaaaaaaaaaattaatatgtgggaactcagtgttaaaaaggaatttttgtgtattgcttttttcttttttttggagacagtctctctctgtcactcaggctggagtgcgattttggcttactgcagcctccgcctcctgggttcaagcaagcatatctggctaatttttgttttttgtttttttttgagatggagtttcgctcttgttgcccaggctggagtgcaatggcatgatctcggctcacagcaacctccccctcccaggttcaagtgattgtcctgcctcagcctcccgagtagctggggttacaggcatgtgccaccacacccggctaattttgtatttttagtagagacagggtttctccttgttggtcaggctggtctcgaactcctgacctcaggtgatctgcccaccttggcctcccaaagtgctgggattacaggtgtgaaccaccgcacttggcctaatttttgtgtttttagtagagatagggtttcaccgtgttggccaggctggtcttgaacttctgaactccagtgatctgcctgcctcagcttcccaaagtcctggtattacaggcatgagctactacacctggcctgtattgcctttttatagtatacgtatcttgtctcttttgttttcgtgtgttagagcctcttaaagcaggggatagatattcatgtttcactgaatctaaggtgctgtcagtccaggcttacattattttacgtcaccaagaaagaagaaaacactgctaattatactgtggcactgtgccttcttgtcacttagtgatcctattctgcaggttttgatgctgacgctttctccatctcttgtgtttgtcactggaatttaagcaccttctgccagagtcagaaggaacattctggtactaggatgctcgttgccttgaaatttttgccatctatacttttttttttttttgagacggagtctcactctgtcgcccaggctggagtgcagtggcgcaatctcagcttactgcaagctccgcctcccgggttcacgccattctcctaggcctcagcctccccagtagctgggactacaggcacctaccaccacgcctggctaatttttttgtagttttagtagagatggggtttcaccgtgttaaccaggatggtctcaatctcctgacctaatgatctgcccgcctcagcctcccaaagtgctgggattacaggtgtgagccaccgcgcccagccaacttttgccatctcttctgagggcgtctgacagtgtctgttgccttccgctgcactgctggggatgtgtcaggcagtccttttcacagtttgacctactggtagggatcttcctttcttaagtttcataaagcatttgattgttgccttgcaagaaaatgtggaattgtatcatttttccagtgatgaatatttgattcatgaatatcaaattatactctgatggtctcttcctgtgtctttctgcatacatgataatttttcttttcttcttttttttttttttttttttttttgagacggagttttgctcttgttgcccaggctggagtgcagtggcgcaatctcagctcatcacaacctccgcctcccaggttcaagcgattctcctgcctcagcctcccgagtagctgggattacaggcatgggcccccatacctggctaattttgtatttttagtagaaagggggttttccatgttggtcaggctggtcttgaactcccaaactcaggttatccacccgcctcaacctcccagagtactgggattacaagcgtgaagccaccgtgcccggcttgataatttttcattttaatgaaaaattttaatgaaaagaatcatagtaattctttctggagacattttaaatgggttcaaacaattctcctgggttcaaacaattctccggcctcaacctcctgagtaactggattacaggtgtgcaccaccacgcctggctaattttgttttgcatttttagcagcgagggggtttcaccatgctggccaggctggtcttggctcagatgttctgcccaccttggcctcccaaagtgctgggattatgggcatgagccaccgtgcctggccatctttgggaattttttttaatctgttaagtatttcatcccttctatttcttttattattttcctttgggaactattaggtcctgaaaattttggatctagtctctataacttttaaaaacttattttactttttgcatacttatatatagcattctggggaaattccttgtcttgatcttccctggtttgttcttaaagttgtgtttattctgctgttaagccagccagctactgggtttctttagaccataataacttcttccccctagatttatttttggttctttttcataataacttgttctttcttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagtatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcctgggcggggcggctggccgggcggggggctgacccccccacctccctcccggacggggcggctggccggtcggggggctgaccccccacctccctcccggacggggcggctggccaggcagaggggctcctcacttcccagtaggggcggccgggcagaggcgcccctcacctcccggacggggcggctggccgggcaggggggctgaccccccccacctccctcccggacggggcggctggccgggcaggggggctgaccccccccacctccctcccggacggggcggctggccgggcggggggctgacccccccacctccctcgcggacggggcggctggccgggcagaggggctcctcacttcccagtaggggtggccgggcagaggcgcccctcacctcaacttgttctttcttgttgtatataatttcccattttaacctccgtagagacaatagacttgtttttgttagagtcctttcttttaggtcctttaattgttattaactgttttcttggttctgtcttttcttggctgggtttggtaatgtttgatgatgtttgatgagacaaggaaatacatgaaaaagtttagaaagactgccagcaaaaataatgaaagtgcccaaatggaaatatattttactgccttacttcctgagagtgttggataaattaggctttcctgtagatacagctgagccatgtgattatgccggaggcaactgtactaaattattcaaattaatcattttttgttcatttgctaagtagttattatttagtgcttgttgtatggtaggcattgttttatacatgttgctaggtgttattaactgctcatattaaaattcattggtgtaattgtgagaaaaaagcaatgagaatatagttaatatatttttttaaaatagtgctgggccgattatcctttaacaaattggttgcttcaacatgttatgactgcgatatgttaaatagccatttgtttggactgcagtaatttggaatttgacagtcagcttgtattcagattgaattggatatccttgtactttgaaattacatgtaattaggattcttgttgacgagatatatagaaacatctttacactgcatcattagtatttgctggcagagataagagctaatcaccaattatccctacttttttcctaaaagaagtctgtgtggctcacaagttagtaatattttttcataggcaggttcctttcttcattttccaaaggagaattttactttgaactttttctttttttggaaaactttcaactagccaagcatttttgggtctgttggaattttcctttttgttgacatgcagtaatacctgacttcttgtctgtcacagatcccagattacaggaatgcagtaatcgtggccaagtctccagcctcggcgaagaggtaggtgggaatctcacaacctctttctggatctacttctaaggattgtatccgtgatgagttccaggcattctaatttgaacttcagtggttcccagcgatatctcttatttttcttccatggactggtattttaagattgttctgtcaactccatttattaagtaaacattttaatttcctctcttttttttccaatcccactctatgattgccagacatacttccttttttaagttatcttccacttacactttcttttatttttattattattattatttattttattttatttctttattttttgagatggagtttcgctcttgttgcccaagctggagtgcagtggcgcgatctcggctcaccacaacctccacctcctgggttcaagcgattctcctgcctcagcctcccaagtagctgggattacaggcgtgcaccaccatgcctggctaatttttgtatttttagtagagatgaagtttcaccatgttggtcaggctggtctcaaactcctgacttcaggtgatccacctgccttggcctcccaaggtgctgggattacaggcgtgagccaccacactgggccttatttttatttttaatagtagaaacagagttttgccatgttgtccaggcaggtcttgaactactgaggctcaaacgatccacccacccgccttaccctcccaaagtgctgggattacaggcatgagccactgcgcctgacctcaatcatatttcttgaccaaagcaatccagttctggggaatacgatctagtgttttccccagacccagattgacaatcacatgtcagtctttgagtctggcgtttacagtactggcgaatatttacagtactagcagacaacttcatagttgtttactgccccttatttgaggaactcagaaattgattaacagaattttatccagctgagaggccagttatttgtatatgttaaaggtgacattttacaaaattgacacaacctgaggtgtaccaaagggggagccttgagagtcagtagagtgagttacatgtaacctggagtaactgatgtgtcactattgcatacttaaaattatatgtcggttgagaggatttcttatactaccagtgttttgtggagaagccactccactggagagggaaagaacaaaatcacttgtaggaataaagcctttttcctaaaaaagcccttttaaagttattttccagttgaatacctttgatcactggattgttgttgagtcctgtggaatgaaagaaagtgtagggtgcctccaccctgggctcgtgggctggcagtattgaaggatggaggagaacttgcacacagtaagccattgatttcaaaagtatttcacataagtcattgacgttatgaattaagaatagcactttaatatgtagacttagtatattaaataaaataaattggcatttgagataaaaccattacatggctgtgttcttgtggctgactttcccaacccagccgggcctgtgttcacccatgtgtccttcaagaagttgtatcacctgatctcctcttgtccatttgattaaattgtaagaaacagactgaattttagaatgtaaacatttcaaatagcttttccaaacatttcttcaaaggctgaattaattttacttaataatttttctctgatatacatgctttaaaaaaatgtaggtgaaaaatcacataatatacaataattttaaagtatagaattcactggcatttagtgcattcacaatgttgtgtaaccaccacctgtctctgttttcagaacattttcgtcttcccagaagaacatctagtacccattcagcaatcattccttatcccttcaccttctgtccctcggcagccacacagtatgtggccctctgtgtctggtttctttcacttagcagttttcaaggttcatctatggtgtagcatgtagtatctcagtgttttgttgtcgctgttattgttcgagacaaaatcttactctgttgccgaggctggagtgcagtggcacgatctcagctcactgcaacctccgcctcctgggttcaagcaattctcctgcctcatcctcccaggtagctggaattacaggtgcatgctaccacacctgggtaatttttgtatttctggtagagatgaggtttcaccatgttggtcaggctggtcttaaactcctgaccttgtgatctgcctgcctcggcctcccaaagtgctgggattacaggcgtgagccaccgcacttggccagtacctcagtccttttgatggctgagtaatattgcattgtatgtgtatactagtttgtttatccattcatctgttgatggacactttttttttttaccgtttggctattatgaataggactcctatggtcagtcatggattagtttttgtgttggcataagttttcatttttcctttcttgtggatatatattaggattggaattgctgggtcatatggcagtttcgtttatgttttgaggaactatcagtctcttttccactgcagctgcccattttacattcccaccagcagagtatgagggttccaacttctccacatcttcaccaacacttaattctctgagttttttcattataatcatcctagtgggtgtgaaattctaccttatcgtggttttcatttgcatttccctaatgattgatgatgttgagtatcttttttttttttttaatgagacagggtctcagtatgttgctcaggctgggctcaaactcttgggctcaatcaatccttctgcctcagcctgttgagtgtgtgtgtgtgtgtgtgtgtgtgtgtgtgtgtgtgtgtatttatttatttatttatttttttgagacagagtctcgctctgtcacccaggctggagtgcagtggcgcgatctcggctcactgcaacctccgcctcccaggtttaagcgattctcctgcctcagcctcctgagtagctgggattacaggcatgcgccaccatgcctagctgttgagtatatttttatgtgctttttggccatttgtatatatttggagaaatgcctgttcacaccctttgcccatttaataattgggttgtctttttgttgagttataagcactctttatatattctacatactaaaccttgttagatacatgatttgcagatattttctctctttctgcagattgtcttttcactgtcttgatggtgttctttcacacaaaaaggtttcaatgctgataaagttcaatttatctttttttttttttttttttgagacggagtctcagtctgttgcccaggcttgagtgcagtgtctcagctcactgcaacctctgcctcccgggtacaagcgagtctcctgcctcagcctcctgagtagctgggattacaggtgcccgccaccacacccggctaattttttgtattttttagtagagatggagtttcaccatgttggccaggctggtctcgaactcttgacctcgtgatccgcctgccttggcctccccaatcaatttatcttttttgtttgttattgcctctgcttctgatgtcatgtctaagaatccattggccaggtgcagtggctcacttctgtaatctcagcacttcgggaggctgaggcagaaggatcacttgagcccaggaatttgagaccagccagggcaatatagtgagacctcgtttttaagaaaaaaaaaaacattaactggatgtggtggcatttgtctgtggttctagctacttgggtggctgaggtgggaggattgcttgagcccaagaggtcaaggctacagtgagccgtgattgcaccactgcctggctaatttttgtgtttttagtagagacggggtttcgccatgttggccagactggtctccaactcctgacctcaagtgatcttgacctcaaatgatcatcccaaagtattgggattacaggcatgagccaccgcacccagccaccatagctttttaatttttttgagatggagtttcactcttgttgcccgggctgcacaatcttggctcactgcaacctctgcctcccaggctcaagcaattctattgcctcagcctcccaagtagctgggattacaggtgtgcaccacttcacctggctaattagtagagatggggtttcactatgttggtcaggctggtgaccaacctgatctcctgacctcaggtgatccacccacctctgactcccaaagtgctgggattacagacgtgagccaccatgcaggcctctatagcttttttttttcttttgagacggagtttcgctcttgttgcccaggctggggtacaatggcacgatctcagctcaccctgcaacctccacctctcgggttcaagtgattctcctgcctcagtcttctgactagctgggattacaggcatgcgccaccacgcctatctaattttgtatttttagtagagatggggtttctccatgttggtcaggctggtcttgaactccagacctcaggtgatctgcctgcctcggcatcccaaagtgttgggattattggcatgatccaccatgcccggccctctgtagcttttcaatagtcttttttttttttttttttgagacagagtcttgctctgttgcccaggctggagtgcagtggtgcaatcttggctcactgcaccctccgcctcctgggtttaagcaattctctgcctcacctcctgagtagctgggattgcaggcacctgccaccatgcccagctaatttttaatttttgtatttttagtagagatggggtttcaccatcttggccaggccagtcttgaactcctgacctcgtgatccacccacctcagtctcccaaagtgctgggattacaggcgtgagtcaccacgcccagccttaatagtcttcaagttgggtattgtcacacctccaactttgttcttcaatattgtgttggctattttgggtcttttgcctctccatataaacttcagaatcagttttttgaaatacacaaaataacttgttgggatttagattgggatttgcattaaatctgtagatcagattggggagaactggcatcttgacaatattgagtcttcctatccatgaacatgggatatcattttttaaaaattcatctttgatttctgtcatcagagttttgtagttttccccatatagatgtgtactttttttttttttttttttaaagagaaagtcttgctctgtttacccagactggagtgcactggtgccatcacagctcactacagccttgaatttttgggctcatggcaatcctttcatttcagcctcctaagtagctaggactataggtgtgcaccaccatgcctggctaattaaaaaaatatatatatattttttgttagagacgggggtctgactgtgttgcctaggctggtctctaactcctaggctcagcctcccagtgttgggattgcaggcatgagccatcacttccagcccatattttgttatatttatgcctaaataaatatttcatttctttgggtatcccttaattttttagacattgttttctttagttctgtgaacatatttatgatagctaatttattgtgtctagttattctgacattgggctttttcagagatcgtttctgttgactgcttttttactgtgtatgggccatgtttttcttttttttaatgtttaaaaaaacttattactttattattttaatttaatttaatttttatttttattttatgacagagtcttgctctgttgcccaggctggagtgcagtggcatgatctcagctcactgtgacctctgcctcctgggttccagcgattctcctgccttagcctcctgagcagctgggattacaggtgtgtgccaccaaacccagctaatttttgtatttttagtagagacgggatttcaccatgttggctgggctggtctcaaaactcctgacctcaggtgatccacccatcttggcctcccaaaatgctgggattacaggtgtgagccaccatgcctggccaaaacttcttactttaaaaaagaatacagaaacaagatcttgctgtgtttctggactggtctcaaactcctggcctcaagcaatcttcctgccttgggcctcctgaagttctagaattaaaagtgtgagccaccatgcccggcccatattttcctttttgtttgcatgccttgtacattttagttaaaaacaacattttaaattatgtaatgtgaaaaatctgagcatcagattctacctccaccaattcccagtgtttgttgttgctgttgtttctgtgatatgtttgtttagtggccaccctgtgccaattctgtaaagtctgtattctttgtagcattcagccactgaagtctctggttggttagcttactggccagctaatgattggacagagatttcctgaaatgccttgaagcaataaatctcccactctcttcaaggtctgtgtgtgtgtgtttgtgcatgtcttcaattctcccagcagcttacaactctgccttagcctttacttcttggttgcacagagccttaaggtcagccaaggttcaaggttaggggcttttcaggtccttcctgggtaagcgcatgttctttacatgcaggaataagcttttcaaggcccatgtggccatctcattccccagattttccttttttttttttttttttttgtctagccccttgttttactcaactggtattgtcacttcaggcggctgcagtgttaaacagttgctgttgattgctcatctactctggggatgggactattcacacagagtgactctaagtttgatcatattctccagccctgagtctcagcaagctgccagataggcataatagtgatggttacctgagaatgggcttcttgagaagctccaaacctgttcttttcccaccagtggttgctagtcttctgtttctcatggccaccatgattatgaggtttccaatttttgtcttttgcagaactggagagagaggcatgggaataatggaataatgggaatggggcaagttaaaacacacacagtttcttttttttgagacagggtctcactctgatgcccaggctggagtgcagtggcatcattatggtttactgcagcctggacttcctgggctcaggtgatccacctcagcctcccaagtagctgagaccacaggcatgcagcaccatgcctggctaattctcatgttttttttgtagagatggggtctcactatattgcccaggctggtctccaactcgtggcctcaagtgatctgcccatctcagcctcccaaagtgttgggatgatagtcgtgaaccagcatgcccagcccaaagtttgctctttaacaagattcagctgtttttcttaaacactcctcagattgttgcaagctgttggttaacttccacagttatgtaaaagttaatttttgcaaaattttttagagtttttctttctttcatggaggagcagattttttagggtccttattctgccattctagagtggtgcttctctatagtggtgttgttgttgttgttgttgttgtttagacggatttttatacttgtcacttaggctggagtgcaatggtgccatcttggctcactgcagcctccacctcccaggttcaagcgattctcctgtctcagcctcctgagtagctgggattacaggctcccatcttcacacccagctaatttttgtattcttagtagagatggagttttcactatgttggccaggctggtctggaattcctgacctcaggtaatctgcctgccttggcctcccaaaatgctgggattacaggcgtgagccaccacgcccggccctctatagtgttttgaatatcaccttatatagctgttttaatagttgttctaagtattttattacatatacaaaacatattacaatatactgatgtcattttatcagcctgagtgaaatatagaagtcatacctctctgtgtctctttactccccctgtttttaatatatttgtcttaaatatttctatacatacatttatagcagtatcaggctgttagaatttttgcttttttttttttttttttttttttttgaggcagtgtctcgctctgtcaccaggttggagtgcagtggtgcaatcttagctcttggtaacctccgcctcccgggttcaagtgattctcctgtctcagcctcccaagtagctgggactataggcgagcgccaccacgcccagctaatttttgtatttttagtagagatggggtttcactgtgttggccagggtggtctccatctcttgacctcgcaatctgcccaccgcggcctcccaaagtgctgggattacaggcttgagccaccacacccagccagaatttttgcttttaaacatcaaacataatttagaaaagtcagaaatgaagaaaagcttattatatttacaggtatttttgtttccttcttccttgctgatattccaaagtttagtttattgtttcctttctgtttagagtacctccttttgccgcttttaaataatagttctgttggtaacacattttgctggttttccttcatttgagaatgtctagagttccttttcattcttgaaggacatcgttgctgggtataggattctggagtaacggttcttttctctcagcacctgaaaagtttttgtgtcactttcttttggtcactgtggtttctgatgagaagttggttatcatgaattatttttcaagattatttctttgtctttagttttcaaaagtttaattatgatatatcttgagattgctttgggtttatcctgtttggtgtttgctggacttcttgaagctgtgggtttatgtctctgaccaatttgggaagctttcagccattgtctttttgagtacttttttagtcctaccgtctttctcctctttttctgggactcttatgacataaatgtcaggtgtttgtttgtttgtttgtttgtttgtttgtttgagatggagtttcattcttgttgcccaggctggagtgcaatggcgtgatcttggctcaccgttgcaacctctgcctcttgggttcaagcgattctcctgcctcagcctcccaagtagctgggattacaggcatgcaccaccacgcccagctacttttgtatatttagtagagacggggtttctccatgttggtcaggctggtcttgaacttccgacctcaggtgatccacccaccttggcctcccaaagtgctgggattacaggtgtgagccaccgtgcccagctgatcttttgttacaggtccatgggattctgtttatttttattttctagtcttttatatttttattttttagtgggtctcactatgttactcaggctggtcttgaacccctgggctcaagtgattctcccatcttagcctccagagtagctgaaactacaagcacatgccaccatgccctgccacagccattgttctctctgttgtccaaattggctaatttctgttgtctgtcttccagttcactgattctttccttgacctccattattattttcactgtaacttccattctgctgttgagtatatccaactgagttttttttttttttttttttttttttgagacagggtctcacctctgttgcccaggctggagtgtagtggtatgatcacagctcactgcaacctctgcctcctaggctcaagcaatcctcccacatccgcctcccaagaagctgggactacaggtgcatgccaccgtgtcttgcgaatttatttttggtatttttggtagagacggggattttaccatattgcccaggctggtcttgaactcctgagctcaagtgatctgcccacctcagcttctctaaagtgctgggattacaggtgtgagccaccacccccagcccaactgagctttttaatttggttattgtattttttaagttctaaaataagtttttggttctctttttttgagactgagtctcgctctgttgcccaggctggagtacagtggtgttatcacagctcactgcaacctccgctccctgggttcaagtgatccttatgcctcagcctcctgaggagctgggattacaggcatctgccaccacgcccggctaatttttgtatttttagtagagatggggtttcaccatgttggtcaggctggtcttgaacttctgacctcgtgatctgcccgcctcagcctcccagactgctgggattacaggcgtgagccaccgtgcctggctgctaattttgtatttttagtagagacggggttttgccatgttggccaggctggtttcaaactcctggcctcaagtgatctgcctgcctcggcctcccaaagtactggaattacagtcatgagacactacgcctggccttgggtctttttttataccttctatttttttgtcaatactttctttgtttagacttcttgttttttatttcacacatgctcataattgctgcttgtagcacttttctgatggctgctctaaaatctttgttatacagtttcagcatgtctgtcatcttggtgttggcatctgttaattgtcttttttcattcatattgagatttcactggcctttagtgtggcgagtggcttctgattggaatctggacttttagatattgtgtgtgagactctgggtctcatttaggccttctgattttgctggcttctcaggactctggcagggaaagtggtggtgttggggctcgtttctgctaggtaagggtagaagtcgagattcaccaccaggccttgtgtggaccacctaaggtggtccttgttactcatgggtggaaatgctccctccatgtcctccgctgacgccaaggaaaagtagcatcattctcattgggtggtggtggaattcctgactccaccaggctgcctctgataccactgcaatggagaggggaggggcacctctttactgctgagttgggggtagaagtccagatttcactctccactgactctggcagttgctccttactgctgagtgagggtgaaagtcccagctccctgtttggccttctgtgaaaccaccccattgggtttggggtgcctcattatagcctgacaagccaggaagtacaggctcacccctcaacctttactcatgcggcggaaatgtggcggaaacgtgggctgtggctttcctgcctgtgtggctagagtaaggcagttattgtctaaatattttctcactcactaggttgcccttttcttagtcctttgactagggagagccgacctttgttggagcttttcttgtctttgcccactggcatttttgggtcgcttcttctccagctacaaatctgggataataaggcaaaaggaatgcccaaggaagccaccaccgtgacgttgctcaggtcctgaggtcccttgctagtctgccttctctctaccttttagtgtcttctcatttttttttgagacggaatctcgctctgtcacccaggctggagtgcagtggcacgatcttggctcactgcaaactccgcctcccgggttcatgccattctcctgcctcagcctcccgagtagctgggactacaggcgtctgccactatgcctggctaatttttgtatttttagtggagacagtttcaccatgttagcaaggatggtctctatctcctgacctcgtgatctgcctgcctcagcctcccagagtgctaggattacaggcatgagccactgcgcctggccagagtcttctcatttttgtttgtatgtaacatccaggggttttagttgtgggtggcagaaggagtattaataatccttcctagtggaagcagaagtgacaatgttttgatacttttttttccttgagacaggttcttgctctgtcatccaggctggagtgcagtggtacaaccacggctcactgtagcctccatctcctgggctcaagagatcctcctgccttagtctcctgagtagctgggactgcaggcatgtgccaccatgcccagctggttttttccttatttttgtagcaacgggatctccctatgttgccaggtctggtctctaactctagggtacaagtaatcctcctgccttggcctcctaaagttccgggattacaggcatgagccactgcatctggccttgatacatttttttttctttcccactaaataccagaagaacatgatgaattttctgttgactttcccatctgggtggacttttagtaacctctagagtcctcagtttacttctgtcacccacctgttcacagagggatggatgtagtagccttttgctcagtttctttggcttttgtcagtgatgtttgtcattcatctgttcaaatgtttattgagaacctattttgctggggctgatgaggcctaggaagatgccctgtaggaatgcatgtgtagcgtcagatgttttttatctatgttatgttatttgatctttgcaactttggaagtcagcagttataatctctcatagatgaggaaacagacccacagagatgaaggaaccaaggtagttccaccaaatgttgtttccttgaaggtagtggggcaactatttacttccaagaatgttttctataccagtgattaggggacttgagtgttggccaaatatgattgaaattgggccaggtgcggtgtcacacctgtaatcccagcactttgggaggccgaggggggtggatcacttgaggtcaggagtttgagaccaccctgaccaacttagtgaagccctgtctctactaaaaatacaaaattagcggggcatggtggcgcacgcctgtaatcccagctacttgggaggctgaggcaggagaattgcttgaacctgggaggcagaggttgcagttagtcaggattgcgccattgtactccagcctgggtgacaagagcaaaactccatctcaaaaaaaaaaaaaaaaaaaaaaaagaaattgacttgcccccctccactcagtctttaccgagtacatatttgagtgctgctgtgccagccatcgtggatgtggtggtgaccagtgcaggcagggctgtgttcccatggcacttgcagactgccctcatgtgctctttgactggtaggtcagttgggtagattggaacgaaagacccagtctctttttctcccagtttcagtaattgaatccacatagatcatactacattaaatgaatgttttagaggctgggcgcattggctcacccctgtaatcccagcactttgggaggccgagatgggtggatctcctgaggtcaggagaattgcttgaacccgggaggcggaggttgcggtgagcccagatcgtgccattgcactccagcctaggcaacaagagcaaaactccatcaaataaataaatgaatgaatgaacgtgtgttttagtatggagatgagtgctacaaaaggttcagttttatatggaacaggtagtaaaataacacagtcaaggcttaggagtttggtctgtgagtttaaggtattgtgagtgggctaggctcgatggctcacacctgtaatcccagcactttgggaggctgaggttggaagatcatttgagtccaggagttcaagaacagcctgggcaacatgttgaaaccccatctctaccaaaaatacaaaaattagccgggtgtggtggcgtgtgcctctagtcccagctactcaggaggctgaggtgggaggatcacttcagcccagtaggtggaggttgcagtgaggtgagatcacaccactgcactccagcctgggtgacagccagaccctgtctcaaaaaaacaaagtaaaataaaaaggtattgtgagcaagagctctgtcgacatggcatcaacacagtaaagtcagttctggttgtcttatatcccgtagctatgtggtggtgattttcttgtgttctaatgtcctgataaacacattcacccagacttcgagcaggagatggcactttctggctcagccacatgcaaattctgatcctattatttctagttccctcctccaagtttttcatttggcagccaaccttagaaaatagctgtaatcaatgtagaagtcagactggggctgacttttatcagtcaggaaggtattaaattagcagtccaagacttgggcttccacttgtgccttagccagtctttgtgagaaccttggtcaaggctgtctctccaagcctcagtttcctggggataacacctgcttggcttatcttacagagttaataagcatcaaagaacttactgaaggactttataaattaaataccattatgtagaatggtggtggttagtgcctttatttatttattttttgagacagggtctccctctgtcgcccagtctggagtgcagtggtgtgatctcggctcactacaacctccacctcctggattcaagcgattctcttgcctcagcctcctaagtagctgggattacagacgtgcgccaccatgcccagctaatttttgtatttttggtagacatggggtttcaccatgctggtaaggctcttctcgaactcctgacctcaagtgatctgcctgcctcggcctcccaaagtgttgggataacagacgtgagccactgttgggataacaggcgtgagccactgtgtttagtggttagtgcctttagaatcctgaagttattgatgaataggtcgaagtccagagctattgttttggagttgtttgacaatgagcagttgttttgactaaaagggatcatcagagaaagtgttgcttttgtaaggaacagaacttgcttgaatgagttgtttgaaattgttttctctgaataactgagtgaataggaaacaaaaggatagctgaggccctgtgtcttgttctttctcacccatgatgtaaattaactcattatcgtacaatcaggatcaagttgctttagaattcctctctgtcagtgcatgaaacaaaatgacacagagaaaccatcctgattgattttggaattagatgggaatgcaaagtatctgattaagttatatggagtatccagaaactcccattgctgtgcaggtaataattttatttatttattattttacttatttatttttttgagacagagtcttgctgttgtcgcctgggctggcatgcaatggcacgatctcggctcactgcaaccttcgcctcccggattttagcaattctcctgccttagcctcccgattagctgagattacaggtgcctgccaccatgcctgggtaatttttttgtatttttagtagagacggggtttcaccacgttggccaggctggtctcaaactcctgacctcaggtgatccacctgccttggcctcccaaagtgctgggattacaagtgtgagccaccgcacccggccatgattttatttatcttaagagcattgtgctttgtagaggttggtataattgaaatattattctaggaattggcaaacctccacagatcccagatggaaaagacttccttagaggataactaacaggtcagtcatttggccaattttgtttgcaaagccaatcttgaatttcaaggaggaactaataatctatgtgatgccaactcttttgaagactctgccccattgttctgtctgaaatttttttctcttgagaattttttttttttttgagacggagtttcgctcttgttgcccaggctagagtgcaatggtgcgatctcggctcaccgcaatctccgcctcccgggttcaagtgattctcccacctcagcctcccaagtagctggggattacaggcatgtgccaccacacccggctaatttgtttgtgtttttagtaaagacagggtttctccatgttggtcaggctggccccaaactcccagcctcaggtgatctgcccgcctcggcctcccaaagtgctgggattacaggcgtgagccactgctcctggccactctcttgataattttttaaaaactattttgattttttttgtaaggatgaattcaaagttatatgaatactaaatcttacatcttgggatatttatcaaatgttattaaaatattctgtgtttatgatgctccctcttttcccttaggacaaatattctgtcttacacacacatagataaatatattttactgacttcactgtttttgacctgaacagtcttgctcctgtgaaggtttatcatcttttccttggaaatataaattacattcctcatagataggaccagaccaataaatgtttacttacgtgtgtctgagattgtttgtttgtttgtttgtttgtttatttgagacagggtctttctctgttgcccaggcaggagtgcagtggtgcaattatagctcagtgcagccttgaccttctgggctcaagtgattctcccacctcagcctcccaagtagctgggactacaggcgcgtgctaccacgcccagctaatttttgtatttttagtagagacagggtttcaccatgttggccaggatagtttcgatctcttgaccttgcgatccacccgcctcagcctcccaaagtgctgggattacaggcgtgagtcactgtgcctgggccagctaatttttttttatttttgtagagacgaggtctccctgtgttgcccaggctggtctcaaacccctgggctcaagccattctcctgccttcgtctcaaagtgctgggattacaggtgtgagccatcacccagctttaaaaagtatattgaaaataggatgatttaagcatgagttttttgtgtgtttgtttgtttgtttgttcgtttttcagtagagatggagtttcaccatgttggccaggctggtcttgaactccttgtcccaagtgatctgcccgccttagcctcccaaagtgctgggattacaggcgtgagctgccgtgcccagccaaatttaaatttcttgaaataattgctaacactgtagcaaagctttcctttgttgtgtagtgcatataggaaaccaggttgatgtgaaatttctaacagctcataagagtctacatactaatagtatttagtactttctagtgccctgctcttcatatgtcatgtaaatgccttggctgtatctagtatagatagtactagtgggattcagtataatccttaattttttgtttgtttttagtaattcttgtaagcagttagttaagaacttgttttgaatttttggtgctggtaagccaagactgcgagaacttgttggattcttaaacacttgaacatttaccatgcattaggtgctgaggatggaaaaaagagtaagactcagcatggcccccaggaatcaggagtggctgtattaatatcagacaaatcaaggcaaataattttgccatggttgaagaaggtcttttcctaatgataaaggggtcagttcttcaagaggacaaaacagttctaaacatttataaactaaatgacagtgtttcaaagtatatgaagcaaacactgataactgcaaggagaaatagatatatccataatgatagtgattccattattcttctcttagtaattgatagaataaggagactgaaaatcattaaggatgcgggagacttgaacaaccccttcagcctgctggatctgactgacagtcatagcacaccatccagagagagcagaatgtagttcttttttagtataaacacaaagatagatcatattcttgtgagccataaaataagccccaaattgataattatgcaagccatacaaaatatattctctgaccacagtggaattaagaataattctaataacagaagtatctttggaaatgtcctgaatatttagtaactaaataacatacttttagataacccataggtcaaagaagaagtcaaaagtgaaattaaaaagtatttagaaccaaatgaaaatgaagacacaggccaggcgcggtggctcatgcctgtattcccaacactttgggatgccaaggccggcagattacctaaggtcaggagttcaagaccagcctggccaatatgatgatgaaaccccatctctacaaaaaatacaaaattagccgagcgtggtggcacaccctgtaatcccagctactcgggaggctgagacaggagaatcacttgatccagaggtggaggctgcagtgagccgagatcatgtgaccgcactagccaagatcacgccactgcactccagcctgggcgacagagcaagactccatctcaacaacaaaaaaaagccagatgcggtgggaagaagctcctgcaagaggccacggagccagcgacgggaggccttgaagccagtgacgacccactcagccgagctgccgctttcgcagcacgccaaggacactcatgaggaccatgatacttccactgagaatgcagatgagtccaaccatgaccctcagtttgagccaatagtttctcttcctgagcaagaaattaaaacactggaggaagatgaagaacttttaaaaatgcagacgaaactgttctgatttgcctcagagaaggatctcccagaatggaaggagtgaggcaccggcaacgtcaagctcctgaaacacaaggagaaagggaccatctgcctcctcatgcggagggacaagaccctgaagatctgtgctaaccactcttcacgctgataatggagctgaagcccaacatgggtagtgaccatgcctgggtctggaacacccacgccgacttcgccaacgagtgccccaagccagagctgctggccatccacttcctgaatattgagaatgcacagaaattcaaaacaaagtttgaagaatgcaagaaagagatcggagagaaaagaaaggatcgggcaaaaacgatcatgccaaaaaaagtggcggaaaagctagaagctcttttggtggaggaggaaaccaaggaggatgctgaggagaagcaataaatcatcttattttatttccttttcctccctttcctttccttttcaaattttaccctgcccctccttttcggtttgtttttattctgttttgtttttacaagggatgttatataaagaactgaattcaacattcaaaaaaaaagattaaagcataaatcaatgaaatagaaaacaaaaaccagaaaaaagctaaaaagctgattctttgagaaaatcaatgcaattgataaacctttatccagactggttaggagaaaacaagacacaaattacctaccgtaccaagtgttggtgaagatgtggaggaactggatctctcatgttctgctcatgggactgtaatatggtataaccactttggaaaacagtgtggcctttttttttttttttttttgagatggagtctcgctctgtcgcccaggctggagtgcattggcactatctccactcactgcgagctccgccttccaggttcacgccattctcctgcctcagcctcctgagtagctgggattacaggtgcctgccacccagtccggctaatttttttgtatttttttagtagagacggggtttcaccgtgttagccaggatggtcttgatctcctgacctcatgatccgcccaccttggcctcccaaagtgctgggattacaggcgtgagccactgcgcccggcctatgtggcctttttataaagagttaaatatacacctactatatgatccagccattccactcttaggaatttatcaggagataagaaagcatgtggctggacacgtaattccagcactttgggaggccacggtgggcagatcatctgaggtcaggagttgaagaccagcctggccaacatgacaaaaccccgtctctacaaaaaatacaaaaattagccaggcgtggtggcacgtgcctataatcccagctacttgggaggttgaggcaggagaatagcttgaatctgggaggtggaggttcacaccactgcactccagcctgagcaacagagtgagactctgtctcaaaagaaaaagaaagaaagaaggaaagaaagcatgtgcccatacagagatctgtgtatgaatgttcacagcagctttgtgacagccaaaaactagaaacaaccggaaagctcagcaatacataaatggatacactgtgatatattcacccagcagaatattactcagcaatgaaagggaatgaactattgatatgttattccatggatgaatctccaaaacatgtgctgcgtaaaataagacaaaatggccaggcgcaagtggctcacacctgtaatcccagcactttgggaggtcgaggtgggtggatcatttcaggtcaggagttcgagaccagtctggctaacatggtaaaaccccatctgtactaaaaatacaaaaaagttagccagatgtggtggtgcatgactgtagttctggctatttgagaggctgaggcaggagaatcgcttgaacccgggaggcagaggttgcagtgaactgagaaatcctgccaccacacttcagtctgggcgacagagcaagactccatctcaaaaaaaaatcagacaaaaaaaggcaactttatgatttcacttacgtgaaattctagataggtgaaactatagtgacagaaagcagatcagctgttgcctggggcaacacttagtgaaaaatcactaaggggcataaggagatgcttgtggtgatgacgttccttatcttgattgtgctaatgcttatatgggcacatacagccttcagagctcatgaaattatatactttagatatgcacagtttctcatatctcagttttacctccctaaaactattaagaaatttgtgcttaatactttggtgagcattttatgccctttgccccatgtagttggttctcactggtaggtaggcaggcaggtagaattagcagctttaggtgagacagagctgagcggaggttccttcactcagtcaggctctcccggccagtggcttgcagaccaggccaggctgctgcccttctttggtgctgctgcagagggaagtgtttggcatgtggggtctctacagttagtcctggtttctaagagtctaaggctgttttattctctcttttctttagtcctttgggagacaacattctacttatgttctcttaatgttttgtcccctaggcattagcagaaccaagggctgcatgagttttgagcttgtgtctggtgttttccctcagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccagtaagtgtgctgctgcctctttcccactttcctctgattttaaggctgactacactgttgtctgtgtggtttttttcctcattcttcgtttttttttagttggcaaaaactcattaacacctttcttggccagatagtagcgaatgcatttctgattaccttgtaaattgtaaggccgtttagaagcagtctgtccttctttgcaagacctgtgaaaatgtttggactattgagacagttgcaatgcttcagggaagtccattcattcattcagcagtatatactagagtgtagtttaacataagcaaaaagctttttatatacaaagttattgactgtgatgttgtttttaatgcaaaatattagaaaggtttaaatggtttaccagagtgtagggcttggtaaattatactgtgtcagtacagctaattatgcagccctttgaaataatcaagactatctggaaacgagaaaaatatatggaatatatatgaacaaggcagaatataagattgtatacctatttgtcttagttcaggctgctgtgatgaaataccttagactgggtaatataaacaacaaatttattgctcacagttctagaggctgtgaaggtcaagataaaggcgccagcactgaccccgtgatgggccgggcacggtggctcacgcctgtaatcccaacactttgggaggccgaggcgggtgaatcacctgaggtcaggagttcgagaccagcctgatccacatggagaaaccccctctctactaaaaatacaaaattagccaagtgtggtggcgtatgcctgtaatcccagctccttgggaggctgaggcaggagaatcgcttgaacccgggagacagaggttgtggtgagccgagatcgcgccattgcactccagcctgggcaacaagagtgaaactccttctcagaaaaaaaaaaagataaaggcgccagcagatttggtgtctgtcgagggcctgttcctcgtagatggtaccttcttgctgcatcctcatgtggtggagaaaggtggaagactccctcaagcctctctgacaagggcactgacccccttcgtagagcagagtcctaacaaactagtcacctaaaagccctacctcttaataccaccacagtgggttccagcatgaatttggaaggacacaaaaattcagaccatagcattttgccccggcccctcaaaattcatgttcatcttacgtgcaaaatacattcattctatcctaatagcccccaaaatgttaactccgggtaagtcttaacttaatttcagcatcacctcaaaagtctgaagtccaaagtcccatctaaatatcatctaaatcaaatatgggtaagactccagctctgggattcactctgacgcacgtttctctccggctgtgagcctgtgaaatcaaacaggttgtatgcttccaaaatgcaatggtgggacagacattggatagacattcccattccaaaaaggagaagtgaggcccagtgtggtggttcacgcttgtagtcccagcgttttgggtagccaaggtgggagggttgcttgaggccaggagttcgagaccaaaagggagaagtaggaagaaagaaaggagtgacaggtcctgaccaagtctaaaacccaaccagacaaacaacattaaatcttaaggcttaagttgactcaaagccccgccttccacaaaaactggggcaggggttggtcttgcaaagctctggatggccccactcccacagctttgctgggagcagcccatgcagcagctctcagtcactggattctcatgcctgcatctctcaggctggagttgcactctagtggttctaccagtcttgggtcttggggtggtcttgccccacaactccactgggcattgccctagtggggtctctctggtggccctgcccttgtgacagttctctgcttgggccctggcactctttggggcatcctttgaagtctgggtagaggtagatgtgcccccacagctcattcactctgtgcactgtggagatggccctgcacggacaccactgtggtttgttgcctgtgccttccagaggggtggcccgagctatagttggacctgcttgagctatagctggagtgggtaaggagtattctggaatgtgggaagtggagccttgaaatcgttctgcccccaagaccctggcattctaggcttatgatgagatgggcagtcacaaagatctcagaaatgcctttggggtcattgagtcactgtcttgatgaatagcgtctggttctttttttttttttttttttttttttgagacaaggtctcactctgtcacccaggctggagtgcagttgtgcgatcatggctcattgcagtctcacctcctgggcccaagcagtcctcccacttcagcctcatgagtagatggaactacaagcacttgccaccgcacctggctaatttttgtattttttgtagagacaaagttttaccatgttgcccaggctggtcttgaactcctgagctcaagtgatccacccgccttaacctcccaaagtgcttacaggtgtgagccaccactcctggccgtctggcttctttctatccatactaatctccttatcaaatgtttgcttggtggctgggcgcggcggctcacacctataatcccagcactttgggaggccgaggcaggtggatcacgaggtcaggagatcaagaccagcctggccaacatgatgaaaccccgtctctacaaaaaatacaaaaattagctgggcatggtggtgcgtgccttaaatcccaactactcgggaggctaaggcaggagaatcacttgaaccagggagttggaggttgcagtgagctgagatccaagactgtgccaccgtactccagcatggcaacagagtgagacaccatctcaaaaaaaaaaagaaaaaagaaaagtttgcttggctacacacttggagttctgtcctgaacatgtttttgcttttttttttttttttttttttttttgagacagagtcttgatctgtcttccaggctggagtacagtggtgcgatcagatctcactgcagcctccacctcccgggcccaagccattctcctacctcagcctcccaagtagctgggactatagatgtgtgcaccaggcctggctaattttttttttttttttggtagagacggggtcttgctttgttgcctaggttggtcacaaactcttgggctcaagcaatcctccctccttggcctcccaaactcttgggcttataggcctgagccattgcatccagccttgcttttacattctttacaagatggccaggctgataattttccaaatatttaagttctacctcccctttgatgataaatctcatctttaattcatcttcttggattttagtataagcagtcaagagcagccatgcaccctcttttgccaaagattctatttcactgccctttttttttttttgagatggagtctcactctgtcacccaggctggaatgcagtggtgcaatctcggctcactgcaacctccagctcccgggttcaagcaattctcatgcctcggcctcctgagtagctagcactacaggtgcacaccaccacacctggctcatttttgtatttttaatagagatggcattccaccatgttggccaggttggtctcaaaactcctgaactcaagtggtccgcctgcctcagcctcccaaagtgctggggttacagacatgaaccactgcacccgacctttttttttttttttttgagacagtgttttactctcttgctcaggctggagtgcagtggtgtgatcacagctcacagcagccttgacctcctgggctcaatcgatcctcccacctcagcctcccaaatagctgggactgcaggcatgtgccaccatgtctggctaatttttgtattttatgtagagatggagttttgccatgttgcccaggttggttttgaactcttgggctcaaagcgatccttccacctcagcctcccaaagtgctgaaattacaggtgtgagccaccatgaccagcctactgtctgtttttctactagcattgtgatcatgaccacttagatcatttctaagaagattgaggctttctttacagctgttttcttctgagcctgtcttagtctgttttgtgttgctataacagactatataagactgggtattctataaagaagacactttatttagctcacagttcttcgggctggtaagttaaagagcatagcatcacatctggcagtttctggtgagggccacacactaggttgaaacatggtggagaagaaaagtgagcaggcgggtgcagagaaatcacatggcaagagaggaaacgagagagcctgggaagccaaactcatttttataacaacctgttctcatgggaactaagtgccctgagagcaagaactcactcacccccataggaaggcattaatccattcatgaaggatctgcctctgtgacccaaacatctcccactaggccccacctctcaatagcgcacactggggatcaatttttttttttttttgagacggagtcttgctctgtcgcccaggctggagtgcagtggtacgattttggctcactgcaagctccacctcctgggttcaagcagttctcctgcctcagcctcccgagtagctgggactacaggtgcatgccaccacacccggctaattttttgtattttagtagagatggggtttcaccttgttgcccaggctggttgaactcctgagctcaggcaatctgcctacctcggcctcccaaagtgctgggattacaggcgtgagccactgcgcctggcccaaatttttaacataagttttagtggagacaaactacatccaaaccaaagcagaactctcaccagagctcccctttacggtctgtacatagcaatacagtctttttctagccttttcctcttccagcctctgcccattacccagttccaaagccactcctgcattggtgggtatttaatacagcagcaactcacttctcagtaccaatttctgtcttagtttgttaaggctactataacaaaataccttagacttggtattttttttttttttttgagacggaatttcgctcttgttgcccaggctggagtgcaatgacacgatcttggctcaccgcaacttccacctccacctcccgggttcaagcgattctcctgcctcagcctcctgagtagctgggattacaggcgcgcaccaccacgactggctaatttttgtatttttagtagagacagagtttctccatgatggtcaggctggtcgcgaacccctgacttcaggtgatccgtccacctcagcctcccaaagtactggaattacaggcatgagccactgcacccggccagactgggtaatttataaacaacagaaattcattgctcacagttctggagactgggaagtcctggatcaaggcaccagcagattggtgtctgatgagggctcactctgctcctgaggtggcaccttgttactgtgtcctcagatggtggaaggagcaaggcagctctctgtaagggcactaatcctgttcatgaaggcagaggccttgagccttaatcatttcccaaaggccccactgttaatactatcacattgggtattaagttccaacatagcattttgagaggacaccatcttcagaccacagcactctctttgtctatgcaaagaccaggaggaaataggaagaatgaatgtagttgggttggggtggtagagttatgcatgaatttgtttttgtgtttaagaaacttccccatgccttaataacatcttcttaattaaaaaaaaaaatgccaccttcgagttgttggggaagaaccctaaccccctgccctcatagattcagtgtttggtggcatatggactaaactggcaaaagacagatgaggaagaggaaaggcagtttaatcacatacatacagatgtgtgtgattaaactcttttgtgagtcacaaaaatgtgactcgaagtggttacaatttggggcttatatagcatcttaataggggaacaggaggggcagaaaaggcccctgtgggaaaacagatgacttctttttttttttttttgaaacgctcttttgcccagcctggagtgcagtggtgcaatcatggcacactgcaacctcggcctcccaggttcaggcgattctcctgggtagctgggactaccggtacatgccaccatgcccaggtaattttggtattattattattattattattattattattattattatttttttttttttttttttttttttttttttttttagtagagacagggtttcgccatgttggccaggctggcctcgaactgactgcaagtgattcgcccgcctcggcctcccaatgtgctgggattacaggcgcccggccaagatgactccttaataggggaagaggaggagggaggggactgatgggaagtgggcgctgaggagaaaagatgggagagaggctagtttttgacagcgtctgtttaggtgtggtctggacttcttctggtcttaagcgataagagtcagtcttccctggtgttcccagggaggagatttatcacagttgagttctttggagttattttgtgaggctctgcttttcagcatataagggacttcaggaactcaaatgctttcagctcaaaataatttttaggtcacagaggtatattctggactgttaggtttttgccttgcccaggagtttgctcatttataaatagagggaaaaaaaaaccagagaaggaactagtgtggttgggatagccatgcacgcagctgggattccagctatactttgtagatcccaactgaggtggaaagggaaggccatctgggcaggggttaaatctcctaaggggtgggggactgagcttgagtttgcatctggctccatcacttatcagctgtgtgttcttgggcctgttgtttttctgaaaaagagcgacagcaagaggccatcctcagagtggacccatgataggccaagatggtggaaagcccaggacgagccctcaggacccagcactgcctgccttatgtgagtgagataggactgcagtggtgagacgttcagtgatgggccatggtgtggccaggaagacactagcctgactaccaggaggcccctggagggaagagatggactaagatagcagtatctgcggggagccaaccaaggaggactttgaataccagtaaatacactcgtgtcctagaaggcagcccacaaaggctctcgatccgggccatttagtgttcagcaggccaggcctgcatctgtgtttgggatagggctgcaagtgcagaggccagatccgggaggctgatgaagttgagcaggcacatgggaggagagcttgatctcttgggctatgctgtccagtcgggtggccactggctacatgtggctcctgcacactgggaacggggtggggagcagtgggagtgtgaaggacacacccctaatctgaaaactttaatgtaagtatctcattagtgaagttttattgactctgtgttaaaatggtaatattttgatatgttgaatcaaatcaaacatgttattaaaattaattttacctttttttgtgcttttgtaatgtggctactagaaaatctgaaattgcatatgtggctttcatttctgttgtgcgttattgctctaggggttggtaacaatgggaatgaaagtgacagagcacattgagaaatgttaaaaagacgatgggagggaggccaggtactttggcgcactcctttaatcccagcactgtggaaggctaaggtggaaggtttgcttgagcccaggagtttgagaccagcctgggcaacatagcacaaccccgtttctacaaaaagtttaaaaattagccaggcggctgggcgcagtggctcacacctgtaatcccagcactttgggaggccgaggtgggtggatcatgaggtcaggagttcaagatcaaactgaccaagatggcgaaacgctgtctctactaaaaaatataaaaattagccaggtgtggtggttcgtgcctgtaatcgcagctactcaggaggctgaggcaggagaatcacttgaacccaggaggcagaggttgcagtgagctgagattgtgccactgcactccagcctgggcaacacagtgagactacctctcaaaaaaaaaaaaattagccaggcatggtggtgtgcctgtaatcccagctacttgagagtgaggtgaaaggatcacttgaacccaggaagtcgaggctgcagtgagccatgatggtgccactgcactccagcctgtgtgacagagtgagaccctgtctctaaaaaagatagcaggagggaatgaacatttttagtgtattagtctccagtacagcccttttaattgagtgatgattttccactttatagataaacaggatcagaaagagaaagcgacttccctgcagtcacatagtgacaagctggacatgtctgactaaaacctgtgctttttccactgtgttcttgggtctcttggacttagtaatggggatttaaggaggaggaaggcagtgagatagagccagggttcaggatttggggctgggagggtgttaataaagcgtttggctcaggacctcaaagccttttgcttgtgtgtgcatttctcacagcctcacgtgcccaggctgttggtgctggggggtaggcctggggctgccgctccctttcagaatccttgcctggcctcagaggggcttgtgtctaggaacctcagcagaaccctgcaagggctggctgggaccattggtgagatgagccatgcccgggagcatggaagaatatatgttcctcttcagtcctgtaagcacatgggctgtgatgaggaacgcgttggcagtctttagatgaacgctgcttctttggaacttgctgggtgttagcttttggtgtggcctttgggagtggactctggactgcagacactgaactacaggtttcccatctggaaatgagttcataggactggatgatctctatgttctttctaatatttctttactcgtgggatctttatgtttcattcataattttaattataatgtttctatgtttatgttttgactcaagtagtgatcactacaggccgtctttgggaatgcagtagaattttagtttcatagatcctaaatatttgattgtttttatacatttgatgattggacaccctacatagaatacttttttaaggtactagcaaataatatatgaagggaaaagaaagcattcttcctgtagcatctcgaatataaagattttgttatttagtattagattttaaaaattattttgtatcctctgatttcttatagatgaaaatatgcctactaaaaaacaatgaaaatactttttcagaatataagcactatatataatatttgaaaatattatccataaaagttagaagaaaataataattagtgcttgatgccactattcaaagacacaccactttaatttggtgagcctctttttggtttttcacccttattttcataaagctgcgatgcatgcttcatacataattgtgcatgttgctgcctccttctcccagctgcccgacgtgtcatctcaggtcaccagaaactttgacaggaaacagcaatttcttttttttttctttgagactgggtctcactttgtcacccaggctggagtgcagtgacaatcacggctcactgcaaccttgacctcccaggctcaagcgatttgtccacctcagcctcttgtaaacagcatttttatggctaataacccatcgtatgaatgtggcttagactgcccaaccacagcctaatttggggtttttatgttttcttctgttctttgcccttataatgtggcaggaaatatatgtggataaaacacttttcccatactttggcttatttcatttcaagcttctaaaagtgagattaatgagtcagaaggtatgaatataaggctttttgtcaaattgatttcctagagggtgattcattatactttttcaccggcattgaggtcaagtgtcctgggagtaggactgttgaaaatgtaaaaagtcacttcagttctggaatttatcttgctttgctttgttttgttacacttttttgccctctcctgatgctcacctggggtcacacattgcctctggttgtcatatgtctttcatctctttcaatctagagcagtggttctcaattagggagtggatattgtctcctagaggtcatttggaaatgtctggagatagttttgattgtcagaatcaagggggtggctactggcatctagtgagtagaggccaaacatgctgctaaacttctcacagtacgtagggtggtcccttgcagcataaacgtgtctggcccaagatctcagcagttgaaaagtcccaatctagaacagtattttaactttttctttttgtgacattgccttaaaagaaaattgaagtcaaagtcacataacatagaattaaccattttaaagtataaaatttactggctttcagtatattcacagttttgtgcagttaccatttctttctagtttcaaaacttctcattaccccggaagaacaccctgcacccattaagtagtttcaccatgcccccatcccccagcccctggcaaccacttacctcttttctgtttctgtggatgtttgcctaatctggacacttcatataaacggaatcatataatatgtgggcttttgtatctggcttctttctttgagcatgtttttgaggttcatccatgtgatagcacttgtcagtacttcattgcttttggtggctggataatatttcattgtcagcatttgaaaggaatttgggttgtttccacttttggctatgctgctctgtatattcatgtatgagttttctgtgtggatagatgattcatttctcatggtctatacctggtatcggaattgctgcgtcacttggtgtatgtttaactttttgaggaactgccagactcttttttcacagcagctgcaccattttatattcctaccagtaatgtacaaagatttcagtttctccacatcctcatcaacacttattttctactttttattgtagccagcccagtgggcataaagtggcatctcattgtgattttgataaacatttccctaatggctaatgacttcatttgtatatcttctttggagaaatatctgttgaaatcctttgcccatttttgaactaggtttgtctttttttgttgaattataaaagttctttatatattttggcatatggcgcatatatatatatataatttttttttttttttttttttttgcgacagggcctcactctctcacccaggctggagtgcagtggtgcaatcgtggctcactggagccttgacctcccgggcccaagtgatcctctcacctcagccccctaagtagctgtgactactgtcatgcaccaccacgccctgctaatttttgtatttttttatagagacagggtttcgccatgttgctcaggctggtctcaaactcctgaactcaggcaggcaatctgtccacctcggcctcccaaagtactgggattacaggcatgagccaccatgcccagcctactttatatattttggatactagactcttaccagatacatgatatgcaaatattttctgccattctgtaggggttttttttacttttttatttttatctatttatttatttttatttatttattttttgagacagagtctcgctctgtcacccaggctagagtgcagtggcatgatctcggctcactgcaagctccacatctcaggttcacgccattctcctgcctcagcctcccaagtagctgggactacaggcgcccactagcacacttggctaatttttttttttttttttttttttgtatttttagtagagacagggtttcaccatgttagccaggaaggtcccgatctcctgacctcgtgatccgcccgcctcagcctcccaaagggctgggattacaggcgtgagccaccacgcctggcgtggaattgctttctcaattccctcttttgattgttcagtgctgctgtgtagcagctgattttgtgtgttgattttgtacttggcaacttggctgaattcatatattattagctttggtaggtggatttgtggattcttgggtattttcaatatgtaggaacatgtcatctgctaatagagatagttttacttttcctttctgatctggatgcctttcatttcgttttcttgtctaattacccttgctagagtatccagtatgatggtgaatggcagtggtgcagtgggcatccttgtcttgttgctgatcttaggggaaagcttttggccttcggccataaagtatcaagttagctgtgggtttttgtagttgcccttaatcagattgaggaaattcccttgtattcctagttggttgaatgtttttatcttgagatattaacttctttaaagttttgttttactttttaatataaaaattttggtgtgtgtgttttattccaaccagtgctgattcctaaagaaaagcccccaatcacggttgtgggtgatgttggaggaaggattgccatcatcgtggtatgtagacctcttttattattaattctagtatttgccattgttattctgttgattgattgattgattgattttattacagagactcactgtcgcccaggctggagtgcagtggcacaatctcggctcactgcaacttctgcctcccaggttcaaacgattctcctgcctcagcctcccaagtagctggaattacaggtgcctgctaccacgcctggctaatttttgtatttttagtagagatggggtttcaccatgttggccaggctggtctcaagctcctgaacttaagtgatccacctgcctcggcctcccaaagtgttgggattacaggcgtgagccactgcacctggccaatttatttgttaattctgggcatataaaggcctaaggatagtagtatggccagataattcttattaaatttgtgccttgtgctaaatgtttgctttggcccagaaattggaaaatgctattgtttattttaaaattgctcactactggctgggcgcgttggctcatgcctgtaatcccagcactttgggacgccaaggcaggccaatcgcttgggctcaggagttcaagaccagcttggacaacatggtgaaaccctgtctctacaaaaaatacaaaaattagctgaacttggtggcacatacctgcagtcccagctacttgagaggctgaggcgggaggatcacttgagcctggggctcagaggttgcagtgagccgagatcatgccactgcactccagcctgggtgacagggtgaggctgtgtctcaaaaaaaaaaaaaaaaaaagtcatcctgtcataacatgagatattgttctgtgatcaaagtaaagtacaagctgggcacagtggctcatgcctataatcccagcactttgggaggccaaggcaggcagatcacctgaggtcaggagttgaagaccagcctggccaacatggtgaaaccccatctctactgaaaatacaaaaattagctggacatgttggcgcacacctgtaatcccagctacttgggaggctgatcttggagaatcgcttgaatctgggaggcggaggttgcagtgagccaagattgtgccactgcactctagcctgggcgaaagagtgagattccatctcaaaagaaaaaaaaaaagtaaactacaaagttgattataactgtttgaaacatgcatcctttcacacatcataagaccagtgcacaaaaagagtgcacttcatgcctgtatattttaaagaatagaatgaacactgggtacccgctagctcacttgaggcatagatcatcaccaggtacctagaggcctcctctgggcttaccctggtctctttgcctcagaggttgtcactgatgtgaaagctgcccatcttgatcctgtagtcagccatgagggcttgtggccttaaatgctgcctttttttcttgtctttgatgtttatgtaaatgatgtctttgtgtactttgggactttcttgctcaacactgttattgaaatttacctgtgtagtggcaggaagttgtacttcattctttttcactgctatgtgttgtgtctttggtataactgctacacaactgattgaggcaatggtactgctttgaacatcctcgtgcctattttctggtgcaaaagtgtgagagtttcaaggtgcctgggagtggggttgttgggtctgaaggtatgcacatttttaactttacaaggtgctgccaaattgtttccaaagtggtcacacccatttcccaagttccatagtgggtgccccacattatccccagtgcttgataattttgtacgcacccttttcaggttagaaaatctctctggggccgggcacggtggctcacttctgtaatcccagcactttgggaggccgagacgggtgtaggtcaggagatcgagaccatcctggctaacacggtgaaaccttgtctctactaaaaatacaaaaaattagccgggcgtagtggtgggctcctgtagtcccagctactcgggaggctgaggcaggagatggcatgagaggcggagcttgcagtgagccgagatcgtgccactgcactccagcccaggcgactgagcaagactctgtctcaaaaaaaaaataagaaaatctctcacgtcaccctccagggtaatagctgtccattacttattccttagttggcaaagtctatagtaacaaggtgctgtggattcagtagcacctttccccccgttctagtgccactgcattatttatttatttatttatttatttatttatttctatttttttttttgagacaaagtctcgctctgtcacccaggctggagtgcagtggcgtgatctcagctcactgcaacctccacctcctgggttccagcaattctcctgcctcagcctcccaagtagctgggactacaggtgcacgccaccacgtccggctaatttttgtattttttttgtagagacggggtttcaccatattcaccaggctggtttcgaactcctgacctcgtgatctgcccgccttggcctcccaaagtgctgggattacaggcgcaagccactgcacccagccgccagtgcattttttaaaaaaacgtttttattttgaagtaattatagatccacaggaagtagggggcaatacacagggacatcctgtgtattcattacccagcatcctccatcttgcttaactatagtacaataacacagactgaaaattctcggtgccacagccacagaggtccttcagacagcaccagttgtgcatgtagtgagtgtgagtgtgtgtgtgtgtgtgtgtgtgtgtttgtgtttgtgaatgcagtcttaccatgggtagctttgtggaaccaccaccacagtcaggacacagaattgctccttcactgcaaggcaccctcatgcttcctttcatagctacactgacatccttcccacccaatctgcaaccccttgtgtctttgtccactttgtgctgctgtaacacctgagactaggttgtttataaagaatagaagaaatttattctctaacagctctagaggctgtaagtccaaatcatggcaccagcatttggtctggtgagggccttcttgctgtgtcctcacatggcataaggcagaaggacaaaaaggaatgaactttccttcagaaggccaggaaagaggttaacccactcccacaagcctttttatagcgacatgaattcattcctgatggtggatccctcacaacctaaacactttcccaaagaccccaccacccaacactgttgcactggggaataagtttccaacacatgaattttggagggacaaaaacattcaagccacagcactggcaaccactgatctgtcccctgtctttctaattattatttcaagaatgtcatataaatggaatctatggtatataaccttttgagttttgtttaacctaccatgattcccctgagatccatccaggttgttttgtatattaatatgttattcctttttattgctgggcagtatcccatggtatagaggtaccagagtttatttgttgaaggacatttggatgatttccaggttggggctattatacataaaactcgctatgtacattcatgtataggtttttgtgtgaacagagttttaatttctctgggataattgcacttacaaatgcagttgttggtttgcatggtagttgcagatatactcttataagagactgtcaaactgttttccaaagtggctgtaccattttactagtaggacttttaaagtagcgtgtgtgtgtgtgtatgtattttttttgaggtatggtctgggtctgctgcccaggttggagtgcagtggcttgatcacagatcactgcaacttctacctcctggctaaagcaatcctcctgcctcagcctcccaagtagctaggactacaggtgcgtacctccatgcatggctaatttttgcttttctgtttttgtagagactgggtttcgtcatgttgctcaggctggtcttgaacccctgagctcaagcaatcctcccacctcagcctcccaaagtgctgggactacaggcatgagccaccacgcctggcctttatatgtatatttttgatcatagtaacatcagtatgcaattaaagagtaataatatgtatgtaaaataaagacacgaatatttattcaactctagacaacgtttgatgccataatgggtttaaaataactctgggagcctgggaatctagtctctagattggaaaccactgaactgggtattttattattaaaaacaataatcattattattttttccattgtaataacatgtaaaaaaacatatttcccatatgctcagtggagaaaatttggaaataaggaaagtagcaagaagaagtggggggaaagaggcacccataattctattacccagagtcaaaaacatcttttaacactttttctgtgcattaaaaacaaaaaaagaaaattatacctccatcatttctggtgtgacctgcattgtgacagcacaatgttggccagttatggtgcagaaaacagtgctacccctgggagcctggagtgtggtgggagatagctccaatagtggcaggtgctgtgcaggaagaggctcgtgtgaaagtactggagggctgccatggggcacggtgatggggacatggggccatgccgtctgcacaaggccaagtggaagagcagatttttcacggtaaatgtaggcagaccctttttttttcctggttgtctaacctattattgtagaagtgctcatatacattcttttccatctgtgctttggcaggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtaacagggtctgggtgtgtgtgggtacagctgcctgggcttttggcacatcttgatctttagttacagagagtcaggacaagactgagatcttttgtggctgagaaacgattcaagggctgggtgcagtggttcacgcctgtaatcccagcactttgggaggccgaggcaggtggattacctgaggtcaggagttggagaccagcctggccaacagggtgaaaccccgtctctactaaaaatacaaaaattagccgggcgtggtggcacacacctgtaatcccagctacttgggaggctgaggcaagagaatcactggaacccagagggcagtggctgcagtgagccgagattgtgccactgcattccagcctgggtgacagaatgagactcttgtctcaaataataataataataataataataataataatgtgtacaactcattggtttttagaatgttcagagttgtgcagtcattaccatagttggttttagaacattttcttcttcctagaaaggaaccccatacccattagctgtcacttcacattttctctcactgccattagtccctgggaaccactaatctgctttctgtctctctagatttgcctgttctggacatttcatataaatgagattatacaatgtgtggtcttttgtgtctggctgtcttcactcaacataatattttcaaggttcatccatgttggagcatgaatcaatacttcattttatgatcaaataatgctgtgttacatggatagtccacattttgtctctctcttcgtatttcatgttgatagaaaaaattttttttctactttttaacttatgaatggtgctgcagtaaacatttgtgtacaagtttttgtgtggacatgtgttttctcttctcttggatacgtacctaggtttagaactgccaggtcatacagtaacttcatgtttaaactttcaaggagctgccagactgtttttcaaagcagctgcgccattttacattcccacagccgtgagttgggggggggctccagtttctctgcatccctccagtacttgttattatcttttttgccatacctatcctagtgggtgtgaggttatcaaatcttaacctaagaaacacaggctgggcgcggtggctcacgcctgtaatcccagcactttgggaggccgaggccggtggatcatgaggtcaggaggtcgagaccatcctggctaacgcggtgaaaccccgtctctactaaaaatacaaaaaaattacttgagcgtggtggcgggcgcctgtcgtcccagcttacttgggaggctgaagcaggagaatggcatgaacccaggaggcagagcttgcagtgagctgagatggcatcactgcactccaggctgagcgacagagcaagactccgtctaaaaataaataaataaataaataattgaaacattgacttgagacatagatccactgtgttttcctgtcgtggcaagcctcagatttgagaagctgtcacatttccagatcaaaccatgaagctacttggctttctgatgctgtggttttttttcttttgcttcacaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataactaaaataaaatgaaagctaaatctacacgctgtgaatgttgaa

SEQ ID NO: 1252 - DNA, 74989 bp, Homo sapiens; identical to SEQ ID NO: 1248

SEQ ID NO: 1253 - DNA, 137454 bp, Homo sapiens
ccgagcccagtcgagccgcgctcacctcgggctcccgctccgtctccacctccgcctttgccctggcggcgcgaccccgtcccgggcgcggcccccagcagtcgcgcgccgttagcctcgcgcccgccgcgcagtccgggcccggcgcgatgggggccgccgccggccggagcccccacctggggcccgcgcccgcccgccgcccgcagcgctctctgctcctgctgcagctgctgctgctcgtcgctgccccggggtccacgcaggcccaggccgccccgttccccgagctgtgcaggtgggtggcccgcccggacgcaggctccgctcgcggtgcccggggtgagcggccggcgtggggggcggggagcgctcgaggagctcctggggtctccaagtcgcctccgttccgcgccggggtccgccccgttcccgagggaaagttgcctgcgtggtgtccgcgagtcccgccgggtcccgtgcgcaggcggggggcgcgggggcacacgcggtcgtggcggtcctggagccccgcgtccggccacttgtggctgtcgctgagtcgggggtggctttgtgcggagcggtcgccccggcccttggggtcggcgcctgccctcgcgcggccgggcgtccgggaaagttggaggcaggaactccagtttgctttgttcccgctgcgcgtttgcatcagagtttcgccagcggggcaccggtgaggcccctcggtgtggagaggctcaccggggcgttggagcccgcaggaatggtcctggagttgagtgtttgtggtttcatttgctgattgatttccccccgtgggctcattttctctttaaagaatatatatatatatatatttttagcaggcggtgacttttgtcttctttagattgggggcagggggtgtcgtccagtgtgagctttcaagacttgacccttcacttctctgagcccaacttcctgcctggttgctcacatgatgtcattgtctccggggcggattattctagtggatcttgctctgggaaccatgattgtataacccatcagtcccatcgagggctgttcacctcgcgcaactgctagcagtccagggcctggggaacttcgaatttcaggaattttctgaccatccttttctggactgtttaggatgatggaaaattcagcttttgtttatttttttaaactttggtaaaaaggaagcaggatgaaaagttttgaacagacaacagtttctccctgttactgttacttttacaagttacttttacaagttacttttcagagtgaaacaaagttgagcctactttgggctgaacttggagtttgtggtagggtttatggggggggttcttatttttcccatgcatcagagatagttttattagcacccctgtgttcagaacatgcagaaattagtctaaggagggtgaggctgatctcacgatagaaactctttggaaaggcccatattttttatgctcccttttttggaaggggaagggtggatggagggagagtttgtgacactagtttaaagaccagttagctaccctaagatacatagttactccagtaactagtatgatacagagaaatggtggcagcttaaacgaggtcaggctgagaacaacatttagaggaaggcattttggaataatggcttctgtgaccaaaaataagaaattaactcgcctgggcgcggtggctcatgcccggaatccagcactttggaaggccgaggtgggcgggtcacttgagtccaggagttggaggccagcttcagcaacatggcgaaaccccgtctctacaaaaaatatgaaaattagagccgggcgcggtggcacactcctgtcctcccagttaagggaggctgaggtggtaggataacgttagccccgcaggtcgaggttgcagtgagttgtgatcgagtcgagttgcactctagtctgggcgacagagcaaggccctgtctcaaaaataaataaataaatacaataagaaattaacccagctggcctagtgtggttgaagtcttggtcttgttaacaaattgaagtttgttttcttcacagttaagattaaggtggcttcaagggcagactgatactttggctgattgatgggacccttacttttgcattaggttagtcatggcagtgtcttgaacctgtgttcacgaacttcatctccaggtggaacacggcctcttggtctagtaggaatggcctttgtatctttacgtttttctggccactgtcacacgtgggcatacttagcaaatgctgaagaggtttctgaggttgatatgcattgtgaatataataagatctgccctttgtagtcttagaatatcttaaaagttgtgtttaatttttctgccagattttcttaggatgacaaatctgccaatcatttcagagacggattttcacccacctctttccctgttacttccctgtagttgcacatgcagacttctccagaaccacttgcaatctctactttaaacccaacatgtgccaagtgaacttcctgtctgttcctgttttataattttttgaggcagggtctcaccgcgttgcccaggcagaagtgcagtggtgcagtcatagctcactacagtcgtgaactcctgggctcaggcagtccttccacctcacccttctgtgtagctgggattacaggtgtgtgccaccccacttggcttattatatattttttaaaatttttaatagagatgacgtcttgctatgttgcccaggctggcctcaagctcctatcctcaagtaatcttcctgcgtcagcctcccaaagtgttgggattacaggcatgaggcaccatgctgggtttatgttcctgttttaaactgatacctctccttaaatactttttgaaaacttttcttggggcgggggaggttatcagtcatctgtacttttatgagataaaactggctaaaatttccgtaaatgtagcatgtagttgaggaataggaatgtaagttgattttttttttaatttgatacaaaaaattttatcgtgtcaccaaggtgtgacgtgttaagctccattttaattttgttcctgggcatcagtttgctgaaatgtaaataactcggccaggtctccactgtgagcatgaaaagtcgagtcctacaaatgtccccgtttgtttttgctgcttggtcacatggaggcagtcccaaatgtacagaaggatcacattccaaatgtttgtaaattggtaatttcatacgtggaatgtgtttttccattgatagtattcttgttcattgtatggcccccagaaagtcattatccttgcaaaggttttggagcacccagacaccatatggctttaacagaatcctagccgtaaattctcattgtctctaaaagatggagttggatttccaggaaaactacctctcctcccaagcccagctctctagaacctagagagaatatttttcatctgcagtcgcttagacccacaagagggacatgagggcctgcttcaggggtgcctgcgaggcaccttgtgggggcaaagcttcaaggtgacctttggctctgagcactcctgggatggggtgcggttcctggtgcagttagttattgggaggaacgaaggagacagcaccatttcagcagcagctttaactgtgtccgtgcacgtggaggggcctgccctctgagttgtgcattgaacagcaggcacgacaaaggctcatttcccaaagtgtatctggcttgaagcagcgctttaaataagtgcatggttttttttggagagactcagcaaagcatttttcaagtgtcaagtggattacttgccaggtggtcccagtgctgagttagaagttaatgattcttatgcaggtatttcttgggaggtgatattgctagtacaaagttagtagaaaacttgtttctgaggctagtgtgataggctgtgggactggcctgtagaaaagacctggggcaggaaggagtgttgaaggtcagtggagggcgggaatagtagagcaagaagagagggcattcaggaggagaggagcagaggccaggccatgcaaaaccaacaacagtgtctaaagtgatctcagcttgtcagtggctttacttattaccatatgctttaaactttgtaaaatgtcatattatatatgtaatatgcaagtttccaccctttagttaggtgttaacaagatgcttaatgggtgaggtcttagcagtgtgcattaatgataaaataatgctttgggatggttagatttaaggtagttaagagcttcaaaatttgtacaggacaagttttccccaaattgtttaggtataaatgctagaaagtttttattatattgaggacaagagaataatgaagccagctgggagttgaggttggtttagttactgtctctaaggagatttttttttccctgtaatttttccaaaggaacagtgcttatatgcctaatttgggccacatgttaaacctggatcacatccatttgtgtgtgtgcatttcaacagtaagtgtatgtggaagcctaaggttgttaattatggttacattagatctcatggattaattctcagaacagcatcctgacagattcccaggaaatgaatgcctgcgttgggcctcacgtcttttgtcagcatttcatagagagagggatttttaaaagatggggctgagagaaataattgagatgttcccttccctattttgatcttggtatataaactattgtattggggaaagaactgagcaggctctagaactgagcctagtggcagagagtagcttatcactttgcaggtgctgttctttttcttcctccttttcttctttggattgtcctagccacagagagctcttgctaatgttgtaactggtcatgaatggtgtatgaggaggtgggcgtagcagctgtttgacttcatgggacccaccagactgtaatgccgaattacaattttgcatttccaccagtgatgtatgagagttccagttctatatccttgtcaacacctgtcagtgttaggtttagccattcaagtggagttgtaatggtatctcagtgtggtttcagctttcatctctctgctgactcatgatgttgagcaagaaaggaacatcttttcttgtatttattggaatcctggatgatgttcaccattatcatgtgcttactgactgggtattttttgtagtgtcctttaaaaatcatattttgtcccttttaccccttaaaaattgtttttgggttcttctccttattgagctttaggagctcctcatgtcttctgggtacaagttctttcttagatatgtgtgaggtatgagtgttttctttcagtctttgccttgcctttaaattttctcagtgatatcctttgaagaacagatttaaaaaaatttgatggactataactttttatggtttgtgcttttggtagcttgagaaatcaaccttaaaactagtgacatttgacctgggtaattttttgtttggagggctatcctgggcattgtaggatgtcagccagcattcctggcctctactcactagatgctaagactatactctaccactccccctcccccagtggtaacaaataaaaatgtctccaggcatatcaaaggccctggaggggagggggcaaaatcacatccaattgagaaccactggcctaccccaaggtctcaaagattttctcctgtctctgcctctagaagttttttggttttaactttgattccttaactctaggatcaatttttgtggtttaatttttatatatgatgtttgaagaaaactcaaaccatatttttcctttgctctcattccatgaacagtcatcaacacagaagacctccgtaatcaaatgtgtggtcgtttttccccaggcaccaagcagtgacccctggccaattcaattcctgaccctgtctacctggagatagtgtcagatgccacaggtttggggctcagttcccgagaccgctccccaccccacaccagtcacaagtccgggcctctggaacttctgaccaactggcttcaatttggggttcccagagtgcctctttgggtctgattaatttgctagagtgacttacagaactcaggaaaacactgatgattagcagtttatgaggatattacaagggatacggatgaagagatgtttagggcgaggtattggggaaggggtgcggagcctctgtgacctccctggctcactaccctccaggaattgccgtgcattcaactatttggaagctcccccaacccagtttttatggaagcttcaggaggtcagcatttcttctcccgggtatagggtgggaccctcactggggaggatcttaagacccacagtccaaaagcagggaagatgagagtcctaccttggggcaggtggaaggaggggcaggtggagagattgtttcctgaggcctgacacacccaacattataacaaaagaccaatactaggactgtggaagttggcagccagaaaccagatgggaaaaaaaaacccatacatgtattatatatatttatatatatatatatataaagtatatgtattgtgtatatattatataagcatatttattatatatatattatagtgtatattatatatgtattatatataatatataatatatagttatatataatatatacacacgcacatatataaataacaccacaaaaagggtaaaagtttatttatttccatgaatatatctagttctgtttactaatactttatgaaatatgcttacagctctgtttttaagtgagattgggctacagtttttttgctctgctgttcttgatggattttgttattaataatatgtttgctttgtggaaggagctagttagcttttagtatttttgtatgtggtgaaacagtttgtatataagatggacattttctgtttcttaaagtttggtagaattcaccagtaaaactatctggccctggcaggctcttaggtggaatatcatcggggaggacttttgattatggttttttctagttttattttcagttttatctagtttatttttctattcagattttctactttttcttgggccaattttggtaatctctattttcctagaaaattgtcattttaattgtgtattcatatttaataagtagcatgctactctcatatttttgatactctatagctctaggtaaatttttaaaattcctgatgtttacttgtgtacttttttcttaattatatttactaaagacttatttacctttttaaagtctttccaaaagaactagtgttttgttttttcatcttttcaccttttatttgcaattttattaatttatccactcagtaacttctacatcatttttctgtttctcgtttgacttgaatgcttagctcttttattttaaatcattttgcataattaagaaatatatttaaagcttcatgtttctttcttcggagtaccataccactcatagattctgatacttttttttttctccatatttcaattttgtgtattccctttttggattcaaaagttctatctgtttcaacttcctggacccactaaatttttagatttttatttttttcaggtccatggactttgggggttttaaatttattttttccattgtgcgggtaaatgtggtggaacttactgacatttcccttgtggcctaacacctagtcaagttgggagggtattatgtgtttggaaaaaaagttctctgtttgggtcaaagttactcatggtgctgttcagcttttctttgccctaactcttcttcggtttgtctgttgcttttattatttgtatctggctgccgctgtggacaggcatgtagctggatgtcgtttgctgctgtcgcccagcttaccagttctcccatggttcagatgttcttctgcttccctgttgtcttttgttgcagaatctcagctgatgtgtagtcacagctgcctgttctttctgcgtggacgctgtagcttctgtcaaccctctgaagatctctcttaaagttctgctctgattgctctattaattatttttccttgggcccagtttctttggtttgagtttgtcaccatgattgcatggtgctggtgcccttgcagtgacaggtgactcctgaccgtgcactctgcagtgggtctccacccgaccttggctgcctccttgtgcagctgcgtggggtagggctgggagcagttgttggaatttggctgtaaattgttttcagggagactaggggatgggcaggatgtgcctctgtggctgttcttggcgctttaggtcctttccaccctcccaatgtcacccccaagcgctgttctgccaagacacagctgctaaacccctgttgattgctgctggcagcgtgtggcctgagacgggggatctggattgttgagttggctgtgtccaatcacttcttttctctggacctcattttcctcctcaagaggggtgggacttagttttctttctctctttcctatttgaaaacctctcattagggagttagttttggaagtcactttcctgggcttgaatccagactcctcccctcacaggccttgggcaagtcacagaacctctgaagtcttcctttccgtgtgtgtccagtcaggatgctaaccatgtttgtaggctaggcgtgggatgctaaccgtgttgtaggctaggcgtgggatgctaaccgtgttgtaggctaggcgtgggatgctaaccgtgttgtaggctaggcgtgggatgctaaccgtgttgtaggctaggtgtgggaattggaagacatttgaatgcctggcacgtcctcggtgttcattggtgctgtagtggtagcagttgctttatctgtaagttacagatgctgccttacatcagggatttatttttataacctgtttctcgccctcccagagctctccattagtgtcttggggtttctgcctcaaccagagagcatttcttcttcatctgtttcatgattggcactccacgtaagcttcctcatgagaaagaaaggtttccactgtttaaaaaagtttcaaagccactggactccgtgatttccgggtccattttgcatcccaaattctgcagttctgaggtttgcagccttgaggagtccttcctcactcagattcccccaaacaatgaggagcttgataattcgaggtgtggagtttggatgggggccgggggtcaccctcctgcatgtggtggcttggtcccaggctaggctgggagaaagggggctgtcgtggttccagggcaagaagagccgtcctccctgtttccctgtggtaggatcaggaagtctcagctaacttctgcacatggtcaagggggtcctgtcctcacttaggcctctccaggcctccctggagggtggaggaatgggtgctgttgtaggtgggaacagaagtgtccaggccagtggcttggatgtgaaagtgcttcataaattccaccttgctgtgcaacttaaaaaaaaaaagtacggtcgtttaggttttcgaggtgcccaaagcaatgcgtcataagcctatttttgtctccgtgttagccagggcagaggggcactttcctgtgactcctccagggtggggaaaatcccaggtgctctgtgaacctggccgttcagccagctgcagacctttggtaggagttttctttttccttttgtgtgcttttcgatcccctgggggcaaccattattcagtacatctggagggcaagttgtccaggaagaggaagcagatcctaggagtgtcgtccttcactgggagaggtgtaggaagtgagggggatggtggaagtactggcccgagctctgttttcaggagtgtgtgacagcaaaaactggcctttgcagttgagttgcctgtgggctatggcctagagggaaggccaggagggtcttgctgttagggctgccaccttcttcatgcctgctgtgtgctgggaggagagagctccttcagagcggacccaccattggattttgagtgtgtgcaaaattaacttgttgctatctgcatggttatctgtactccagaatcagttatacattttaaaacagctgtttagtactgaaaaaactcccccaacactccctgcgccccaccctggcctgcaaatagagtgccaagccaccagaatagaagtgctaaagtagtgagtttcctagaagtggcaagcctgagactccagtgagtcaccctcattgttcccctgaggcaccctgcctccacctgctctctgctctcgaagcgtcagttataccagcacttctctcttctcttttgtctctttttacagtcacccctttagagtgacaggcagcgtgagctcatggccttgactttgctggacatgcggagggagaggagagctggtggcagagtcgggggttgggccctgaggatggggctgttttattggagagtccgctgtcaccaggcctttctgtaaaaggctggaagtgagcgagtgaaccaggcaccctggtggggggcctgcatgtcagacccagcgggaagcatgtctgacttggttgagaggcagctaagggcccagtgtgtctgggtgggctgagccattgggagaatggagggaggggccagagagcacggaggattagctgtggccagatcacagaggctgtgggactttgggctccctctgggtaaaagccagagcccttgaggacttcagtagattggtggattgaaaggcacatgggccggtgctgtggctcatgcctgtaatcccagcactttgggaggccgaggcgggtggatcacgaggtcaggagatcgagaccacggtgaaaccctgtctctactaaaaatacaaaaaatcttagatgggcgcggtggcgggcgcctgtagtcccagctactcgggaggctgtggcaggagaatggtgtgaacccgggaggcggagcttgcagtgagctgagatcgcaccgctgcactccagcctgggcaacacagtgagactccgtctcaaaaaagaaagaaagaaagaaagaaagaaagaaagaaagaaagaaagaaagaaagaaaggtacatggaagattcgattgcttggattgccttagggaactatgagatccctaggtgagggttgcagttgagcatggtagctgcttttcctcttcaggttgcctttaggctgcgatggagatagcatgagctctggagcaggacaggcttctttctaacatgggcttggccactttgtgaatttgtgatcagagacaaggtcacggacctcactgggacctccctaggctgtccattctgagtctgtaagaaggtggagaggggcagccccagctgggtgttaggctttgcggagcctctgctgtctgatgtttggctccagcatcttcaaagcaggggcttttctcctctgtccacctgattggcctttgtgaggaaccaccacctggcggtggcctcattagcatcatgggccagccagctgagctgacagcccgcaggttttctagaaaggcccaccttcccttgtagtttgcacactccaggaagggccctgggtctgggagggttttctgggaccttggtgacagggagagtagggggctgaacattaaggtctgaattctgcgctgggggctggattgtccttaaaggcggttggcctcagacatccacatggcaaagcagggagtttagcccatctacaactcttctttatacatgaggagcaaagtatgagaccgcccaggtaattgctctgattggaagaaaatcatcacggagcagggtttagggttgaaatactggcctgcatcctgtactgttgagttgatctgagccaaggatagcagagaggaccagccatttttgtggtagctttctgttgtggagggcacttgcccacctcctgggaacgccacaccctggtgtgtttgcccttgttctgtttcccctgctgctcttctgctggaagctctggactcacctgtctctgttgtggatggtgcagggcgggcaggccagagtggcatccttgtcctgagaggtcccaggaggcagttgagtgtgtatgtgtgcgtgagtgcgtgtgtgagtgcacgagtgtgtgagtgcaagtgtgtgtgtctgagtgtctgtgagtgcaagtgtgtgtgtctgagtgtgtgtgtgtgagtgtgtttgtctgagtgcgtgtgtctctgtcttcatcagctcctaggagatgcctccggacaggggcctgcccgtctctccctccagttccttgccagtgtcatgtgacactcctttcagagggcaccccccgcccccagccaactcacctttttttgtaaacttagtttttaagcagtccaactctctctctggattcaaatgaaagctttagatcatagtctgtttcgatagctctgtgttcctggtggtggttttctcctcacaatgaccttgtaggctagctgagttttgtcgaggaagttgagctgggagagactggctcacacagcttgttagtcagcgctggggcaggaatctggcccaggcccttcatggcacctttcttagggtagcgtgccccctctctattccaggtgacctctgttacgcagtccccattgcctgccctggttccctgggctctgacatcaacttagatgtcgtgtttgacttagggcttccagccggatccctctccatacaccgggcttccttccagaccctgcatacctctcagggaaaaccaaaggctgacgtttggcatttccctgcttctatttatttgtatttgtcggccctgtatctttgtccacagctttgtgggtttgttagaataggaagtgaagtacttcctatataagctctggccatgctgtgtcaaactcacgtgcttccccagccttcagctcggggtaggagtcttcatgcaaatcagattgtttctcttttagtgtaggcaacagcaagttgttgacgacagtggttaccttaggctcttgacattctgctcccaaggtccagtgtgggaaccctgcctccttgctcctcttccttgctgttttttccctttctccttagttaaggagactggtctggatttctgaaggtgactgtgctggatatgtatgagctgaaacactgtctgatactgttgagggacagtagtgagccaggtgatttcttgaatactctgttagaggacttgcgtgcatgtcgaaagtaggagaatcttttttggatgttcaggttggaaacacttcacattctctttgtctccaacatgttagatttgttgcttgctgtagactcagagaaacatttctctagctagtgaccatgtatcttgttatgtgaatttcacttatgtgtcaccaactgggtttctgtcttttaaggaaaccaaattacagattcacacgtgcctacttttattattactgatcccatcctgcctttatcttgctttattaattgcaggccagtagtaaaatgtttaatagttacatgaccattagcataaccccaagattcacagggactgaggaaactaagatatattttaaaagagtttggatatatggcaataaatgaggaagggacagagtgatacttcatggagatgttttgtgttgaagggaaggaacccagttttctaagatttattttctttaagagattgagcataccatatattttgatcatagaattttacatactttagatgctagctgtttttaaaaggaaagaactccaaattacatcttgcaagctattgtggttttgcaagcattgagtgatggcatatatgaaaactctgagaggtgtcatattaagataccaatgtcagtttaaagatattctatatctgtatccctatgacattgtattttgaattttttatttttcatttttggacagacatttagaactcactcagtggagatggctctgcatctctgttttaagctttttgaactctaggcagctgtgtcggcctggggctacattgacttcttcattgcagcccctcgattggtttcgtctggaccagggtgggtttcgattgcggcccttgctggaacagtagcaggaaagtagaaacaccttcctgtctctgggttaaccagctgacagtctgttacttgtgtgcttccttctaattggtaatctgccaacacctttcaggatattatgaaatttcaagcaaatgaggttaaaatggaacctctgtacttctgaacaggcgtggactgactgcagttctccaggatagtttcagcagaagcagtgagattacagtcaggagcaaaacagtatctgagctttctttatgggaaagattccgactgtgtgcttggtttatatggttaaattaattgcccttgttaaattaaaaaaatagggtatgtttctgccacagactttgctttaaaagcagagatcttctaaagtcatttgccttgtatttgacttctgctgctccccgtttcctgctgggcctgatggtttgattgtagaatgtttctgagttgtgtcactgttggactctgctgagctgagtagtctcattaaaggagagtgtgcatctgagttgaggaagacaatatagatgtggaccttgtttgtagagttcacaagctgcttacatagaaatagcaaggacagtgcagccagtgggaaggagccggctgagggacttgatattatttccatggaaaccagttgggtatgggaagagaggttgtggaaggcaatgctctggtgtttggcaattcacactgtgcagaagagaaagcagaactggactgggagtatagagtagcagaagtttaagcttggggaagaagttgagcaaggaaaagcatatgatctgttgatcagcatgatgtgatgtggtctgaatcttcagacagttcacagctttttcatagaggctgtcctcagatgggttcaaccattctgagaattctgcctttacgatataagtagtatccatgacattaaaaacgagaagagaagcgttttggccaatgacggactgcataaactacagtctgcataaatgaccttggtcctagaagattaggatgaagctgaacaattcttatcacctagtgatgctgtagccattgtaatgtcgtagcacaatgcattagtcacatgtttgtggtaatactgctgtaaacgaacccactgcgctaccagtcttatgaaagcgtccagtcaggtcctaggcctttaggtccactcactcactgactcacccagagccgcttccagtcctgcaggctccattcattataagtgccctaggcaagtgtgccattttaatcctttataccatatctttgctgcaccttttctacgtttagatatgtgtcacatgttacagttgcctggggtattcagtgcagcgtcatgctgtgtgggtttgtagcctgggaacaataggacataccatatagcctaggtttgtagtaggcgacaccatctatgtgtgtgcagatacactcgatgatgtttgagcagtgacagaattgcctcatgacacatttctgatgacgtatcgccattaagtgagtgactataaaccagtccccccatcagcagttacacttcctgaggtttcagttacccatggtcacttgcagtctgaaaatatgaagatattttgagagagagatgccacattcacataccttttattacagttataattgtgctattttattattagttgttaatcttttacaactaatttataaattaaacttaatcatgggtatgtatgtaaaggaaaaaccatatccgaaaccgtattcctggttccaggcctctactgggggtcttgtatctgtgattacaaggtgctgcgaagggataactgtaatttttctatatgactagcattttattgaatcaagttgtgtagatggttggcaatataataggaactcagagatctttatgccatacagagtctgtccttttaatggcatttattgtgacaagatttaaactaaagttttgtggaatgttttgccagtttttgtgttgtaactgaaactaaatgttttctgaaaagttaaaaccatttctttaaatggaaaataaatgaagccgtttacctaattggttaaggactcacccgtgggcctcacaccgcctaggttaattcttcactttataattccgtgatgttgggcaagttcctcattctgagccttgggatatttggcttcaaagctgaggaacttgggagggttggataatggcatcacgttctgtggggagatttggctcacatgttagctgtgtgggtgagagccgtgctgtcatgcgttcttagccactggccagtttccttctcaagccatcagtagagatgctgatcctgcatctgccagtcattgctccaggagggaagacattactgtcccagagtgacggtgtcattggggataacagacacttcagaaaatgccaccactgagctgtatgaagtgccatggcagctagtgctggagctgtggattcagccggggagcactgtctggaggagctgctgcagcacatgtgtgtctctccagctgtcaggctggcctttggagtgcatttggattttttgagaatgagagagggaccattggctaactgttttacgctctgaaaaatgacatagaatagcaaagattttacttatttttgctgattttctagaacattttctgtcccagagtgatggttttgaagaaccagcgttcttggaaagatggttttgcatccagaagagtgattttaactaaaatcaggctgcctcccttgaggatggtcactgaattttgtacaactgggacaacggacagggatcctgggttgtttccagtggacaagccgcttctgtgggggcctttgcagttctccccgctcctctcctgtgtcccgctggtttccttcagttgagatggaatacagcatagagtcagtgacttttagaagacttgacagagtttcaggaaaatgctcactgggctttcttacctatcctgctgcagaactttttttttttttttttgagatggagtctcactctgtcacccagtctggagtgcagtggtgcgatctcggctcactgcaacctccacctcctggattcaagctattctcgtgcctcagcctcccgagtagttgggactataagcgtgcgcgaccatgcctggctaatttttgtgtgtgtgtgtgtgtgtgtgtgtgtgttttttttttttttttaagtagattcagggtttcaccatgttggccaggctggtctcgaactcctgacctcaagtgatcctcccaccttggcctcccaaagtgctgtgattacaggcatgtgccactgcgcatggcctgaagttctttctttcagaaaatgtattcaacacattcttttgtgtgtgtttgagtgaagacggtgtttccacacagcttgcagatactttcttccagaagcttgtttgttgctaacatttaacatcttactgttacagcttagttttctctttgattgaatatattgatctctttttttttttttctgttggcttttttcttaagtctttacttgtgtaagctcagataacttagtctagaatgtaggctttttctgggaatctcagctgaatggtttcatttgcttggctgttaaatgaaccatactgtttggaatagtttcctaattctggctgtacatgttcacttcaggtagagaattttctaacagacaaactttcagacaaaaaatttattattcctcaaagatatcattacattttatttagtctgtaataattttattgcttctgaaaccattttctagttctataatgtgatcatggtgcttttaaactttaatatcaagttaattttaagaatgattttagcttaggccattctaggggcttggcctttaatctgaaaagaaatttagaatcctttagtttcaaacatgtgatttcttaaaacttgttgtcagttatttatacgattttcaagtttattatgaaatagtctttaaaaaatatttactttagtggaaacatatctagtgatagtttaaccagggtgcataccagagtacataatagtttttggaatattcttcataaattttcagagagattatttaaaccacatgactgtttctgagctcctgttgatactaggggctaggcatattcgttttttctttttgagacagagtctcgctgtgttgcccaggctggagtgcagtggcacaatctcagctcactgcaacctctacctcccaggttcaagcgatactcctgcctcagcctccctagtagctgggactataggcgtgcaccaccacgcccggctaatttttgtatttttagtagagacggagtttcaccatactggtcaggctgatcttgatctcctgacctcgtgatctgcatgcctcagcctcccaaagtgctgggattacaggcatgaggcaccacgccctgccattagtttgttttaaaggagacataatgtccgttgaaacatcagaatgttttaagtactgacagcttgcaggtgtctttggagtgaagtttagaaacctgctgtgaccattcttcattttaaagctgtgactaagaactctgagatattggtgccttcgcctcaagtgctgctgatgggtttgaatggcattgaggttgccaggcctggaggagggctgccttgtgctgagtggttaaatcacccccctgaaaaaagtcagtgtttcaagtattttaataggctcctcctttcctactcccataaccacttacatttgataaatcttgacaaaacaagtatgaaatccaagtagagaaaataatataattgaatagagcaacacttttctttctagcaaccctgatttccagattatcaggacaatatccctcattttattcttttttaaatcttgattctgctccccaagcaaacacactctttaccttatttagatatcccctttgcaagaatggtggatttcttttaagaaaagcatagcaggccgggcgcggtggctcacgcctgtaatcccagcactttgggaagctgaggcaggcggatcacgagatcaggagattaagaccatcctggctaacatggtgaaaccctatctctactaaaaatacaaaacattagctgggtgtggtggtgggtgcctgtagtgccagctacgggaggctgaggcaggagaatggcgtgaacccgggaggtggagcttgcaatgagcggagattgcgccactgcactccagcctgggcgacagagtgagactccgtctcaaaaaaaaaaaaaaaaaaaaaaaagaaaagcatagcattttaggtacgtgtggatctctttagcgttgattcctaccagttaactcattttaaatgacaccctcatgcaccaatatcatatacttaggattgtgaaatagtttaatgatgccactgccgctacttgaagtttgtctctgttatcctggagaaactagtcatggctcctgaataagagattagcatttttcctgagtagtagccaagtctttgtttacttgtttatcttgtatcctgcaacctggaatatacactccgagagggcagggcgtctttgttttgttcattgctgtactctcctgtgcctcccgcagtaagtacttaagaaatacttgtgaaacacatgaataaaggttaacgaagggcaaaggaaacaagcctttattgatgatttttctctgtgcccagtaatacttgggttattttctcatgtccttgagtcatcttgactctaggagacacctcttaacatgttcctgctgaaaaagctgagctgaggagtcataccccgagggtatcaccctaagattgggcacctgagtaccccagcctgctcttcaggtctgtagctgcttagtggctatcagaccttccaagtctccatgcttttgaaggcctatgtgtgcggtttggtttcttggcaggggggtttgatgggttcccagacctaggagttcttggcgcctcgtcttccagtgaccccaccagggctgctctttctcctccattgctgaaactagttcagggttggggaggagggcacgtgggggggcctggtggttggttttgtgctgagtcattgccttggtgcactgtggaaggaagctctgggaggtggacggctccttctgtgagggagtgcttctgtcgtcaagggagtactgcatagggtgaataacacagttatgtagatatatatggtggtcttacccccagggcctccacaactcctggatgggcctagcctaagcaattctgatttaacttattgcccctccttttagcaatactgttgagttaaataacagtttttgcattgaaaataaaaaaattttatttttgtagagatgggatcttggtatgttgcccaggctggcctgaaactgctggcttcaagtgatcctctggccttcgcctcccaaagtgctgggatacaggcacgagccactggccaggtctttattttttgcattttgcaaggacattttaagtcactttcttccttttctgtttttactcctgctgaggagatgatccccattttacaaaatggacaaaacattctccccagggaagggaagagtagacatttgagaataattgttttcacagaaccgggaaaccacctattttgtcccaagtatactgattgatgcattagcaataactcactatctgctttgccagaggtttgaacaatgagtgttaatgcttggtgtagtgaattttgtgtgatttcgaatctgatagctgactcattgcacagctctgtcttgcgagttcagatctgaactgtagctctaagaggtaaaagcagaagtggagctgcctttcatgccatagctagttttttaataaaatagagttaaaaaatcctttggcttttcagcattttggtgtgattggaaaggctattactatcttatattcagcatgagtcttgagcaattactgattaatatgatttggctgtgtctccacccaaatctcagcttgtagttcccataatccccatgtgttgtgggagggacctggtgggaggcaattgaatcatgggggcggttacccttatgctgttctcgtggtcatgagtgagttctcacgagatctgatggttttataaggggctttttccccttttgctccgcacttctccttgctgaaaaagaatgtgtttgcttccccttctgtcacgattgtaagtttcttgaggcctccctagccatgcttaactatgagtcaattaaacctctttcctttataaattacccagtcttgagtatgtctttattagcagtgtgagaacagactaatacactgatctgagttgatattcttaaattaatggtaagatatttcttttttttttttctttggagacagagtctcgcactgttgaccgagctggagtgcagtggcacgatctcggctcactgcaacctccgtctcccaggttgaagcagttctcctgcctcaccctcctaggtagctgtaattataggcgtgtgccaccacgcccagctaatttttgtatttttagtagagatggggtttcattatgttggccaggctggtcttgaacgcctgacctcgtgatccacccacctcggcctcccaaagtgctgggattacagacgtgagccaccatgcccagccagatacttctattttgataatctttgagtcctgaggtagcttcagaatggattgaaccacagacagatggtgttagtagtttctgccctggcttctttgcaacttaacatacttgactttttagtgtttttggctaaggaaagtgtattttctagtttgtggcagttttaagcaaatgtggcttgaataaaactagagagaagtttaatttttgataaatcagtgacattgacaagttgtttttcttcctttccagttatacatgggaagctgttgataccaaaaataatgtactttataaaatcaacatctgtggaagtgtggatattgtccagtgcgggccatcaagtgctgtttgtatgcacgacttgaagacacgcacttatcattcagtgggtaagtagaactacctgaaattactggattggcaatatgattccccaattttgcaaaaatgactgtgtatagctatacgtatatagcgatacaaaaattttgaatgtttagaaatcataagtgtttataatacataatacacatttgttagtagttaaaaatgctaacggtttgaatgtctagtatgagctaaaactaggttggttctgtctagtggatactatacagacagctgttatgaagaattatgtagatgtgtatttgatattgaaagctgtctcctagatggctctcccttctcacccacacttttcttaaaccctgtttttacattctcccccagcccacatttccttttagtgctcccccgactcccattcctttgtaccttccagctttggctgtagttcccagacagtgtttctgctgtcaaagatggtcactggagttaggcttacattaaaggttaaataaatagtcctgaggattggcagtctcagagaaagaggtgcagccccttctttcctagggttcgtttcattccccaaatgtatgccttttgggtcaggatcgctatccttctgtgaagaatatgaatccaagtggattaatatatcagcaccaggttacatagagtggagtcagggcagatgcctgaaggaagggaggcagggcagacagaaaagcagaatgcattgcccttggatttggcaacatggatgtccgtggtgacctttcactaaggcagttagaataatgaggtttgaccacaatggatgctcgtgacatagagatggtatatgactagggactgtctgataactagaagaagatgctaggtgggcttttggatttgggagagaagcttactgtggtagctctgtcattttcttttgtgttttaaacattttaatatttttatagatttggcagttcaagtgcagtttgttacatggatatattgcatagttgtaaatctgggtttttaatacccgtcacccgaatagtgtacattatacccagtagataatttctaattcctcaccccccaacctttctgagtctccagtgtctgttattccactgtccgtgtccatgtgtacctattatttagtttctacttataagtgagaacatgtggtatttggtgttctctttctgagttattttacttaggataatgtgctattgttcaattcatgttgctgcaaaacatgtgatttcattcttttttatggccaacatgtggaatttgtccatagaaaagaatgaaatcacacacacacacacacacacacacacacacaaacacacaccacattttttgttatccagtcatccattgatggacacttaggtttattccatatctttgcaattatggatagtgctgtgataaacatatgagtgcaggtgtctttctgatgatttttttccttcaagtatatattcagtagtgggattgctggatggaatggtagttctatttttagttccttgatagatctctatactgttttccatagaggacatcctaatttacattcccaccagtgtatgtaagcattcccgtttttctacgttcttgccaacatcttttgctttttgactttttaataattgccattccagtgggtataagatggtgtctcatggttttaatttgcctttctctgatgattagggatgtggaacatttttacatatgcttgttggccatttgtatgtctttagagaaatgtctgttcatgtcctttgccctctttttaaaggggttctttttttctttttgaattgtttgagttccttgtagattctggatgttagtcctttgtcagatgcacagtttgcaaatattttcacccattctgtaggttttctgtttactctgctgtgcagaagctttttagtttaattaaatcttacttggctatttttgttttgttgcatttgcttttgaggttttagttatgaaatctttgtctaggccaatgtccaggagagtgtttcctgggttttgttctagaatattcatagtttcagatcttacatttaagtctccaacttttgtatatggtgagagatagggttctagtttcattcttctgcatgtggctgtccagttttcccagcaccgtttattgaatagggtgtcccttcgccagtgttatgtttttgtcaactttgtcaaagatcagttggttttaagtatgtggccctgactctgggttctctattctgttccattgatctgtgtgcctatttttatatcagtaccatgctgtttgattactatagccttcaggtataatttgaagtcaggtaacatgatgcctccagctttgttctttttgtttaggattgcttttgctattcaggctttggctactcatatggttccatatgaattttaggattgtttttctaattctgtgaaaaatgacattggtactttgataagaattgcactgaatctgcagattgctttgggcattatggtcatgttaacaatactaattcttctaggccatgatttttgcatctgtgttcattagggatattggcctatagttttccttttttgttgtgtccttgccttgctttggtgttagggtgttactggcttcatagaacaagttagggaggattccctccaacttgatttttttttttttttttttttttttcagggagtagtctcagtgggattggtaccagttctttgtacctttggtagaatttggctctcaatctgtctggtcctgtgctttttcttgggagatttttaaagtactgattcaatctcactcctttttactggtcttttcaggatttctgtttcttccgattcaatcttgggaggttgtatgtttccaggaatgtatccatttcctctaggttttctagtttttgagtgtagagatgtttatagtagcctctgatgatcttttgtctttccatagtatcaatgtctactttttcatttctgattgtgcttatttgaattgtgtctcttctttttttggttaatttgagtagtagtccattgattatgttcatcttttcaaagaaccaactttgttttgttgatcctttgcattttttggggggggtctcaatttcgtttagttctgctctgatttttgttatttcttctgttaggtttcaatttggtttgttcttttttttttctagtgccatgagggttacattaggtcattaatttgtgatctttatttttgatgtaggcatttagtgctataaacttccctcttaccgctgctttgctgtatcccagaggttttggtccattgtgtctctatttatattcatttcaaaaaatttttacatttcatcctaactttgtcattgacccaaaggttattcaggagcaggttgtttaatgttcatgtatttgtgtagttttgagagttctcctcttggaattgatttctagttttattccgctgtgatctggaaagatagttgatatgatttcagtttttaaaaatgtactgagactgttctgtggcctaacatatggtctaccctggagactgttccatgtgctaagaggaatgtatgtcctgtggttgttgggtagaatgatctttaaatgtcttttaggtccatttaatcctgagtccaatttaagttcagtgttttattgttgattttctgtgttgatgatctttctagtgcttgtagtgaggtgttgaagtctctcattattattacattgctgtctatctcctcttaggtctagtggtaatgattttatgaatctgagtgctttggtgtggggtgcatttgtatttaggatggttatatcttgttgaattgatcccgttatcattatttaatggtcttttttttttcttttttaactattattgacttaaaagtctcttttatctaaatgttgcttctcccgctcacttttggtttctatttgcatggaatatcttttcctacctatttaccttgagtctttgtttttaccagttaggtggttttctgtaagcaacatatggttggatcatttttttttttaaatctagttcaccaatctatatcttttatgtaaaggatttaattcatttatgttcagagttaatattgatatgtgaggttttgttcctgtcatagtgttaattgttaactagttgctttttagtgtcaattgtataattattttataagatgtgagttttataccttttgtctgactgggttaattcaaacctgtctttaagctattagattctcttttctgctggtctagtctgctgttcaagctttcaactgtattttgtaattcctacaatgaatttttcatttctggaatttctgtctggttttctaaaaaatagctttctctagtaaaattttaatttagatcctatatttttccgatttctttgtgttggttttttgactttctcttggatcttattgcgcttctttaaaatcaatattttgaattccttagctggtatttcaaggatttcattttctttagggtccactgctggagagttagtgtgagtctttggggatgttgcagcgctcttttttttttttttttttttaatacttctagagttgttactctgtttcattctcatctggataaactatctcttctttatttttgaatttactttggcaggatttttttttttcccttgagaatgtgaatataacgtatgttgtatatagttgtttgacttcagttctgggtactttcagtgacagagactctgagtttcttggttatagttggcctttttgtggtagctttctcaaatgctagtgatagtaatgatgtgcttgggtgtgtgagcaggatcctcaccgtctcccgcggggcctggaaggcagagttctcaggaagttattttgttctcccttgctttgcactttggcagcagaatttatattgggttgtgcaggccagcaggtggtatttatgggtaaaaaccagctgcagtggaatccgatgggtgggtctatgagtctctgtgcttgacctttgtttaatgggggaagctctgttgcttcaggcagtggagtggtctgtggaatgcacagtggcctgagctacctgctcagcccctgagtgggggacaaagctggacagaactgaactgccagttcttctcttggatactccagtggctcaagcaccagccctaacaggggtagcaggggtagctgtgtagaaggtgccaaggtgtctgcggggaggtgtgggggttgctccagctccatggcctgggcaggtgggagcacaatctgcctccctgtcacaccccgtcctggcgctgggaatattcagaacatgagaatatcgctgtctgtctcaggctgcagtgtagtgagtgctacgagagacacctgtccatggcttaccaccaatgtgtcttctgtagtgagcctcctccctcaacccaaagcacacacatttgtagctctcctgctctttgccgcaggaatgctgtgggtccgtgtagagagggtgaggccccacctttcgtgcaagtcctggctcagtggaagtcgtgcaagtccactgccagtggaaatgcagcttcccctaacagccacagaatggccactgtcctgtgtgcctgtgccaacctgtgggagcagccatgactgtgcccacagcagtgggtagagggtgggggaggagaagtcctactacccacatccgtgcccaagcactgagaccacctggctcctgggctggaagcatactcctcccttgcagggctgagtacagcacccctgtctccactgcatgtggcacaggccacaagccatgctcctgggcacaggaaagtgcatgctcctttgtcccaaggagtgcccccttggcatgctgtactctttcttcccttaggagcagcactccctgagggtagatctctgggaaccctgcagctcccctgggtccagccagccctgtgtggctgctgcagtctcagcaggtgccaagaaaggtctgcagggcctctggtgatacggagacatcagtgctgagcttccccaggcagtcctcccactgctgccgccactgccacccaggtccagtggagggtgagcaacctggcataagtggtagtctgatgtaatgccctcaggaagtccccaaattgctgcccgcaccagtgtttgggtttgtgagggcagaaaagctctcccacagttcgggtaccagcagtcgaccacagaggtgaggggcagcaacagcattcccgccacccctttcaaaggaataccaagtccctcagggctcctagccgctctctgcccctctcgtttcctgctttttattttttgccctcgtttcatcccaggggttctccaccaggctccagtgctctccacttgatactccattctggcgacggttgctcacctgtaacttgggttcttctgagaaccggcctctggcaactctgttcagctgtcttgaaacaaaagaaacccccacttgtcattttgcatggaaattgctaaacacagttaaaagagctttgtagaaagcagtgtttagagtacgaagataagggagtgcgaggtctgctgattgaggcccagctcctgtttgatttccctctctctctacaaagagaccatccagactgaaaaacctggtgagagggatttgaggcctgggattgagatctgagaaagcactagattgttgtgaattcttgggtctgacattatccttggtgatatacttaggaaacttacaggtgagatggccagtttactcattgtgctcttttgagaactcacagagaaaggccacaagtaattctgttggccagtgttatgtaggtgttcagaaagaaggaaaagtagctttcttcttgattttattataatacttcaatatttttggctaatgaaagtatgtcttgagtttatggtagtatagtatggtatggtatagtgtaataccacatagactgatgccagatggaggcaacttacttgaaggataatttgtgagcttggcctcactggacaaagtttgagtttgaccaagttctgtggaccttgaaagccagggaggagaagagttgttatttttttgtagggagtggatccattacagatcttttgtgatggtaacggggaggtgatgtgatggaaggtgtttttaggaagctggccccgtggaataggaaacgatgcctacaggggagataccaaagataactagatgactaaaaagtaacttacaggttaagatgatgatgatactattataaaccagcagtttccaatctcattttttcccccagatatgtgtgacagatccctttcccagagcttgaaacttccagagggagtcatcatatatactttcaggactctcagtaacggctccctttcttcaactggagagagcagtttgtatgagtcaatgagagtgacattcacagtagcatagggataatcccgaatcaaatctaatttgcatatacaataaaaatacctaaattttgttgcacattcatgtgctaggcctaatgtttaaaagtaaaatatctcatttaattcattcaacaaccctttaaagtaggtgatttcatttccctcatgttataaatgaagaaatggaagcgcaaaatggatctgtgttctacagtgggcaggtctgtgcaaatctgcccccgaagtccaaggaagttgagaggctgaagaaggaggctgacacccagtttctcagaaagaaacatttaatacggacttatgaatagaagccacatctcaagaagtcacgagatgggatggatccctctgccatcacccactccagacccagggatcatacaccatagggaaggggtggttcagaaggaatgtgtaggacaattgaagtaggttttttgacctaaggggaggattcgtgataattacctgctcttacacaaggaacagtagataaactggaaatcttggaggccttcctggaactggggttaatcggaagtcagcagggctgtttggcctccagaatggcgttactttagcctccacaatgagcaccttgctggaggtggtgtggttatggatttgaatgtggacagccggctccagagcctgtgtactcactcagggctgtgcttttgtgtgagtcatggggtcacatcagacagattggagctgaaatggagaccaggatgggagatctgaatgtgtggctctgagaggacatctgagaacgaacttcttttgatcttgttagaaaggaaaaaatgtgaaccttcaaaacaaccacaagaactggagctccccgcagatcagaggaacagaagagctagcatagaaatagatccaaatatgtatgggaacttaagataacttacaaccaaaaaattgggtgtaagtagctattgtctcttacgaaacaaagttcaatccctcctttagatcacatactgaaattacagctcagttaagatttgaaagtaaaaagacaatagaacattggaaaaaaaattagtaacatatagatataatctagaagagccttccttaaggaatcctggaagccatacaggagaagaggaacatttcttattacataccttttaatgactaaaaggtgttctaaagacaaaagacatacactagactgggaaaaacatttccagcatgtttgccaatgtactattaggatgagagcttttcttaaaaattggtaagaaagacagacacccaggagaaaaatggcaaagtcaaagaacaggtaattcacaaaagaagaaatccagatgctcaatacaacttcactaataagccaggtggattagtcctttctcacattgctgtaaagaactacctgatacttggtaatttatgaaggagagaggttggattcacagttctgaaggctgtgtaggaagcatggctggggaggcctcaggaaacttaaaatcatggcagcaggtgaaggggaagcaggcagcttcttcacatggtgacaggagaggagtggggcggtgctacacactttcaaacaagcacatctagtgagaactcttatcacgagacagcacttggggatggtgctacaccattggaaaccagccccgtgatccagttacctcccaccaggccccacctccaacactcgggatcacaattcatcatgagatttgggtggcgagacagagctaagccgcatcaccaggtataaatgcaaatcagagcaattatgagatctcatttttctttgagaagttggcagaaatttaaatggttgaatcatagagtgctggcaaggagcctggaaatgggcacatttatttatacgttgctgtaggaagacggttgtctctaaatccttttgggaagataatagttggtgtgaggttgtttttttttttttttttttttttttgagacagaatcttgctctgttgcccaggccggagtgcagtggcgccatcttggctcactgcatcctccgccccctgggtttaagcgattctcctgcttcagcctcctgagtagcttggattacgggcaccaccatgtccggctaattttttttttgtatttttagtagagatggggtttcaccatgttggccaggctggtcttgaactcctgacctcaagtgatccacccgccttggccccccaaagtgctgggattacaggtgtgagccaccacgcctggcctggtatgagttttaaagtgccctgaagcaggggtcctcaacccccgggccacagactggtagcggtttgtagcctgttaggagctgggctgcacagcaggaggtgagtggtgggtgacagagtgaagcttcgtctgtatttacagccgctccccattgcttgcactactgcctgagctctgcatcctgttagataagtggcagcagtagatgcttataggagcgcgaaccctattgtgaactgcacatgcaagggatctaggttgtgaccccttatgagaatctagtgcctgatgatttgtcagtgtctcccatcacccccagatgggaccatctagttgcatgaaaacaagctcggggcttccactgattctgcactgtggtgtgttgtataattatttcaattacatattacaatgtaataataatagaaataaagggtacaataaatgtaatatgcttgaatcatcccgaaaccatcccacccccagtccaagtccatggaaaaactgtctttcatgaaaccagtctctggtgccaacaaggttgggggctgctgccctaaaattttttatagtgagaaacaaatattaagacctcaatgctggtttaaacaatattacattattttaaattgaggaatcatacattatccacacatccaaggagctcagaagaaattaaaaaaatcatacattagtttttccttaggcaaacaatattacatatgtgaatcttagcaaatgttagccatcattttcatagggcctgtgaacaatatttggtcccatttgcaacctaattattttcacattttaaagtggtttatacattttatatgcatttgacccttgaacaacgctagagttaggggcaccaaccccctgcacagttgaaaatccacatttaacatttcactccctctaaccttagctgctaatagcctgctgttgatgggaagctttaccagaaacataaatagtcgatcaacacatattttgcatgttatatgtattaagtactatattcttacaataaagtaagctaaaggaaagaaaatattaagaaaatcaggccgggtgtggtggctcacacctgtaatcacagcactttgggaggctgaggtgggaggatcacttgagcccagaagtttgagaccagcttggacaacatagtggaaccccatctctgcaaaaaataaaaaaattagccaggcatggtggtgcatgcctgtagtcccaactacttgggaggctgaggcaggaggattgcttgagcccaggaggtggaggcctcaatgagctgtaatcaggccactgtactcctgcctaggtaagagagtagtgagagcttgtctcaggaaaaaacaaatgataaggaagagaaaattatgtttattattcattgagcggcagtggatcatcatataaagatcttcgtccttattgtcttcatgttgcgtaggctgagtaggaggaggaagaggagggactggtcttgttgttctggggttaccgaggtgaaagaaaatctgtgtataagtggacctgggaagttcagacctttgcagttcaactgcatttgatttccttttcaagtacctcagatgtctggcttaacagttaaaatttcagtgtaacaataattataaatttatgagtattattatttaataattcttatatatttactagttatgctaaaattctaaaatttctaattctaaaattctcttaaatgttctaatactgtgtcgtaagtctgaattaattgctgagttataaactttggattggagttatattaaacattgcagtaaaaataccaaatacattcacatttttttctaacacatcaaatattaatattatgattttaattaatcttctgaggattacagctctatatccatttcaggaagcctgttaccagcccatttaacttgaggtaatgtactcactaaggaacagtgttaattgaggttacctctggagcctggaattctgtttggcttcttgttggtgacctggtaggacacagtgagtccgactgtagttgccgtcccaggtgattcatttactttaaagagcctggcccctgacttccagtgatttgatagtgtctgattcttgtatgcactcacagaaatctacagcaggcactggattgatcattggattgtatctttcatctctttgactcataagatgtgaaaatgccttttcctcttaagtcttttattttcttaaaacctagaattctgttggatatttaagatgatacctggttgagttttggatacaactcatgtttttatctgatttatggtctctcctgatagtctggcaatacctgttaacattttaaaacgtatattcacataatcttttgtgactcaaacggatagaagaagtagtactatatgtagatatttgtacaaaaggtttttggtagcattgtttattgtggcaaatatgctggaacaatctactgtgtgggtatggttcaataatttatagtgtattttcttcttatttacttggttaaatcatctaaaattatatgtgtacattatattaaaacatagccaacagttaatgtttatttataataactatttgactatcagtcatatgtaggcaccggtttaggtactggaattgaatcagtcactacaacaggcaagaatctctttttttcatggagcttacattttagtagggtgggagacagatgaaaaaagcaatggctaagtagtatgttaaactgtgatgactgctacagaaaaggaaaggaagggtaatcaggagtactgggggctcgggtgtgtgtgtgaggatattaaatagggtaagtgtcactgagaatgtgacacgtaagtaaagaccttgagttgagggagtgagctgtgtgtctctctgggggaacagccagttcaggggacaagaagggtagccaaggagtgtgttggtggtagcaagaaaataaaaatcttttaaaaagagtatccatataaatagagaagctggaggttaaaaaattggatgagtatttttttttttaatttggcaaaatagcgtgaatagtatatgttgaaggaaacgctaagtgggtggtgcaggggagagaggaagacttgcttgagcacatcgggaagtaggacaggaagggttctctgtttgccttgtaggttctaattgccatggcaataatataattgctgtggccgctgcggtaggcaggagggctgcctgtgaagtcaggatcaccaggctttgtggcttcaaggaggccaaatcaccatgggcttgcttgggcttggaggtgcgacctggtgggcctgcagaatgcgacttggtggcctgactgagcagcacgtgagggcctggtgcagcctggcatggtggtacccttgagagcgtggcctagagggctccgaggtgcagcctggccagtgtggtctggaggggtctggcaagcgctatctggagcactcagaggtgtggcctgtttttccgggtgggtctagtgagtgtagcttggagtgctgggtggtgtggcctggctggcaccgaggtccctgcggattctggagaacctcaaggtgcggccccgggggtgtggccaagtgtggtgtgtggagggcccttgtgtgcagcctggtggttcctgtgagcatggtttggagggcctggtgaatgtgtcctggtaggcctggtgagtgtgtgagcatggcctagagtgtcaccaaaccaaagtggacccgcctgcctgtgcaccagggaaagccaaacaccaaagcgcagggtttttgctggagagagtggactgcactgcgacgagacaggaggaaaggtcaaacctgtctccccaagctggcggctgggtcgggttttataagcataagcttattaccataaggtaatgaggtgtgttctgattggatcttgcaattagatgacaccagggctctatctgattggatcctggatcttgccatgtggtgtgcgcttcttatttcagtcccgctcctcagtccagcgcttaggttcctcccgtgttgcaagcttggttcatctgtgcaggctccggtgacatgatgtcgaactgggagccatggcagctgaaaaacaacgaacagctttgtacataaaagatgatacagcttggtctaatgtggttctaaggaggctctgccggcgagtcttaggggttccggcgggcagccgcgtgaacctggagcttggggtctgcagtgctgggaggccgaggcctggcatgttggggacaggtcttgggagctgactgggggcctggcgtggtggcggcagcccgcagtccctgcctggcccttgtctgggaggccgcggttctctgcggcctctcgccggtgtcgcccttggccactgggctgcgaggaagccggcgaggagtgggtgtgcgccccgcccggctctaccggcgagggatgcagtggccgccagcgtggccgtgcggctgggtcactcccttcccgcttccagggcctttttctgcctccttttcaggacgtgacccgcacattatgagggacccgtaggggctcttgacacagaggggtcaccctatgtgtgaacaggttacgaggttgggggcttggcttctgaacttgccaggaaacaccgcatcccttttcctgcagcggccgccccccatcccccacccgccccattctctcccctccccaactgcagccttccgcgcctccttggcccctcgagcctccctgggtcccctgcacctccccatgtcccccacgactcctaggcctctcgcgcttccccaggaccccgcgcatcctgggcctcttgcgcctccccggtcctcagcgcctcctcggccgccgtgcctccccgcaccttttgcgcctcatggggctcccggtgccttctgcccgccgcctcgccgcgcccctcgcctcctcatgcccctccgcgccccatacctccccacccctgtgcctctctgcctatcccctgtaccacccggcatcctccgtgccccatgcgcctcacccctcacgcctccctgtaccctgcatgccccgtgtgcctgctgtgccccacgcgcctcccccctcgcgcctccctgtaccctgcatgccctgtgcgcctgctgcgccccacgcgcctcccccctcgcgcctccccccttcgcgcctccctgtaccctgcataccccgtgagcctgctgcgccccatgcgccttccgcgtctccagccctcatgcgcctccagctgcgcatctccctaggcgggtacctcagcaccgctgagcccacccccgcccctgctcagtgcctcccagacacgcccactgcgggcgggacagtgggagctgtccaggcgcggagctgtccaggcgcgggagctgtccaggcgcgggagctgtccacgaggcactgaccttggtttcagagcctctgcagggcttctgtgtccttttggctgagccgactgggcaaaagttttagaaaagaccctgggtgttgcagatggagaaggatgatcgtggctgacttttgcttgcaggcagaagaaccacggggccatcagcctggtgctgtgggggcgcgctgactcgtggtccgcccctgccccaagacttcaggtgtatatgggattggatcagctatcatcccgagctcatggcacgtacagtgagccatgtgttaatccatagactaacctttttccttttaaaaaattagttgttttgtataatgtagcgagcactgtttccaacaaaaatctaggatcttggcagtaaccactatctgttttactctttcctctttcacttttcgctaggagtaatcattagctcccatcttgtattaatttttttttttttttactgtatctaatttccaaaaaaaaaaaatctgtgtgtttgcaactaagttatcttcctatgtgtaactttttgggacttaagtgataacagtaatattactaaaaatcaaccgtattgttgtttttcactgtggtttattccttctgactgctgtgatattttgtgtggatctgctgaagttaatttatccactcttctgttgatgggcctttggtcatttccaggtttttgctcttctgaagagcatgagatattctttcacattttctgctgtgcatgttccatatgtgcatggttttctcttttatatagacctgagtggagtaactaggtcatagggcacacgaatgttcaattttaggacataatgtcctgctgacttacatagttgttgaaccagttaacatttcactagcaatacaggagagctctgagccacctcatggctgacacttggtatttaatttttgccagagggatggttgtaaatggtataccattttggtcttgatttgaaattccttgatcaccagtaacattgaacatgtcttaacatatttattgatgtacatttttctttgatttgcttgatcatgtcttgttcattttatattgggttattgtgtgtgacctagattagaattttttcttttcattggatattaagatccaccattgtgtggctaggagtgggtttttccttctctctcctttccagcatggtgtgtgctttctcagtcagaggtaattcatcgtcctttatttcctggaattatacagacattcttttcttgtttgtttgcatgtgaatgtgtatgtagagattcttgatgctggttctttgccagttctgtgtttttcctagtttataacttacttccgttttctttaagctgttttttgatgagtataaactcttaaattgaataggtcaacctcattaatctttttgagtcttaagaaatctttctctatcttaagatttctgccaagttttgaagtttggattttgatgtttacatctttaatccatttagacaggggtgtccaatcttttggcttccctaggccacattggaagaataattatctttggccacctaaaatacactaatactcatgatacttaatgatctaaaaaaaatcacaaaaaagatctcataatgttttaagaaagtttacaagtttgtgttgggctgcattcaaagccattctgggctgtatgtggcccatgggccacgggttggacaagcttgtgtttagagttgatttttgtacccagtactgggtagggatccaattttgtctttttccatatggaaaactattttgtttccagttccgtttttatttccagttctgtttattgaacagcctcctcttttccctgacctattacttctgtcataatcaaagtttaattcacatttgtgtctctgtgctctctcttctagtcgattggtctctattctagtcttttgatcagtttattcctatgccaacccccatcatgttgatttttacatagactttttattctggactgttacagtaatgtcctggacaagcagagatgtggtcattctacttgtgggcctttctagagaatgttgattttgtagcatatgtgatgggaagtattgaaacatttcagtggctgagttatatatcctgatttgtatttttgaagatcacactggtgcaagatggatgaggaagtggggctggcgagggatgagactagtgtggaggcagggggagcagttaggtggccattgctggagcgcaggtagtggttttagcgggagtagaggtggagaaatgtggacagatttgagatgggcgtatagctgtggacctttctgatgtatagaatgcagcagacaaggtaaagatggcacttaatgtaatgtaatggggatgccactctgagatggaaaattctgggaaaggacagttttataaatttataagctatcagatacattataatgctacttttaatttgcttttccttggaaatagctgtttggttatgtatgttttatagcctgttcactctcttttctctccaaataggtgactctgttttgagaagtgcaaccagatctctcctggaattcaacacaacagtgagctgtgaccagcaaggcacaaatcacagagtccagagcagcattgccttcctgtgtgggaaaaccctggtgagtccacacaggcacttgatgtatttctttaaaaaaaaaaaggtctgccccttggtgttctggctgtagaggtattccaggaagaatcagtgagcaaacttagaaacacaaataagaaaaaccctaccaaatgaccatcatcatcaagaaccaataagtaaacaaattctaaacttgttacaacttttaagtaaaacatagaccatgtcttttgtaaaactacaattcaaagtgattactgtgttaaaaatcagtgcactgtttaatgtttaagttataggcatactttttttttctctaaaacctcttcttctagcatttcattttgataggttttagggcagcatatttagttttttaaaaaatatttttctttcctcatttatattaaattagagatacccacatctatttaggagaagccttggcccgtgggtatggggttctcaagttttttggatattacctggtgtttaaaggggacataattgtgtaaattattatgattgttcttattatgggcatattgtatgtaatttgttgattttaatctttagtttttggaaaggaacttgcagtaaataattgttttagctcttgggagaaggaattggtatacaaattctatgaatgttcttgaatcccagtaagaacccaatctttaggaaagtcaggttgagtgaaactctgtggctactaaattgctttaaaatatcattttagaatttgggactgtgactattgcatcttcaggtccacagtgtcttatctgaagaactttgaaaataaaactaatattgttaattttggatccgcatataaattgcatcgttgtgcatattgagacccaaaaaagaatctgttcgcagcagcattaaatgagatttatattacagaataaaatatatagctcctgttttaacttcagctaatttcctttatgaattctgtgttcaccataccagaaatagaactgtgaaggataactccctagacttgcacgtgggagtgaagaggccagttcctgctgtgcttgtgtcatcctgcgatgctggggttgacctgtttgtagtccactctggttgcggttaacaggaggggctgccttggagggttggcgtctggtgggtgtactaacttggtcagatgcagatgggctcctcatgggagccttttcacgggaagcatgaggtcacgttttctggctttcgtttgctggcatttgcttaagagaacatttggagtttgagaggagaatgactgaggatttcttcccatgaactcactcaatgtacttgcacagctggggcggtagaattcctttggattagttacacaaaatcccaacatgattttatgaagctttggtctcagaatttgcagatttgggaacctcttgatgaccccgtttaactaaagcggttgcatcccctgcccttcttgctgctgctttctttattttagtagcctttactgcattctcattttaaagaagaatctttacaatgtgtggtatggtaacattataattactatttttttttaatagggaactcctgaatttgtaactgcaacagaatgtgtgcactactttgagtggaggaccactgcagcctgcaagaaagacatatttaaagcaaataaggaggtaacatgggaacttcaaattacatgcttatgaagtatactctggggaactttatctttcaaatactgattctaacctttccgggtgaaaatcttttttagcttccaaattgcatttgagcagagataccatgtgatttaatttttaaaacttttctgagtggttcttatttttaggacagggcatttaaaatatcacaggatgtgatttttggtccagattggaaatagaatggctcatccatatagggcaagttagttcttggtttctggtgctgtgcaactcagtaaactaagtgacgtgtttgggcttgggcttagagtattcactctacctgcaggagccatctgtttctgacgctgcctgcttcatcttcctttgcacctggctttccacctgtgttgtaccccgcttttgataagtctcctttacctgtttgcattgttaaatctctctgtccctctcctcagccttgggatgacttctggctgcaatgtgagtccaggtcaggtatcccttaaattcttttccagctcacctcagagactagattactaggttactgttactattacgtccaccccttattatttgaacccagcattccttggtcaagacattcttcttgggtgcatgtatgtatatatatctatatacatacacactgacctatatgtattatgtgcaacatgatattttgaaatatgtatacattgaggaatggctacattgagctaattacatatgtgttacctcacatatttcgtttttttttttttttttgtgaggactcttaaaatctactctcttagtgatacgcaagaataaattacattgttattaactgtggttgtggtggtgtttaatggatctcttgggcaggtcattcttgttgactaatggaatgtccccttccccagcctggattccctcatgttgcactgctacttgattctccctggtcctggggaagagcagactgtgttccttctgccgcttctccatgcccaccaccccagatcctaaagggaatttcctgttctcaccttgataacaatcttaattaattgattatctcacttttctctcctactttctgtttttaagaactttcaaaggttgtaaggattcaggaactaatgaatggtcataatcagtaatttttactagtggcctaataccatgcagtttaataagacaaaaagaaatgtttatttaaaaacattaattcagattaaattatgaacaataaatcactgatattttcagatatggtcatctatgaagggaaagacagtgtcatatggaagtggaagtggtaaaatactgcccaggaaagccataaggagcattcaatgaaaaaaaaaaagtttaaagtggaaagaattaaggctgatatttaggagacagtgtcaaatgtaagcttcatttaaaaacttaggtgaagctgttagatgacatactgttagcggtgggaaaagcatctcaaagcagacatctgtttggggtttgggggtgagggtgggagcacagtgtgttcattctcgcagtgctataaagaaacacctgagactgggtaatttataaagaaaagaggtataattagctcacagttccgcaggttgtaaaggaagaatggcagcatctgcatctggagaagcctcaggaaacttacagtcatggcagaaggcaacagagtatcgagcacctcacgtggccagagcctgaggaagagagtgggagggggaggtgccgcccactttgaaatgaccagatctcacaagaactcactcactatcatgataatagcaagaagggggtgatggaatctgccctcatgatccagtcacctccccaggccccgcctccaatgttgaggattacaatttgacacaagatttgagtggggacacacagtcatcctgggattacaggcatgagccaccatgcccggctaatttatatatatatatatatatttttttttttttttgtttgtttgtttgtttatttgtttgttttgtagagacggggtttctctatgttggccaggctggccttgaactcctgacctcaggtgatccgcctgcctcggcctcccaaagtgctgggattacaggagtgagcccctgcgcctggccccacacacagtcatcctcaagtgtccagttggccggatctgagttgcttcctgtgggaggtggaggctgcggtgacagtggtgccctctgctctcctgttagaccccagacctctcagtcccacagatactctcctgggctctgattttccaacctgatcatgataccctttttgttttgttttgtttttgttttatctgagtgtacctcttatgtcacgttgctgaattgacagttgtgtcttctaccacctaggaaaaaattgctttccaaaataaaatgaatagcaacttgttttcaatgggtcagaaatcaccaactacagcccatggttcaaagcctgccctggcctgtttttgtacaaccccaggactaagaatggttttcacatttttacaggattgttacaaaacaaagaggaatatgccacagagacctatgtgacctgcaaaacccaaaatgtagataccacatggttctttgtaaaaaaaaaaaaaaaaaaaaaaaggtgctgatctgtgttctaaatagtttttggggtgggaatggggaggtatagtctgtgtttttctcaaaacaatgacatttaatttctcttagaagcagattgaagatgcatgagaaacatttgtactttgtactctcttacctcttcaggtgtaattggcagctggggctttattcattgagttttcatttattgagagcctattgtgagctaagcagtaggaattttgttaaattttggaatgctttcagggagcctatagactaatggtgtgaaggacatatccatattcattaactcatttttttttgtcttatggatagattaaatggaaagaactgaaaagcataatgactgctaaaaatgtagtgctgtcactgttagcaaatcttaataaagcgtatgcccttttttctgctttcagtttgatttgattacaccttacaggcttggtatgataagtttaaaacatattgaaggtttatgtacttataaaaacctcatcattccctaaagaaaaaaaatctcaatttggtttagtgtcattgtagtcttgctttctacatcttactaatgtctcatttatttattcattttgctctgtcacatttagaatgattttgatgggcaaaaatcatggtagttacaaacagccctttaaaactattgttatactttgttcagtggattctggtagaggctttaaggtaattatttctttaaagcattgtgtaaatatacctcctactgtagtgcccttgggaacaggcaaaattcagaactggcctgctagcagtcttaccagggttataaaagtaagattattatatataaaacagcattaactcaatgcgtggtgtgttgcagctggcaaacaacctcgctccccaggctgctaaattcgtggtcttatgaatgtctccattgctgtgtttgctgtagcaggaagtgggagggtgttccccagtagccttgactgtttaccaatgcacactccagttctgtggagtgctgtgtgaggcatgtcttctcttccctcctggagtagggagacagccagtagttgctacctgccccgagcagggtgcttgcagatcttgcctatgtggaatcctctaagtgtcttggtgaaatgcagctgttttcagaatgaagagttctttcattttcccttcttgccatatgccatcttgctcccttttccatcataggcttttattttgctggttagagaattgcatcttgtcttgcatcctacccagtccactgactcactcccctcttgggttaatgttttcatatgatcttgctgtgggatgacaagctttagatttgcaggataatgggcacttgtggctttttactgtaacccaattatagtctgtggcaataattttcttttagttgcctttctgcatgaatctggtggtaggcttaagctccatgtgctggtaccctctgagcactagaggttctaacttcctccattattagtagaaacacttaggtgtctgagaagtattttaggcgacaggcaactttgctttgaggatatggtcaaaatgagttcaagtgcctttgaggctgtgagtaggtgtaggtcgtttgattcactctattagctctccatgaatctctgacagcaggactggggaaaaaggttagtgggttagagcattcctgcagatttgatagcctatttctaagagaaatttgaaagctaaatattaagcagttaacttttgtaaatagacctgtctgtgaattgcttcagtctaaaagataaaattttgggaaacttatccacagaaaataataaaactatctactttgaaatgatttcagagaacatgaagttttagaatattctttggaagaggtaattaaaatgatgccagtgtattattttggaaataaaacttacaggaatgtttcacatagtcatggttcacttggtgaccagggccttttttactctgggggggattcctttctgggcttgagttcttgctgtgatgcggaagttgggtgcccctacttcatgaaactgtaccgcaaagatgtgggtgcccctacttcatgaaactgtaccgcaaagatgtgggtgctcctacttcatgaaactgtaccgcaaagatgcgggtgcccctacttcatgaaactgtactgcaaagatgtggcctcagagccatggtttctgtcctgggcagggagtcttgcagcctggggcagtttcaccatctgagcacagaccctgatatagtttggattttgtccctccccaaatctcacattgaatttgaatccctaatgctggaggtggggcctggtggaaggtgattaaatcatgggggtccctcatgaatggtctagcaccatccccttggtgctgtcctcatgacagtgagtgaattctcatgagatctggttgtttcaaagtttctggttgtttcactctcaccgtcttgctcctgcttttgctgtgagatatgcttgctcccacttcaccttctgccgtgagtgaaagctttttgaggcctccccagaagccgagctatgcttcctgtacaacctgcagaactgtgagccagttaaacttcttttctttataaattacccagtctcaggtatttatagcagtgcaaaaacaacctaatacagactgcttgggactgggctggcttttttggcctgctgccagcgatgggccacaggtgggagactcactgagttaagggcattagaacttggtgggtcctgctattgcctgctatgctgtggagctcaggctgcacctctttttaccatgtgggctctttgatgtggtagaggcgcctctgtccctccccagaatgttgccctggaggcccgctgatcaccgttggggccagtgcttgtctcagctgttggagagcctgaatatgtgcttgcctgacccagctccacccagctttccttcctcaatctgccttgctggcagaacacaagacagtgatgcttaggtgtcccatggccccacccattgtctgggacatgggagtagcctcctcgttaacaaaagccaagcataaatcctgttgccaccactgcagctgcctctttcctgcaagtaccacttcctggccaggagatgaacttgcgtagcccatctgctgagacaagtgcacaattgcacagtgctacggcaggagacaagctttccatgacctcagttaccatcatccctcaccacaccctggctactcagaaggccctgagcctgctcaccagcctggtatattactactacaactgatgtttgagaaagtcaccacacaaagcctatctataaccaaggaattcatacagtctttgacgctgaaagcgtccagaagcaaagccaaataaaactatgcaacatacattatagtcacattctcagggcggggggaaccctctagtcaaagcaaaagtaaattcaaaccaaaaagtgacagtttctctagatgagaaggaagcagggtaacaattctggaaatatgaaaaagcagggtgttatagcaccctgaaggatcatattaatcttccagaaacagatcctaaccaaagtgaaatgcttgaaatactagttaaagaattcaaaatattaattttaaagaagcttaatgagatacatgagaaagttgaaaaccaatacaaagagatcagaatatcaatccaggatataaatgagaaatttaccaaagagatgttttaaaaaaatcaagtagaatttctagaaatgaaaaatttattataggaattataaaattgagttgaaagtttcaaccatagactagacgaagcagaaggaagaatctcagaacttgaagacaggtcttttggattaatccaatcaggcaaaaacaaagattcaaaggaaatgaacgaagtgtttgagaaacgtgggactacatgaaacatccaaacctataaagcatagatattactaagggagaagaacaaacaaaatctggaaaatgtatttgaggacataattgatgtaaacttctttagtttagcaggagatctagacctccaaatataggaagctcaaaaaattctaaggaaatatgttgcaaggaggacttcaccacaacatatagccatgagactgtatgaggtcaacatgaaggaaaaaatcctatccacgagaaaagtatctaatcacctataaagaaaatcccatcaaactaataggggacttctcaggagaaacttaagagccagagagattgggtttctcttttcaaggtgcttaaggaaaaaaaatctgtcaaccctgaattttgtatcctgccagaataagtttcatgtatgaaggaaaaataaagtctttctcagacatgcaaatgctgagggaatttgtcagtactagatggaccatacaattaatgcccaaaggaggtctatacagggaaacaaaagtttgatacttgctatcataaaaacacacaaaagtataaacactcttataaaacaattattcaaacaagaccacaaagcaactaggaaacagttagcattatgacaggaataaaacctcacatattaatattaactttgaatgtgcatggattaaatgctccacataaaagatacagattgggagaatggatttaaaaaataaaagacagaatccacccatatgctgcttacaagaaagccagaactaattggtaaagacatacactgaagctaaagggatggaaaaagatattccaggcaaatggaaatcaaaagcaagcaggaagacccacctatacttagataaaactgactttaaatcaacaacagtaaaaaaaaaggaaaaagatggtcattatatgataaaaagattattcaacaagatgtaacaatcttaaatatgtatgcatgcaactctagagcacaagattcataaaacaactgctggtagacttcagaaaagaaatggacagcaatgcaataatagaattcaatcactgagaaagaaaatcaacaaacacggcacataaattggattcaggaccacgtagacctaacagatatttatagaacattctccccacagccgcagaacatatattcttctcatcagtgcatggaacgtttttcgagatggactatatgtcataccaaaaaacaagtctcaataaattgaaaaaaaccaaaatgataccaagtatcttctcagaccacagtggaatgaaactagaaatcaattcacagagaaactctcataactatacaaataattggaaattaaatagcctgcttctgaatgaattttgagtcaacaatgtagttaagatggaaattaaaaaaaaattgaaacaaatgaaagtggatacacagcataaaacctgcgggatacagcaaaagcagggctaagtgggaagtttatagtgttaaatgcctacatcaaaaatagagatcacaaattaacaacctaatatcacacttcaaggaactagaaaaaaaagaaaaaaccaaattgaaacctagcagaacagaagtaacaaataccagagcagaactaaatgaaatggagaccaaaaaatgcagtacaaaggataaaaaaaatgagaagttggttctttggaaagataatattcatagactgttggtcagattaaccagaagagagaggattcaatcagaaataagaaagtagacattacagctgataccacaaaaaagatcataagagacttctgtgaacatctgtgtactcacaactgagaaaatttagaggaaatgtgtacatttctggaaacattcaagttcctgagattcaaccaggaagaaatagaaattccaaaaagaccaataacaagtattgggattgaatcagtaatttaagaaaaacaaaacaaacaaaacaaaacaaaacaaaaacctcccaacaaaaaaagctcaggaccagacagattgacagctgaattctcccagaggcacagggaagaactagcacaaatcctactgaaactgttaccaaaaatcagaggagggaatcctccctaactcattatttgaagccaatattatcctgataaccaaagccaaacaagcacacaacaaagaaagaaaactagaggccaatatctatgataaacagattcaaaaatctcaacaaaatactagcaaactgaatgtaacagcacttcagaaaaataatacatcacgatcaagtgggttttattccagggttgcaaggatggttcagtgtatgcaaatcaataaatgtgattcaccatttaaacaatttaaaaaaaagtctgaccatctcaggagatacagaaaaagcatttgatgaaattcaacatcccttaatgaaaagacaacactcaaaaaatattagaagggacatacctcagaataataaaaggcatatacgacagaaccacagccagcatcgtactgaacagggaaaagttgaaagcatttcccctaagaagtggaacaagacaatgatgcccactttttcatctctcctattcaacatagtactggaagtcctacctggggcagtcaggcaagagaaagaaaacgcatccagatcagaaaagagacagtcaacgtgtctctgtgtgctgatgatatgatcttatacctagaaaactctaaagtttcctccaaaagtctcttagatttgatacgtgaattcagtagtttcaggatacagagtcattgtacaagaatcaataacatttctacacaccagtaatgatcaagctgagaatcaaatcaagaagtcaatcccatttataatcactaaaaaaaaaaaacccactagaaatacatttagccaaggaggtgaaaaatctctacaaggaaaactgtaaaacactgatgaaagaaattgtagatagcagaagtgggaaaacatcccatgttcatgaattggaagaatcaatatcattaaaatgattatattgcccgaaacaatccacagattcaatgcaattcctatcaaaatgccaacgtcattttttatggaattagaaaaagtcctaaaattcatgtggtcccccaaaaaatcttaatagccaaaccaatcttaaggaaaatgaacaaagctagaggcatcacaatacccacctacagattttactggagggctatagtaatcaaaacagctagtactgatagaaaaatagacacacagattaatggaacagaatagaaaacccagagtcaaagctgcatacttacaaccaactgatctttgacacagttgacaaaaacatacactggggaaaggacaccctatttagtaaatggttctgggaaaactggacagccatatgcggaagaatgaaactggacccctatctcttaccacatataaaaattaactcaggtcggattagcgacttgaatgtaaggcctgcctgaaactataaaattcccagaagaaaacccaggaaaagctctctcggatcttcgcctaggcaaagaattcatgactaagacttcaaaagcaaatgcaacaaaaataaaaatagagaaatgggactttattaaacttaaaaacttctgcacagcaaaatacatagtcagcagagtgaacagacaacatacaaaatggccaaaagtgtttttaaactctacattcaacaaaggattgatattcagaatctacaaagaatgcagacaactcaacaagaaaaaccacaatccctttaagaagtgagcaaaggacgtgaacaaacatttctctaaagaagacatacaaatggccaagaatctcctaaacatactccacatcactaatcatcagagaaatatacaaattattataaaaccacatggaatactatgcagccataaaaatgatgagttcatgtcctttgtagggacatgaatgaaactggaaaccatcattctcagcaaactgtcgcaaggataaaaaaccaaacatcgtatgttctcactcataggtgggaattgaacaatgagaacacatggacacaggaaggggaacatcacacacctgggactgttgtggggtggggggcggggggagggatagcattaggagatatacctaatgctaaatgacgagttaatgggttcagcacaccaacatggcacatgtatacatatgtaacaaacctgcacgttgtgcacatgtaccctaaaacttaaagtgtaataataataaaattaaaaaaaaaagtttaggaaaaaaaaaataaactgcatatatggaacgtaataaaaaaaaaccccacaatgagataccatcttataccagtcaaaaatggcaattattaaaaagtcaaaaaacaacagatgttggcagagttgcagaaaaaaaagagaacacttatacaccattggtgggaatgtaaattagaatgacctttatggaaaatagtatggaaattaatcaaagaactaaaaatagaactaccatttgacccagcaatctcactactgggtatctacacaaagtaaaagaaatctgtctgtcaaagagatacgtgcactcgtctgtttattgtggcactattcacagtagcaaagatacggaataaacgttaagtgcccaccaacggatgactaggtaaagaacacacacacacacacacacacacacacgtctatcatggaataccactcagccgtaaggcagaatgaaatcctatgttttggagtaatattggtggaacttgaggccattatcttgagtgaaataacttagtcagacaccacatattctcacttataagtgggaactaaataatacatacacatggacatagagactggaataataaatattggagcttcagaaaggtgagagggtgggagggcagtgagggttgagaaatgagaaatttcctaatgggtacaatgtacagtattccagtgctggttacactaaaagcacagacctcaccactgtgcaatatccatgtaatacaactgcactcggtcctcctaaatctaaataaaacaaacaaagaggcacccccttaaagctcagggtcttgccaactctaacagtggggtttcttgatgttttttaaaataaaaagaccattagttcataggtatgagagactgtcataaattaaaaccaagtaaggatggattgaaatacccacaggaggaactcatcttcacagtttatggaacaaatatagaacaaatatttactgagctcccactatgttgtaggcatcatctttagcctgcagtgacaaacccttgacctcaaggagcccctattatagtggggggaaaatgacaaaagtcaacagatggcagtacctagtatcatacatcacagtgctgtgaacaaaagtgaggctgagtatgggagacagagagaggtagagagtgctgttttaggtaaaggtgtcagaagaggccttactaagggcgatgtttcatcagagacctgaatgaagtgagggaaagagccatgtgtatatttgggtaagcacatctcaggtagagaggacttttgagtttcaggagggtagaattgcatcaagaggtgagtgtggctgcgttgagtgaggagagtggtaggttagggcggtgtcatgaaggagttggaatttccttctcagtgtaatgggaagctgctttgaacagggagaggtgtggcctgatttaattctgaagtgctaatcctgtgcttgtggagacatgggctgaggtagtagggcactgaagctggaattggggggccagttaagatactattgcaggcaagagattatggtggcttggacagggtggcgatggtggaggtgataagtagggagtggatccagggtttagtctgaagggagagctggcaggacttgccgatggttggatgtagacgtgagagaacttggcggtggggcagggggaccttaaggttttggctcaagcaactggttgaatgatggtgccatttgttgagatgaggaacactggggtaacagtaggttttgggggagaaatcaaaggctcattttaaatttaaatacatgaaatttgagatggttttgtgtatccaagtgatgatgataaacaacagcaataaataacacttatgccaacctgccaggagctgtaccccaagcttcacatacattagttcactcaggccttacagcagccccatgaaggaataactgtcattattccagtatggcacgtggggaagctgaggcatggaggttaacttcattcatggtcatgcaaagtgttcatgccagaggttgaaccccaagtgttctgcttcgagtctgtgcttataaacgtagcttctgctattgttggctgtgtaagcctgcagttctgtggaaaggtcaaggctagagacatgaatttgggagtctttggcagacatttataaccatgcacgaggtcaccaagggattgggtgtagacaggaaagagggctgctcagtaagctgtggcacacctctggattgagagtcagttagagggaaggtgagaagtgtttccaggaggctgaaaaagagctggaagtggggcagaagaaaaccaggagcctgtggatgcaagccacaggagaaggggtttcatgaggtggagaatgatcagtagcatccagtgccacaagagaccatgtaacgggaaggctaggacacgagcactggatgtgtcagcagagatgttgtgggtgagctggtaagcggggttttgctggagtgggaggcagcaagctgatgggactgtgttcaagagagaatggaaggcaggaagaggagaagacgtgtagggacaattgaagaaattttgctctaagttgcagagacatgagatgatagctaggggaatgtagggaccaggaaggacgtttgtgaggtggtagatctcatggcatgctgacggaaacgatccagtggagagggaaaacctggtgatgtaaagtgagaggagatgattgcacaacagtcctcatgtaagagagaagagataccgaaaagaacgcagaggagccaagacgtttattgacctttgcctgagttcgttattaggggacaccatagcatgatagtccctaaggaatggagagcagtgttgtgtgacattggtcataagcttttctgattgaccaagatgtatactgaagactcacttttttcttcctcccttccaggtgccatgctatgtgtttgatgaagagttgaggaagcatgatctcaatcctctgatcaagcttagtggtgcctacttggtggatgactccgatccggacacttctctattcatcaatgtttgtagagacataggtatgaatctttgtggggctgagggggtggtggtgagggatttcttctatggcttcaatatctttgcctttctacctttatttctgttttcacatccatgtttctgattaggccctctaataaagcttttgtccccaaaaatgttctatttgcacaacccacctcttctcccccagtagattccatgcctcctccccaacccctgtagattccatcctaactgttgatccattccatgtgggtgttctctcggccagacaccttgggtttcgggattctacagaagtgagggtcggtcttgttctctgtgtgtgcctgaatcccttggctctgagttacgggctgggtgaaaaagaaaaagggatgatcaaggacttgggtacttggtcgggatgcatatttggcccaagctgacttgttcctttctctgtacttgccaaaactggtgtgagaagctttagcttaagctttagaatctttgataaattaactaaagaccgtaaataaatggtctttatctaaaaagggccatgaaaagttttactaagcctttgactagccttcagctggttttactaagccaagtttctaaaacccagcttgatgttcccctcagggctatgaattgttagtcctgtaggccaggactgtctttctgcagtgctagccatgagtaaattctgctggtgattaactaatctaaaggtcatttttagtgttcttctttgttttttatttctcaaatagtacataatgctttgcccttagaaaagtttggagaaaattttaaaaaataaactcaatacatggaagtattgctggatagtagatgagtattaatttatgattattctttaaattatatatatacattatgtactatcttgtttatgtattatttctaaacagttaaaaacagtaaatataccccattcagggctcaccaaaagtaaccaatgataactaggtttttttgtgtgtgttagagtattacatctttcttttgttctccaaggataacctttattgattttttggaaaaagactaatacagtctttgtcttaaatgggtctgtaactcaagtttggttatagagttgatgagttgtagattattgaattctggaataatacgctattttgatttggaaaacatttaggtttctggtctcttaacattttacagatcatctgaatttgctgagtattttcttacaagttttttctttccaatttattggcaatttgagtagagcttgaatgactttgattcacagtaggggtgccctagtttttactcagacattctccattcccaggaaattgccctaagtctcaaaccaagattgaatgtgaccctcaaaacctcttggatagtttcggacttgccatcatgtgcttacctccttgcatcctcagggcgcttgctgtgtattctgcctttggtataccaagtggattgtcttacactgagtccccatgagggcaaggagcctatggcacagcagatactataggtggaacaaagcagtccatttgtgaaatttcataattccacataatttcataattgtttggaaggcttgagagttaaaggtttgcttacctcttcactagctggtgcaaaggtagataaccctctccatctttgattaataaggcaggtaaaacttaagggaggtaagattattcactcactcattcgtgggagaagggttgtttgaatcccttctgtgtgctaggcactaatctaggcactggattatagcactgaactcaccacagttcctgttttcctggaactttagttagataggagaaaagatagatagtaaacaaataaatcccaaagtatactgtgtaaggtattgagtcatggtcatagaaatgaatggtaaagagcaacctagctgtaatcatagctgttgctatactggcaatctgtaaagcctgcgggatgttctggacatattctgggtatgttttcatctttaatcctccaccaaacctgtgcagtagcacactggcaattggatagttttgtagttagaccaacgttatcgacatagtaagtggtcgatttaggatttgaacccagagctgtgggttctttccctaatctcctaattgttccagtcatctgtggagtgcctgcattttctagtctctgtagcttgaaaggggatagtgctaatgttgttgtacctcaagcagaggatgggtacatttcttgattacaaataacatcataacctgtttcctgtgcacctcttatataccagtgcagagccagtactttacagtccttcatcctgagctttgtttgcagagggttaatggcttgcccaaggtttcagaatagttacttagggagacttttaggaattcaataatgtatttaaagggaccctgggtctaagggtacgtgtgattatcactcctaacacctaatctgatttaatgtaatacatgattttcagacacactacgagacccaggttcacagctgcgggcctgtccccccggcactgccgcctgcctggtaagaggacaccaggcgtttgatgttggccagccccgggacggactgaagctggtgcgcaaggacaggtcagtcaaggcctccgatgctgttggcgtttttaatctccagcaaggacctgactttcagggagctgcaggaacatcctttttcagcaaggcttgggatagtccctgcagcattgctgcttcacatgtacttgtaagattgttggtcattgctgtgagtcacatagtctagtgtgcttgtctactttttaatcatttgtctcttacagcagtaaaaatacatctcatgatccagtccatagtacatacctgtatttgcctcatgaaataatgcctatcttaaggtgccatctgatatttttcattctgtggcacccgtgaaattgattttgtgtccattgtgttctcatcttgggagggcaagagacaggagggacagtttgctggtgaccttcactgggatgtgacagggaccttggttcccagtggggaatggtgttccttataatgtgttgtgccgtgtacatatgctcttgtactgcctttgtatcttgccttggcagacatacgcatttctctagtgtgttgcacatgaccatatcctgaacttcgatcaaggattcacattttctccccattcagaggcctttggtagacaccttgttgtgcttgctctagtctggagctcgtggcatgtctgggtggttgtagggagcatgtgcaattataatggcactctgtccaaagaaaaaacttgagcgtaacctgaggggaaaagtgtttggaattttctatgtgtgtgtctgtattagtttgctcaggctgccataagaaaatacgataggctgggtagcttaaaccacagaaatgtatttcctacacagtctaaaggctgcatgtctgaagaaggcgtcaccggggctggtttgttctgaggcctctctccttggctcgttagatggccgttttctttctgtgtcttcacgtggccttccctctgcgggggtctgtgtccgaatctcctcttctgataaggacaccagtgattttttggattaaggcccactcacatgatctcctttttccttgttcacctctttaaaggccctgtctccaaatatagtcacatgctgagctatggcttaggccttcaacatacaaattttgaggggaaacagttcagtccataacagagtctttaagtgacacattggtaattcttaatatgaatgagtttgtgtgacgatttagtaacatgtgggacactgagcaagtgtgagcttctcttgtgggaaaaggcaggtcatctgtgatcagctattctctagcaggcagccaggggcactgggccctttccacactgagtgcagtaaaccctggtggtgggggccatgttggatggtggtttgggtggtggaagagaaccccagttcagtaactgctgtaactgctgggcaggtgctgtggggttaagacaaaacaaaacttttggctggcacttagaatttgttgtataaagaggaaatgattgactagccttgtgggcaaaaatgcacctggcctgcttgtctgcctttttttttttttaattttgttatctcatttacaaccgttttttgcttgttttagtcaaatggtgtttcttcctttttttaaaaaaaataatttttttgttccttttctctttccttattctaggacatgaagcagatcaaacaggttttgtttttgtttttgcttttgtttttgagatgggtcttgctgtgtcacgtaggctggagtgcagtggtgtgattttggttcactgcaacctccgcctccctgttcaagtgattctcctgcctcagcctcctcagtagctgggactagaggcgcactaccatgcccagctaatttttgtagttttagtagagatggaggttcgctgtgttggccagggtagtctggaactcctgacctcaggtgatccaccaccttggtctcccagaatgctgggattacaggcgtgagccatcgcacccagccaggttttcttaatatatcaaatttatgtgctggtcactttagatatttgattttttaacaaaataacactcactggagtttacttaaaacttttttttttttcaaatggaaataaagtcattttataccatatctacttttatattttaatatttcttctgttaccctctcctcccccccaagtgaatgtgctgaatgctcagggcaacatatgaatttggatgtactttatacttttgtaatactcttttctcaatgtggctctcccaggcttgtcctgagttacgtgagggaagaggcaggaaagctagacttttgtgatggtcacagccctgcggtgactattacatttgtttgcccgtcggagcggagagaggtaagtgactcgtctcctgatcactaatgtggcgcacagtagcctgggttgcccatgcgaacgcgtttctgggcttggggcagggtgggcctggatgcaggaagctgggagccatgacagaggcactggtgggttctcaggagaagacaagcttcctgggatagcttctgtcacatgcagctcactcagggagagctgtttgcattttgccttttgcttttttacagcaatccggaggggcctccacatataatgggatggtgttttgttctagtctctgtgagattattttaagtagttcacggacagatttttttttggtagttgggttgttttagtgaatagtggaaaaacgaagtagaatttcaagcctgtgatttcttatgagaagcctttccctccctctctcttcccagtctgcccctaaacccccatccatgccttctcccctctttctcatcacaggccagtttattgctgtgccctctgctgttgatgaaatctccagcgcagctgtaaactcttcgagtgtggctgctgagacttacttgtccttgagtgcccagcgcctgcaagtgttttaaccaggggcaggtgctgatggaaaggaggcgtcccccagggagggaggggtagggcagggctttcctttagtttctttctgccttcttagtaatagggtgaagtagggaggggctgaattcttttgccagagaaccacactccccttcccccaagcaaatgtggaatttgctctgacgtcaggctggcagctggcctggtgtgtgtgggatatggagacagtgcagggctcagctttccactttctgtccccagacttccacatcaagtgctgtcagctgaatgaaggccggagtgtctgatgtttgttctgaatgtgaatggggaggaatatttattcacacttttcatttgtacctacagatgtgagttgaaatcttttaagcccagtgagatgttctcaggcggtagtggttttagtgttttccctttttatttgttctacatttggtaagaatcattttacactgtgagaaccaagagaattgggagttttcctcctttttcttcgaaggggtatgaggcatttcttggtgttagaagaagaggctgatttgttattagtggagcaagaagttccctctgttttttttttttttttttaaagacagtgtcttgctctgtcgccccggccggagtgcagtgccacgatctcacttcactacaatctccgcctccctagttcaagcaatcctcccacttcaagcaatcctcccacttcagccttctgagtagctgggactacaggcatgtgccaccacgcctggctaatttttgtatttttagtagagacagggctttgctatgttgcccaggctggtcttgaactcccaggctcaagtgatctgtccacctcggcctcccacagtgctgggattacaggtgtgagccaccgcaccggccaggtttcttttcaagcttaactgttcactgggcagaccttgtgtgacatgtgcttggacactgtaatacttgggaggtttgtttaagcatttacatttgctcattgaatgattttaggagctggtatttagtaaacactcaccttgtcatatagatcattttaaaaatgctttatttaatttatttattgggtttacatactgtaaagttcagttttttttaagtacaattcagtggttattagtatttttttttagaactgtgcaaccatcatcacaatctaattttgcatttccatcaccccaaaaagaaacctcctgcccattagcagtctcttcccattcataccccaagccctggcaactgtccaccttcttcctgtctctgtggattggccttttttggatgttttatgtcaggagaatcctacactgtgtggctttctgtgcctggtttctcttacggagccctggggtctgcatcaccatgtgtcagactgcactgagccacgtgggcagaagcatcgattatgagtcaaacagaagagggttgggcctgcagctctgcaacttactaattgtgtgcgacctgtttgtaaacctggcacctagtgcctggcgtgtagcaggtgctcagtgagtatttacggaatgaatggtgctgggaagcagcacggctatgcccggtgctaagcccagtaagtcgtgtctcctaagggtgattaaaaagctggcagtgacattcctggtgagcagggaccccatcagcccccttcatggctcacatcaaagacgaatggtggagctcctgctctgtagaagcaacacaatggcagaatcgggtttgtgtctgggtggtgccctggcttcacccaggagcaggtgtgggtacagatatggtggtgcccaggatcccaaaggggttgtggaccgtgtctctggttgtgcacgcatgtgataatgttcactcagtgtcagggttgcaccactccagttgagcacctcgtggaaagcggtgaatggaccatgcaccctgcacggcctgttagcgcttgccgatgtcctagtgattgccacgtgccactgagtccaggtgcttgctggccgaagcttgagtgtctctctgaaggtgactagactagaaagggaatagagtgtaaagaggaaatggaggtgttacgagtcaaatggaaaaaaaataacagtttagaaaaaaattaaaagtaactttactgagttgttataagtcaaataatcttaatgtgttagaggcaattatgattcaaaaaacagaaacagcaaaatgtagaaacctaacaacctgtctttgagcttttcataagtgtggaaaatctgcattaagctgcatgaaacattttttattttgcttctttcacattgttcctgatagggcaccattcccaaactcacagctaaatccaactgccgctatgaaattgagtggattactgagtatgcctgccacagagattacctggaaagtaaaacttgttctctgagcggcgagcagcaggatgtctccatagacctcacaccacttgcccagagcggaggtaagcaggtgctttctgcctcctggcgctgcttaggaagaaggggatcgagagagggaacgggacagtaggggccaagtcagtccatgcatgcttctgggttggagagagctgtagtttgggctggtgtttcagaaataggattcaggtttgactaagtaagactgtaatcttctaatacctattcatataaaacaagcctcttcttgttaatttccctgtttttaggttcatcctatatttcagatggaaaagaatatttgttttatttgaatgtctgtggagaaactgaaatacagttctgtaataaaaaacaagctgcagtttgccaagtgaaaaagagcgatacctctcaagtcaaagcagcaggaagataccacaatcagaccctccggtacgtcaacaacctctgtgcgattttcctttttctttgtatttcttgagatagggttgcactctggcgcccaggctagactgcagtggtgcaatctcggtgcattgcagccttgacttccctgcctcaagtaattctcccacctcagcctcccgagtagctgggactacaggcaggcaccaccatgcctagctggtttctgtagtttttgtagacatggagttttgccatgttgcccacgctgatcttgaagtccttgcctcggtgatcctcccacattggcctcccaaagtgcgtggattagaggcgtgtgccttgggactggcctgcataattttcaagtgcgttgtgtgtattcttgtgaaacataactccctctccttttcttcctctttccattttccgtaaggtacgggagaatcagttactccagcattccttcctagtagacttcggcaagttgccgtttgtcactaaacaatcaaatgtttttcctggctttagagtaagaatgcttctgttagaactgttcactttataaacttgctgtttgtacggaacctactgtaggaaaagtatttaatgagtttacagttgatagggttttttattttaaaattcgtttttaaggagttttgatttttctctggcagtttgagaatctgaagcaccatcaacataacagaaaattttaaacaactaaaaaaatgcattcagcacatttcttttgacccttaacttggtagttgaccttcataaaagcaggatgaaaatgcagttttctgaaaatgtgttaggggcagttacgattcaaaaattaggaacagaaaactgcaaaaaccccagaactggtctttgagctttttaaaagcatggaatatctgccgagaagctgcattttaaacattttatttttgcttctttcaaattgttcaggatcagtatagtccaaggcccctcaggcacggctgtgttcatggcggctgttaagaaggctgtctaattcttgggcgttatttattttgtacgaaatctaaaagtgagaacaagagaagtcttcatgctcacagcaaaaccttcggcactttcttccagccagttactactttgaagcgagaggatgtcaagtccatacatttggaactcatttcctgtagatatttttccctagctggctagagagcttgctgttttagatccgtagtgatttgttgatgctacgcaaaaggcttaatgtagacatttaaaaagattcaagtttttttcttggttctcccaaacacatttgtctgtgtattcacaaaaatctagatattcggatggagacctcaccttgatatattttggaggtgatgaatgcagctcagggtttcagcggatgagcgtcataaactttgagtgcaataaaaccgcaggtaagtgtgcgctggagttcagcccctcctctttgcattcatgggcatgtgcttgtgtgtgtgcacaggcgtgttcttggaagtgaacactgaatggaggagtcagatgccctcctttggactggccagctctagcccccagactgggttttttctgttggagtaacactttccccacccccactgccccagtggacacacacacatcctgtttgtgttttcctcggttttctctgtttgttttgggaatgggcccagcaatgagcttgttgggaaagttttcatcttgaattttggtgcacactaaactacagcaaggacagattcggcaggggcgggatggcttgtcaattttgattgagtgacctcttcttttatgtaatgagtatcaagataatcctttttgcaaagtggtgaccctatggtagagtttggatctggggattgcagaatgtcactgggtgcattgaagctgaaggcgtgcatttctctgagtaatgagaagcacccttgagtcaccaaggcactggcatatcaaaaagcggtgccgctgtccatatcttgacgattgtagacacagttgtagctgtagagagatgatgggattccgtcatcatcagagacctgccccatctgttgacccccaggctgtgactccaggcaccctgcagggcatcccaccactgctcagagcaattctagggcccattctggtttccagcctaagtgctgccccacccagagggtctttctggcccttgcttccgtgtgttctgtgtgtttttctacagcagagctttgggtggcttggttacaggatgggttgctacaggattcactgtgggatgagggagaggcagctggacatgatgtgaaccatgctctcgaagcctccggagatcaggtctgcgttgggagagacaggcacccctgccctggtagcaccgcacccctgcgaacgtcctagcaagcaggcaaagaaccagcccagggtcttgccactgggaaggctttcaagcccaaaatgccccagtaactgctgttgtggcacctgcccctgggatgcccttgttcacaggtctgccattgctgtccttgttctctacatggccccttttgttactttcacaatacacacattttttaagtacctatttgcttaggccctatgaggctggagggtgttgtgaggatagatggctctctaggtgttcacagactagcagcagagagagataaggagcatgatgatggaggttcagggcagtgctgctagagtagagcgagtgcttagtgttgtcgctccgctgctttaccaggagggaggcaccgaggtcagctggctggggtctgggctgggtgcaggggtcaggcagttcagagaggaggaagtgctgcctgagccacactacattgaggagcatgccagtcccgtgttggggtggctttagggcctgggcctccagacattcaaaggcatggaccaggggaactgcgagcaggttagaggcgtgtatggggaatgtggctgaagatgaccctggaacggtgagtgtgcagtattgtaagaaacttgtatgtcctgcagaggagctggattatatctggaaatctgtgaagtcccaaggattttcagcaggggtatgacatacatctgactcgtgaatgagaaaatcagtgtggcctctggatggacctcgcatctggtctgagcactccctgcacccctcagcttctccatcattctctcatcgccctcacctcctagcctacctacgctactagcctccttagccatgtctgcaccctgaatcacgtctctcctacttggtgtccccagtccccagggatgcagcctgtatcttccccatgtgcccagcccctctgatgcctgaccttggttctggctcccaggtcaccccaactggctctcctggactccggctggctcaggctgctctgctgtggtctgaatctccctgcaactttgtgatgacctcctttggcctgttctgttcagggctttttattaatgacttggccgagatctttgagagtgtgctgatctcatttggggatgctgggaagacagaatcattatccaaaaagatcgaaatggacgagcaggatatgagaagggcattatatcgtttcagacttacagggaagaggtgtggacatcgatgagctgccaaccaaacaaaaaacacaggagagaaaaaccaaagaacagaaagaaagaaaaatagaaaaaaaaaagaagacccgcagtagagtggggagatcttgccttgtagttatgagcatagatgaggccacaccctctgggtttggttcccagctgccctagtttttagttatgaaatcatgggcccagagggagctaaagcccagatgagctgaggcttgacaaaacgggtgaaggcctcccatagctccatttttccttttcattataaaaattttcaaacatggaacattaaaacagaaatttacatgcctgccactctgacagccattgatgttttgccagatttttcatgtaagccatgcgtcattgatggctcatatcaccccaccctgatgccaagaacgaacattcctttatgtaaattcagtaccatcgttgtacttaacaaaattaacagtgacatcctgatgttaaaaaacccatgttttcctaggctgttttcattatgattgtaacaaggagcctggacagagagatgtcaggtgttttgtgggagggttttgagctggctctcaggcaggagttggattaaaaaatacttacatttccttccagctctgtaattcagcactccaaactctgagagcaaattgtgtactgtaaaattagttcattattattttgctcgaatttaaacttagagtttttggagaatatcccttggtagactctgtttattagatagatgtatttttgaaggtgaacgagtgttaattggctatgtaatagaagtgtggtttaagttggatctctaggaattattcatgtgaatctaggttcatgtacttttcaggatgcaagcgcatcttttggtcataatattttttaccagtttaaatctagtttgttgtaaagcgatgctttattattggtgatttttttaaataaagatgttagataattttttggaagagcagaattcattaggataggctaataaactactcacaatttaagtggctcagcccattaaaggtttattttcttagttcagtgctagtctttggggatggggctggggtcgggggtgcgggctctgctccatgtggtcatttggagacctacgctttttccatcctgtgtttctgccatctgcagatgtgacttccaggggctctgcaggatgggaacatcaatttgctttgttttattttttttccaggccagaaataagtcacttggcccagcctgaatatcaggggaggctgggaaacggagtttagctatgtgtctagaggaaaaattaaactagttgggtaagaggtagcattgtttttgccacagagaaatgggtgctgctgcctcctccttaggcagagagctccttggttccatttgaaaaccttccttccccttttgctggaattgagagactgaggacacaaagtggtgtgctggagaataaactagagcctgtggtgccagactggcaacttggggattgtgtgagtgagggagagattgtgcagagctaatcctaacattgctgatgagtggacagaaaccataggcctcatgaatagtgatttctgaagtcaaagcccagtatgcttaaatatcaacccaagtggtttgggagaggggagcacagcttactgttctgctaaaattctttgaggaattaagtaagaatacgtgtaaggtacgtagcaatggttatttacaaaatggactctgcctgcagattattagtatgtctcagatgtaaaaccagctcaaaagtactaggacgatttgtagtagtatttaattatttgtaaacttacacgtttttcttcacgtttgcagaatacaaatctttgtcagtagtgaaatgtgaatctagtaggattaaactgtgtgtaaaccttgtgggcgggatgaagagaggcagaggcgcgtcactgttgctgttagttgaccggcaagctcaggggcccagctatggtagctgcctctgggttgtcagctgcgcccaggaggtgaaggtggaaggcattccttaaagacagtggcttagtgtacttattaaaaaccaaaccaaaccagccaaccaaacaaacaaaaaacacaggagagaaaaccaaagaaaaaaagaaaaatagaaaaaaccccacagtagagtggggcaatcttgccttgtggttatgagcacggatgagggcagaccctcagggtctgattcccagctgccctagtttttagttatgaaaccataagcaaattatttagccaccctaaatctgcaaaatggtgctaaaattgtacctttgccatggggttttgaggatcaaatacattaatatagtcatgtgttgcttaacaataggaatatgttctgagaaatgtgtcattaggcgattttgtcattgtgtgaacatcatagagtgtacttaacacacacctagatggtatagcctgctgcacacctaagctatatggtgtagcctattggctcctgggctacaagtgtgtatagcatgtgagtgtactgaatactgcatgcacttgtaacacaacggtaagtatttgagtatctaaatatatctaaacatagaaaaggtccactaaaaatacgatactataatcttttgaggctaccgttttatatgcagtctgttgttgaccaaatgttgttatgcagcacgtaactgtataaagaaagtacttaaacagagcctgttcttctgcagcttgcctttatgtagccgaggtgctgagctcagtgcctggctgagattgtgctcactacaggtttgccgctgtggctggtattataattatagtgatgataatattaaagattggatagaaattacaattgaaatatcatttgctcttggtacagaatcttacttcctgttttcttagatcattacctagcttatgataccaaacctcaagaaggcagatcacatggtgggaggctcagacaaggattatgaaaccatcaggggtgggaaaaggagtgttgtgcccacggacccctagcctggaaaggtgcagggataggatttccagcaaggagcaagtcagcaaagcctctgaatctcagcgtccatgggatggggacgtggcctgtgaagagctggttttcagacttaggcctgaactattcctgctgatggatgggaaatctgggtggctcactcttggtggaagaagaggcttgatttgaggagggtgttacagacaggtgcactgacggaaccacagaatttcagcactgtttggagttgtgctgctaacattgtggggctggcataggaccttggcgtgcttcactgggagcgactgactatagatggcttccactcttgttttactttagggatgagtcccagagaacttgtcttgttcacagtcgcatcactaagtcagcagtgcacagggaactagagctccatttctgtcctcctttctgtgagtccccagtgtcacccagagatgttcaggagcctctgggagctgaccacagcccgggagcagaggatcccactcactgctcttgcgttcctcctgcctgcccttttaatcttatctttggagatgctgtacacagccttctgtcaatgtctcccaaggtgaaaggcatgctggcctgccatcgaggacttagggttaagcatctgaagcttaatagaagcctgtgtcaactcagatccccatggtctctaaaaaaacctggacctgaattttttaacggagcagttggcattggtcctgttcagtttcttccttgctccttagctgttcctcaattttggtcacgtatggagtttaaatttctcctcttgaattgtgcaggtaacgatgggaaaggaactcctgtattcacaggggaggttgactgcacctacttcttcacatgggacacggaatacgcctgtgttaaggagaaggaagacctcctctgcggtgccaccgacgggaagaagcgctatgacctgtccgcgctggtccgccatgcaggtactgccctccttgccatgcgggtcttagtccacatgctcatggaacattttcccatgagtacttttggaaatgcggttactattttctttgtcagtgggttgcgtcacagccctcccccagttttttcatgtggctgtgtgaattattagaaggagcattggactgggaggtgaaataactgaatttgagaccagcatttttgaccttgtgttttcacccttttacacactgcctctcttccatctctgaggtgggatctgcagcctctgccccctggggttcttctgtttggatcctctaggcagatggatgtgcaccttgggctgctgttcaccgctgcctcagcgtgcagtgggcttgtactcgaggctgagcttgctgttgcacggcaggcaccggatgaggtgccaaggaggcagcagcgccccccacagcacaacccctgtccttgggggcctggaatttagcaggaaacagagcaggtggaataataagaatgggagtctcaagcagggataatctgatgggggggatttctggttttaccctcttggcagctcaaattaggtgtacagaagccagttgcctctgtaagggggagatgacccgaagcagagagaatgacttgcctcatgtaattaccacccagaacagtcacagaactgctggcggtatgttctcgctcgtaagtgggagttgaacattgagaacacatgggcacagaggggaacagcacacaccatggcctgtttagggttgggggtgaggggagggaacttagaggatggatcagtaggtgcagcaaaccaccatggcacatgtatacctatgtaacaaacctgcacgttctccacatgtatcttgtttttttttaaagaaaaataaaactgccagggtgacagcactgctgctcctgtcttctgagtcccacctggtttgctaaataccaggttagaaagaggaatccctcttgtggagtgtttgagaacctgcctcactgtgaaccgcctgggcagggagtgctggcagtgctgttgtggttaaacaccctgtgtgctgctgggaacggtgccatagttaattctggcacatgtgtgctagtgaagacattggttttctgtgaagtggaaagagttctagctgcagagttggagacctggctgaggactggtgttgccgcatccaaccacatttgcttgagcgagctgctctccaggcccgggtttcttacggtgaactgggtggtgctgttagattccttaagttaacttttttttttttaaacattactgtgtataagagacaacctaggatctatgagataaggagagatacatttttcaatctacagacttcctgacatagctctggtttcttggaatctgcagtatttcgtggtatttgtgcgtagatagccctaagtaaattatgaagggagagctaaaaccattccttactgcttgaagaagtcccttaagactttacagcccacctggctccaccccagacttccagtgtttagggcaggtccttgttcacatgcacagtcttgtatggtttcttttaggctgttgacattggaaagtacttctccaaatgtactgtatcaccactgatgagtcatggggttttgccttccaaaccccagtacccaacctgcaaagggagcattttcaaatgagaacgtgtatttttatatctttacctcctccttgacacactttgtaagttactccttcagcgactgttcgccgtgtggtttgctttttgtggatgccctcgcccttgcttgctgtgctggtgacactcagctggtgccccctcacgtcctgcaggtgcctaatcagtgtctgatcacactgaccagctcaccagtcttgtgagttcagcggccacctgtggtaccttgcttgtcttctgtggtagcatgcattgcatcctgcactcagtctgcagatgtgtaagaggttgctggtttcttttagcttcacaggccttcacaggggccgagcggggtgtattagcaatggtgttaagcggggtgtactagcaatgatgtaccactctactgcgtcccaagacacaggctggcttcttgatttgggttttcagtttctaatttcatactgtggggcttgggagaattttgccgttcagttctctgtcccccagttgggcctactcttctgaagaagtattgggatgtagtttgtttctgtcacattaaatgagaaacctgagaatctcggtgaatttttgtgctttcagtctgcccgggttccagaaacagcgctggggattgagtgacgaagtggtttgggaactttgagcccttgacttttggcttaatcactatttattctgtgactcagagaaatcagcattgcttttggctaaaatacacttttgttttgttacagaaccagagcagaattgggaagctgtggatggcagtcagacggaaacagagaagaagcattttttcattaatatttgtcacagagtgctgcaggaaggcaaggcacgagggtgtcccgaggacgcggcagtgtgtgcagtgggtgagttgtgcctggatggaagatctaggtgatgcttttctagggcatccagtttggaatgagttagaagatctttctgtggttcatctaagcctcctctttctataatcacatgaaggatggtaaaaatttttcattcataactcaaatgtcagtaattgcttgatgcactctggaatcctgaagttggctagagctccctgacatgggctaaagccataactgggaacagaaggaaccacgtggaaaatactacatcatctttttagtttgtaacctgaagaataacattgccagtgtttgtgtacaagtgattttattttattttttaacaactttattgcctagaatcgttcaaaagttatggcttgagtgaagtgtaatctcagctgtagccctagtgtaagaggggcttgcatgcttcgcttccttttgctgtcattgttttggtcccgtagctgtcatgcagagacttctcaattatttgatacaggtatttagcacttcatttttgtcatttatgactcactttgaaaatgccaggctatgagaatagtgagaatctgttaaaagcattcaataaggaattgtgagcctcgttggattttaggaattatctcggtattcagaattgctggtgtgtctttaaaagcaggttcaggcatgtccatgtctttactaagaaggactttggaacagagttttaatcctttataacaaaaagcaagtgaactaagaagtaagcggcctcctgcttgggttgctaaacaggtttcgttaatttctgctttggatatgagacacattctcaccctttggctgtgtggctgtgctttcaaaagactttgtgtcttggggtagctgaagccctgacagtaggggacaatgtcagtttacagttggtgctgatgcatgttgcaagccatttggtctttcttgccctggaagggcattgtgcatccttcatggcgctttctggctgaacctatggatgaccctggaggaccccaatgtggctgttaatgtctagccaaacgtggcactctagggaaacccatccgctgccttggtgggttcagggggctggagaagggctgcacgtgctgggtttgggctgatttctttctttctttctctttctttcttttttttttaagtcacttctttgtctgcgtgatgatcatttttaaccacatcttctgttttctccccctttctcttccagataaaaatggaagtaaaaatctgggaaaatttatttcctctcccatgaaagagaaaggaaacattcaactctcttattcagatggtgatgattgtggtcatggcaagaaaattaaaactaatatcacacttgtatgcaagccaggtaaaaattttaaaaaagatgaaatcttttctggcttctgccagaggtcctgcattcttcatatctctgttcctcatcagtcactgcaaagctgatcagacagattggcatggtgttcagcattttgagttccagactctggcgatgggagataggtcatttggaatttttccctcatcccctcctcaaaaccaaatcagaaatggagaaaccagatggtgtcagaagggagttgtgggtctcagcgctgtatcctcttcctcgggactgatactcggccagtcatgtggttacttaacttccttcaaaggggaaaaaaatcataaatggtttaaaacattgcccgtgatctcaccacttaaacacaatgttaattttcattacctttatttatagatgtatgttgtttttaccaagtcaaaatttttatggtaacaaatcttaatgtttctcaaagtgtagtattttgtaaatacttttctatgtttcacagttccattaataatttttaggaacttccttgttgacatggtgtggttttactatttttgaacattttccttattgttggattaatagcgcgtttccagtgttgctaattgtgctattatgtatcctctctctacctcccattgaaatatttcctttggataagttcccagctgtgggataaagtcagaagctagggtcattttgtttgtttgttttatatggtaaaatatacaacataacgtaaaatgtaccatcctaactgcttttaagtgtgtagcttggtgacattgttgtgtaataccaccaccatccatctccagaactttttgatcctcccagactgaaactcagttcccattaaacacgagctctccattccctctcttctactttttgtctctacggatttgactgttctagatacctcatataggtggaatgctacagtatttgtagggctgttttttgacccttctatgcattatacctcatttcccactgtcccttccaagtctacttctagcagagaagaatgaggtaagatattttaggaatgaacggattagtgatccccatctcttttccccattgacaggtgatctggaaagtgcaccagtgttgagaacttctggggaaggcggttgcttttatgagtttgagtggcacacagctgcggcctgtgtgctgtctaagacagaaggggagaactgcacggtctttgactcccaggcaggtctgtgtccaagcaggacctctgctttaatgtgacttggaaccacttaaggttttttccttaacattctgtgtgaggttttcaaggtgacccgccttagaattttattcatgctgtttgaacaaaattctgaacatccgatgtttgaggcttatttgagatactgaaaatactatcttaaattcattattgaggtggttttgctgaatgcaaaaccttcggaacacaagggaataaattatgtttgaaaaggctttcgtgtgaattctaggcaagaaacctctctgagggagaccttacaagaaggccataatatcatgctcgtcctactttgaacatgctgttgtttattagcccagcagttatgggctttgaatagcgctttaggctaacccagtagaagggaatggtggagttggatccatctccaaggaaaatgttagtaatcgcggttctggtggcctcaaggggcagcgtctcttctgcctcctccacttcttcctgccgttgggaacctcctgggaagaacctctccctttcaaactgtggggtgagaccactctgttaactgtcggactgaccttccatacttttattgtttttattctttcttagggttttcttttgacttatcacctctcacaaagaaaaatggtgcctataaagttgagacaaagaagtatgacttttatataaatgtgtgtggcccggtgtctgtgagcccctgtcagccagactcaggagcctgccaggtggcaaaaaggcaagtagcttctcagttctgtttcattcttaggcattatatgctaagaaatattattttcaggaataggtgtgttctcacttaatgtcattgctttatgacaagcatttaaatactgatgagacctggtctgaaaactgaaggatgttaggagtttaatttcccagagaaaggagcaggcccatccttgggaaagaagggtggattgaggttatgcctcactattgcgcattttgtgcttctcagtgcctagatatctctgtgcgtatttctgcattctgcgtaactgcagttcaaatgaagtgagttgtctaaaccagcggtgccaagaggagatttgggtcccagtgttcctgctgccgttggagaccttgtgtgggttcctgtggtctgcagcccgggcctggttctggtgactcctcacgtcgctcacgggccctcccttcagtgtggcagccttggagtgcttctgcccctcaggtctttgctgagagaaacgtgtgtttatttcagtgatgagaagacttggaacttgggtctgagtaatgcgaagctttcatattatgatgggatgatccaactgaactacagaggcggcacaccctataacaatgaaagacacacaccgagagctacgctcatcacctttctctgtgatcgagacgcgggagtgggcttccctgaatatcaggtaggaatgtttgttcctcatcgcgctccctgaggatactcatgcctgtggtgggcctttcatttaagcagagcttgtatcagtctgggtttccagccaaatcatcaccgtcattagatttgccagggtgcctgggcagtattagtattttaagctgtttatttagtgggttgtgcaccttaataacagcccacaagcctgtcagttttgggtacaaaacatacaaaagcataaaaaaaaatcctgaattaacccccacttagcagaggctaaattttcatcctgatttgttactggacagtcttctttttaataaaatgaagggagatgggcagactaagcttttcttcacagtttctcattgggaacattgctctcgtccttttttgaatcctggttttatgtcacgtgtctttctctttttgccatccctccgcgcatctgccgtggattaggaagaggataactccacctacaacttccggtggtacaccagctatgcctgcccggaggagcccctggaatgcgtagtgaccgacccctccacgctggagcagtacgacctctccaggtgaggcagagtcagctgctctgtttttggcctggtacagatgctgaggttgcaagtgttgctggtgagcgtgtgactgagctgatgatggggagtgatgctggctgtggggctgcaggaccaaggtggggcattttcagcagagtgaattctaataactgtctggtcgcctttgggatagcaaccagtcttggccacagcagagcctcggcctttagcttcatcatttaaaacaatgactgtcagtgcagaggcacgggggacagttaaggtccactgcatactgagttcagcgaaggtggagtgtaatcctggtgcgtcatgcgcccagacaagccaactcctggtagtgtgattggtggagcatgttttatttggtagctttacttccccaactacatagaaataaatgagactgaaatgtgtaagctctttaaaagcatatacattttgctttgaaattttagtctggcaaaatctgaaggtggccttggaggaaactggtatgccatggacaactcaggggaacatgtcacgtggaggaaatactacattaacgtgtgtcggcctctgaatccagtgccgggctgcaaccgatatgcatcggcttgccagatgaagtatgaaaaagatcaggtgaatctgttttcactgcttgtctcctttgccctcctaattccatgacttagtgggaggaggtggttattctgggacatccagatcaaaggcagcacagctgctcgagagaaaccctctgagtaggagtggggcctccatgtgaactcatctgcctcctgtaggagcagaagtgtgtcacacaggaatcattgttcacatggagaatgctgtgttgcagacttttgatcacacaaagggcagaggaagcaccgaatggttatgtctagcctgaattcaaaagtgtctttaggtgctttcagcagacacctgtgaaaaagagagttttgcttccaaaagctcttgtttctggattgattagggggaaaaaccgatttgggagagttgctgtggatgaaccagattcaagcacacgctctcattcgctgcagttcgtccctgggttgaatgcagtcaccgccagaacatttacccgtctcctgtggtcgttgtacgtggtgaatcttaaaagagatgtctctggacatctgtattggcttctgtaaaaatagcatgttgggaatgtacttttcttggtgtatgctaatggcagcttggaggtttttgaaaggaaggtggcaagtgtgctctggtggttaggaatcgagttcctggttgtgtttacctctgcacatgtgtgttctttactggagcaatgagttcagtgtatagtcagtcctctttattcacagattctgcatctgtgaacttgcctacttgagaacacgtgtaactccaaaatcaccacgcggaacactttctcagtcattgttggaacgagtgtagtggcccaatgtgcatagtacccgacaagcctgttcctggttgaagttgaacagggggacactctggcctcttgtttctgcctcaccctgagatgagcaggggatggagagggcgaggcagtgcagtgcaaaagctccagccctggggccagttggacggggtctgaattccaactctggcatctcaactcagagatgctccagagctggaacttccgcgctgcactgcctggtaaggtctccctaagagaagtttcttgcctagaattcacactaaagccttttcaaacatgacttactcccttgtgttcggaaagtttagcggggcagccttaggtgagccacttaacactccttaacctcgtttttccttctgtaaaataaagagagtagaatctgtcagcatgagttgtcttgggatttcagatttataatctgtgtgtaataggtttgtttgcctgatgtgcggccagtcagtacgctgagacattggggattacagccgagaaagagtttaattgtagggcaggcgaatgaggagatgagaagaaacctcaaattcacctccctaaggaatttgggttgagggacttaagggatttggagcgggccaaggtgtggggattgtttattggtagaagagtgcagggtgaagtcatcggatggggagatgaagaaactgcatttggttccctgtagggaggtcttcatagtggttagtgtcagccgttccaccggaattcaggatctgaagaacatcttacacgattattgaacgaaagccttatgattccaatgccagtgattctttctgtagcaataatggggatgtgactagtatctagtgctatgtgactttcagttacaggccagcatgcagcctgattggtgctcaattgcatgcctggaacgcagcatgcagttgttgttaactctttgaggatggtttcctattccatatgtaataaggggatttccccaggagcagtggttctgtattcaataattcattgtttgctgcagctttatagaatgtaaccaccaccaataacgaatcgactgtatcttcagggggaaaagcctaacaagactggttttcttgcagggctccttcactgaagtggtttccatcagtaacttgggaatggcaaagaccggcccggtggttgaggacagcggcagcctccttctggaatacgtgaatgggtcggcctgcaccaccagcgatggcagacagaccacatataccacgaggatccatctcgtctgctccaggggcaggctggtaaggcactgctgctggctggtgaccttcactgctgcattttttgactgagcgttgccttatgtgtctcttaacagcagcagtcttggggtgggtggcggagctaggccagtcttagttctgcttaaggtcagtgtgcggtatatatgttcacaggcagggagtgatttgtggtaccttcatggctgcgatttctgaagtgtaagcctcatcttttgctgcggagtttgaggctctggtgacatacactgtttcctggattttttttctgagtcgtacagacattatcttgcctcttagttcttgtgagttgaggatcgtggcagtggaacggggcttagagatagtttggtcctgtaggggccaagggaaagcttccctttcaccctttgaagtttccctgaaaatcagctgtcaacaggagaaaagacattaaaattttgacgtgcatagcaccggggaataaatagcaggagaaagatgacccagtagcctaatgcaacacagaaggttatgtaccctatttcacaggggagagggagataggggatgtagacagttcttttgacggggcagcaaatgattatttgggagaaagaatggacagaaattaacttgcaaatgattctctttggagcctgaatgaggaaggcattatcttgtgcacaagtctgtccaggtgtgattgctgtcctcagtcttcttttgtgggatagataatgagatttccgagtttcttttggaaagaagccttcttggtcaggtaaggaaattccagagaaagtctctccctgtgcttgagggtggaggtaacaaggcacggttcaaaggatgaccttgattctcaggcagcttctcagcatgtcaaagcactgatccttggggtattgctttctgagccccagcagtccaaaccacaaagaccacagataggaatctgaggcttggtatagctcaggcctgtgggtgaacgatgagggctgtatgtgtaatacaaaacaggaataagaaattaaggctgagggctgggcacagtggttcagatctaacccagcactgtggaaggccaacatgggaagatcactcacttgaggacaggaattggtgaccagcctaggcaacatagtgagaccccatctacaaaaaatttaaaaaaaaatttagccaagtgtggtggctcatgcctgtagtcccagttactctggaggctgaggcaggaggattccttgagcccaggaggttgaggattcagtgagccatgattgcactgcagcctgggagacaaagcgagcccctgtctcaaaaaaaaaaaattgggaggcagaggtaggaggattgtttgagcccaggagtctcagactagcctgggcaacttagtgagaccccatctctacaaaaaattagccaagtgtggtgatgtgcacctgtagtcctggctacttgggaggctgaggtgggaggatcacttgagcccaggaggcagagattgcagtgagctgaggatgtgctactatactgcagccccttggcaacagagcaagatcctgtttcaaaatagtaatcatataaacaacttcagcaaagtctcaggatacaaaatcaaggtgcaaaaatcacaagcattcctatacaccattaacagacaaagagagccaaatcatgagtgaactcccattcacaattgctacagagagaataaaatacctaggaatccaacttacaagggatgtgaagaacctcttcaaggagaactacaaaccactgctcaaggaaataaaagaggacacaaacaaatggaagaatattccatgctcatggataggaagaatcagtgtcatgaaaatggccatactgcccaaagtaatttgtagattcaataccatccccatcaagctaccaatggttttcttcacagaattggaaaaaactactttaaagttcatatggaaccaaaaaagagcccacattgccaagacaatcctaagcaaaaagaacaaagctggaggcatcatgctacctgacttcaaactatgctacaaggctacaataaccaaaacagcatggtactggtgcaaaacagatatatagaccaatggaaccgaacagagtcctcagaaataacaccacacatctacaaccatctgatctttgacaaacctgacaaaaacaagaaatggggaaaggattccctatttaataaatggtgctgggaaaactggctagccatatgtagaaagctgaaactggatcccttccttacacctgagacaaaattaattcaagatggattaaagacttaaatgttagacctaaaaccataaaaaccctagaagaaaacctaagcaataccattcaggacataagcatgggcaaggacttcatgactaaaacaccaaaagcaatggcaacaaaagccagaatagacaaatgggatctaattaaactaaagaccttctgcacggcaaaagaagcatggatgaagctggaaaccgtcattctcagcaaactatcataaggacagaaaaccaaacactgcatgttctcacttataggtgggaattgaacaaggagatcacttggacacacggtggggaacatcacacaccagggcctgttgggggctgggggggagggatagcattaggagaaatacctaaattaaatgatgagttgatgggtgcagcaaaccaacatggcacatgtatacctatgtatcaaacctgcatgttgtgcacatgtaccctagaacttaacatataataaaaaaaggtattaaaaataataataataaaatgaattaaggctaggaggtagaggaggtgagtgggattgatgttggccctgagttccttagccaggggacaacagcagactgtgtggagtttgctctgctcttctctccatggaaatgctttggggccattttatacagtcccaattgcttctgttttttaattggggtaaaatatatataacattaaactgaccattctgactgtctttgggttacatatattatacacatctctggtgtcctgtatttatcaccagtatccatgtccaggacttttacagggtcttgctgtgtcacccaggctagcgtgtagtgggtgtaatcattgctcactgaatcactgcagcctcgacttcctgggctcaagtgaccctgtcacctcagcctcctgagtagctggaactacaggtggagttacctgtagttatcaaaatggtttttaaattttttgaagagatggggggtctgtctatgtggcccaagctggtcttagaactcctaggttcaagcagtcctcctgcctcagcttcctaaagtgctgggattataggtatgagccaccatacacagcctagaagttttttgatggtctcaaatctaatttggaaaggagagctttatttctcataaagatttgcagcctgcagggtggccatttctgacaggctgggaagtgtagcctcaggccagaagccagaaacaagcgctgggagggaggaagactaagacacgaatggatgctgaacaggttagtcaagtatacatattcagcaggttacaggagcagctatgcatattcacgaagggatggcacacacatgcgtggtaggcaacatgtatgcagcatgtgtccccatgttcattttgggttgaagacataacatttaaatatattacagttgggccctgtatgtcgaaaggtgaagcagaggacatgaaggccctctgtgtgcagcctccttagaaggccaggaccacctgggagttgtggtctcttatcagcagggaatgctggtcgattgttgtgttgtcagaaccacaaaaagggatggacgttgtcaggtggtaggttgataccagcagcagagtctttcaaaagggtcggcttctgtttagcacttagggaagaaagcctagtggttaacgaggaaaggggtgtaatggggtatgtctcacctcccaccccgtcatggacaggaatgcaatttttaagtttctctggagtccccttggctaagagtggggtgtgttcagtcagttatggggcttaggattttattttcatttcttattacctgtagttttaggtttataccagggtcatgtgtttttgagaaattatcaaatggttaggagagtggagagactggaagccatgttcattatcaactaaattattaacaatcccttgttaagggtgtgtggcagcttcctcaagccccactgaaatgagccagcaggatgcgttctttccctgcagtggcccagtggacgctgcgtcactcacctgcctggtctgctttgtcattggctaacactctttttcctgagagacacttcctttagagttgaagatctcggtgatcagggaatgaatgacgggcaggctgagcttggcccatgctctctgcgggaggtgttctacccaggttgtacacactctccttgggttcacctgagcttgggccgcccacttcttctctcagtctcaggaaggatccaggtttggtgttccacggggagatgcctaggttgcccagttcagcctgctggtctgtttttgggcacatctgtgcattccctgcctgtggactgccccctccttctctggtttcttgttgccattgagacactgggtagttccagaaagttcttggacccttggttttccagcttttctgtgataccatatttagtttacagggtagcttcacattgttgtcgtgtctctcagcactcatatagggcctgcagcacaggaaatacactcactgaaggaagaaagggccgctctcccaggggtttgcagtcacagaactttcacaggctaaagctcagtccctttcacaagcacattgtgaagtggaaggagcaggtgtgtttttattctactgctagtgttgctgaggcctggagtgggtgggggctttcaagggtagagagcccttgacggccaagggtgtggactcagtgttagtggctgttgttcctgaacccgtgaccctgggcaggtgtcttaacttccttgtgcctcagttttctcatttgtaggctgtgtttgtgggtcactgtgaggcgcagttgagaaatactaacaaaactcatagtgcagtcctggtgtgtgataaacactccctgatcggcagctaccattgcctgtgtggtggtggtgctctcacaaagctaatggctctttgggggagctttttatggaaacatacacaccgaagggcacacagatgataacgtgacacagctgggtgagtgtccataaactacacatcaagaaagaacatgcttccccctaggagccctcctgtgccctcttcctgccactgctgagcatcctcctgacctctgacagcgcaggccattgttgcccaatcctgagctgatgtcagtgaatcctacgtaccgttgcctttgtgtatggcttcttgcattcaactttttgtgtagggtacttttcagaaccttgagctcagacctaggtttggatctgaattctaccatttactgctggcacgatttctatatttctgaatatccaagcgtaggagattattttgtcttcatagggagaatgagaacattaaattctaattaggtaatgcacattaagtgcctagcttattggctgactcataataaacatctagcagattttggctatttttatgtctcaggcgagtattcttttggttctatcaagttccatgttactgtattgacttttaccctggatttgcccattcagaacagccaccccatcttttctctcaactgggagtgtgtggtcagtttcctgtggaacacagaggctgcctgtcccattcagacaacgacggatacagaccaggtacgtgtgctttcacctggccctcgtgctgagctgcctgctggacatcctcaactcaccccagtgttccagctctgaaccgacccctgccccttctttctgaatcagttactatgttgcattgacaatgggtgtctgcaggtcacccagagttcctctccactccgcagctcccagctcctgggataagaaccaggtccctcagtcttactctctgctcactgtagtttccttccttttgtttccattcctttgtgccttccatgtggcagtggtatcctggtgggctctggggcttctgcaccaccggcagatgtctgactagtcgatacgtcactccacacctaaaccatctcagtgcctgtcccctagagggtagagcccgtatgttttaatgtgaccctatccatagagcacagcctgcaggtgttaatgtgatcctgtctatagggtaaggcctgtgtgtctctcacctgtgcataggccagagcccacaggtgttaatgtgatcctgtctatagggtgaggcttgtgtgtctcaccgtggccctgtgtgtagggcaaagcccacaggtgttaatatgatcctttctatagggtgaggcctgtgtgtctcaccgtggccctgtgcatagtgcagagcccacaggtgttaatgtgccacttgagtctctcagtgcctactggctcctcccgccttctgcccgggtccatgccctccacttgttgagtgcaccctgcagggcatagtagtaagctgctcagtgacgttctctctgacctccccaaggtagtgagttgttttcacagcaccgtgtatatttctttatggtgggacctgtttgccttcccacttcctgttctaagctacactgcagactctggcagcagagaccaaggcttttccaaaccaacggccccagcacagggtcctggctttgtaactgctcagtgagggcaggatgccaggcaccctgttcatggacaatgtttctggggctgtggccaccgtctccttccctgcattcagtggacagagggaggcccagggcaaagttaaatatggagaggagaggatatcatttgacagtcacctggtcatacttcccatgattaccttaagggaataattgagacagaaaacagaacatgagatttcttaagatgtttattttctttaagaaactaatttatgagtcttatatttcctctccaactttagggagtagcaatagtcttcttagggaaatgcagtagccttaacagcttccaggtgagtgtaatttctgagtctgggctcacacttggtatacttcagggtggtgtatttgaagaggctacatgtagggctacatttttgatagggattttgaaagtaaatggagaaacagttttgtcaggtgcatacttgcaggtttctggaggtgctgtatgtatgttatgttcctgtggaattggtttgaatgcgcccctttttccccattttgtttcctgtaggcttgctctataagggatcccaacagtggatttgtgtttaatcttaatccgctaaacagttcgcaaggatataacgtctctggcattgggaagatttttatggtaagagcgatatgatgcatttccagtttgctttgaaacagggggagagtgcattattgaagtcacctgcacgtggtgatatgagagaattgcccaggccactgtggtggcagctcttactcagaaggagatgggaaaatccagatttaagggaaagatgaagtaaaaccatttaccaccattctggcacagttcagacgtgaagactgttattcttcaaataataagttgttctctttaaggaaacactttctaaaggtagtgctgaagcctgtactcattgtccattggtctctccttactgtatcttcacaccagagagcataattgacttcatttttacaactataatataataatttttaatggaataacaaatttaagaaatgtagggtaccactttatatttacttgtaattaacatgatttcaatgatacatactttctcataattgaaaatattataacattatgacttctgtgtcttccctctcttatatatggtacattattacatgcagtagatcttacacatttatagatacggggatgtatgaatttaaatgatgtatagatactaaaccttaaaggcagtttatagatactgccctttggacttatgtactaactgtactaacatgccagaaagtggaaagttggcaagttaactaacaaataagaaatgtttaacctagtgggatttggagttgctagggttcttgtctgtggtgagatacgaggcataaatttgtttgtatggctcttaccgtctgacctgcagtttaatgtctgcggcacaatgcctgtctgtgggaccatcctgggaaaacctgcttctggctgtgaggcagaaacccaaactgaagagctcaagaattggaagccagcaaggccagtcggaattgagaaaagcctccagctgtccacagagggcttcatcactctgacctacaaagggcctctctctgccaaaggtgagctcagagccatgttgttttgtagctaaaaagggccctggtggctctgtggctggccatgcaccttcctgagtgtaggatgtgcacatcccccgccaccatgggctgtgctgtccaccttgctgcaggagccatcacggtggtcttcctgcgtttgacctcgcagaatacaggggtcccgttatccgtggcttcacttttgtggtatcacatggtccgaaaataataaggtattttgtgagaaagaatgagagaaaccacattcacgtaactgtcattacagatattgttacagttgttctgttttattgttgatctcttgctgtgcctagcttacaaattgagcttcatcctctgtatgtgtgtataggaaacagcatagtatatatagggttctcaatttcaggcattcactgtgggtctcggaacatatccccccgcagataaggggggctgctgtagcctgtattcaacacagcagtcagagtgatgtttctgaaacatcacatcatatcacttcccagctcagagccctcggaggctctgcactgtacctagagtagaagccagtgtccacagtacggccatgggacgcccgtgggggctctctgagatgatcaccccctgctgctcttcccgcttggcccgctggcctccctgtttctgatataaacaaagtgcactgtctcccaccctcccctcttgaatctttgtacttgctcctcgctctgcaaccagcacagctgcaggcaggggttttcgtctgcttcattcattccgatacatggtaggaacttagtatttgttcaataagccaacgaattagagttacattgtcttctaatgcttggattggtaaactcgtgggatttaaatattttctggaagagtaggaatgccaggatgttaggcttatggtagaaacctgtcataacataggccgctgttgcagtgtgtaaagctgtcatcacataggccaccattgcagtgagtgtgtaaacctgtcataacacaggccaccgttgcagtgagtgtgtaaacctgtcatcacataggccaccattggagcgagtgtgtaaacctgtcataacacaggccaccgttgcagtgagtgtgtaaacctgtcatcacataggccaccattggagcgagtgtgtaaacctgtcataacacaggccaccgttgcagtgtgtaaacctgttgtaacacaggccactgttgcagtgagtgtgtaaacctgtcataggccactgttgtagcgagtgtgaccactttgttcatgtcgagtccctcgatacacacttggtgccctggtgtcattgctcccacgaacggctgtgaagcttgttgccagtggcagccttgtcctgttgctgcactgtgcttgtgggctgcgccatgaatactgttctgtctcttaaaatctgggccttcttgctttacaggtaccgctgatgcttttatcgtccgctttgtttgcaatgatgatgtttactcagggcccctcaaattcctgcatcaagatatcgactctgggcaagggatccgaaacacttactttgagtttgaaaccgcgttggcctgtgttccttctccagtggactgccaagtcaccggtaaggccgtgcggcctaagaactgagaggccggtcaagagtcagtgtgtgtgtgagtggatatgaaggtgtgtttctgtgtgtatgtatatttgtgtgtgtgtggtgtgtatgcttggttatgcaggcagcgtgacatttctgttatatattctctttgaatgatgcctagagttgtaatgtttttcttgaagagaatctgactatatagttaatggttttaagctatcttttgggatcagatacatcttaagaacagagaagaaaatgcagaggaaacacatttcacatgtactgtcagagcttcttatttgagggtgaaaaaaaaagaaaaagatgttaaactccctaagctgtgccctggaagctgacagtgtatacaggagaccttgacctctgggattgaccctgcctgctctgcaacagtggtacttccttgtcaagggcagtgggggtttggcttttttctttaaagagtctttagggactcactatgttgcccaggctggccttgaactcctggtcctaagtgatcctcctgcctcagcctccaaagtagctgactacaggcgcatgccaccaggcccggctgtgaagggcagttttgagggacagagtgggtgtgttttgtaggcaaagcctctcagcctcccgtggatttccttatcctcacagttaggaatgccaggttcacgcctcctcagggcttatttagggtgaaaggcagttcttgagtgctcacaaggaggcagagttctccagcgtggttttttgttgtgtttcagacctggctggaaatgagtacgacctgactggcctaagcacagtcaggaaaccttggacggctgttgacacctctgtcgatgggagaaagaggactttctatttgagcgtttgcaatcctctcccttacattcctggatgccagggtgagttctccttggtctcttgattggcgtctgttcattttattagagcatttgactcaaggtcatcgccttcctcatgcccaaaccacttattctgttcttccaggcagcgcagtggggtcttgcttagtgtcagaaggcaatagctggaatctgggtgtggtgcagatgagtccccaagccgcggcgaatggatctttgagcatcatgtatgtcaacggtgacaagtgtgggaaccagcgcttctccaccaggatcacgtttgagtgtgctcagatatcggtgtgtgttcagaccagcaatgagatgttgtccccgggtgactccatttcccatttcccttgaacctctgaatcttctatcttgtttaaaacttgcctgtgttttcgtggagtttcagccattgctagggtttgacgagaatgcactcatttcttcaggtcttaaatgtttaataaatgttacgtagtttgcacatggaggtcaaagattgggtactaactgtggctatcatttatttaatttttttttttttttttttttttgagatggagtcttactctgtcacccaggctggagtgcagtggtgcaatcttggctcactgcaacctccgccccccaggttcaagtgattctcctgcctcagcctcccgagtagctgggattacaggcacctgccaccacgcccagctaacttttgtatttttagtagagacggggtttcaccatcttggccaggctgatcttgaactcctgaacttgtgatccacccgtctcggcctcccaaagtgctgagattacaggtgtgagccaccgtgcccggccccatttgattaatttttaaaataaacaggaaacaaatcaggctgctgatttatattacagggctcaccagcatttcagcttcaggatggttgtgagtacgtgtttatctggagaactgtggaagcctgtcccgttgtcagagtggaaggtaggactgggcctgtccctacaagtcattttaaatgtatagagtagcagacgttctgaacgatgccttagatatgagaccgtgtgataacagccatagctggggtcatgagacacacgctagggggaggataatttcttttccttgagcttttttttttactgaagcatattgctaatttcacgagtgacattttccttgtgtgcctggattgatgggattttggcgtctgatgcttgaagacactaatgtggggtttggttttgtgttgtttgatgaagcaagtctttattcggggacctagactttcctagaaagctgtttgccaggcgatttgtattatatataaacaaaatcatgtggaaatggcttttaatgcccatttatagctggtatttacctaaccaaaaattgtaaaagtttttttttttttttttgagaccgagttttgctctgttgccaggctggagtgtaatggcgccatctcggctcactgcaacctctgcctcttgggttcaagtgattctcctgcctcagcctcctgagtagctgggactacagggtgcctgccaccatgcccagctaatttttgtatttttagtagagacggggtttcaccatgttggccaggatggtctagatctcttgacctagtaatccacccgcctcagcctcccaaagtgctgggattacaggcgtgagccactgcgcccggccatttgtaaagctttttgcttgaaaatgtgaatgcgtgtgtggttgcagttgcccttcacttcttccatgttcttgaaggggacaactgtgaggtgaaagacccaaggcatggcaacttgtatgacctgaagcccctgggcctcaacgacaccatcgtgagcgctggcgaatacacttattacttccgggtctgtgggaagctttcctcagacgtctgccccacaagtgacaagtccaaggtggtctcctcatgtcaggaaaagcgggaaccgcagggatttcacaaagtggcaggtaccattgtttgtcgttttccttttgttgcaaaggaatggaattaaaatattaaaatattttgctgaagatgaattttcccttgagtcagaaacatgagtgttctactgtaaaaaaaaaaaaaagcatattaatgatatttcggattttgcttgattttcttaaacagagtacatactgaaggatgttggtagagcatgtctattttattcttagttagccatgccagttactgactctaaggtcatatttctcttctttattacaacgttgggacacagtgagctagccagtgttggatgttctggggtagtacttgatagcattgagtcacagggaatgcatttagtacgaggtttggctgtagaaattacagggcacgctgttggtcattcatgctgtttcagcagttgggcaagatttaaatacatttaggaacttgtaaaaatgaagtcaaagtagctggtggtgagtacgtggacagccctcaggcacagtggagaaagtgacattcccttaggtgatgaggctaaggaatgcctcatgtcatcatacacgggtcagtctgtgacgttgcagcagccttggacaaggggaagcctgattttattcccaaagtgtaatgtgacaggagtgcatggtatggtgctgggaggccagggatactttgtctcacactcttcagggtgtgtggtgtcacatgtcttaggctaagtttgacagcctagggacccgaaccaaaccttgtttaatgttctccttctttacaggtctcctgactcagaagctaacttatgaaaatggcttgttaaaaatgaacttcacggggggggacacttgccataaggtttatcagcgctccacagccatcttcttctactgtgaccgcggcacccagcgggtgagcatgtaccgacggccctcagcggggtcttctccccaccctcaggctgctgggatcatattagaaagaatctgtcctcagatctcatcaaatctcctggttaactgagtttaaaataaccatttacagaaaatatgttgaaactttcatcagttagtattgattttcatgaacgtaaccattctttactattttcattcttaaaactcaaagtataaactaaagttttgcattctcacttttatatatgtgcctcttaacttttttagccagtatttctaaaggagacttcagattgttcctacttgtttgagtggcgaacgcagtatgcctgcccacctttcgatctgactgaatgttcattcaagtaagtccatggatgtgttgtctcttttggacagactaacttggtatgattttgctttaataattagtggtcttgggtgcaggggattagattagtcagttaatttacctaggactcggtttgctcatattaaaatgaggagtcgggctaggttaactctcagctccgtcaccacctggagctgctgtggtgactgcatggggaagggattggagctgaagcagagagtggacccctggcactcttgcgtgatccacatgtcagtgagcagagtgggccaggagcggtgtggtgacccctgcgatgaagggaggtcttcgttgcatgtgatcgtccacagagctgctctcaacagctttgccagatcgccctctggacacctggggtcccatccttagagattttggttttgtgggtctgcggttctgttttttggagggatgccctgtgttctgccgtgtgaaacacccagtatgagccacttgatcactgttgactttcctgggggaaagtgcaggtgattctgtttccttccggcctttgtcctgttgtgtcatcggttatttatgtaggtgaaatcatcatttaagttttaggaacgtatgtaaatgcaagcatttagtaatttatgttcagtgactttaaatcataattttagtaaccttaccttttccagttaacattttgtaaatattttcatgtgaaacaaatttgtttctcatttctactggatgggaaatgtcctcagtagatatccccagttcacttagcagttctctttctgccatgtgaggctgccttcagttttctgatatttatatacaaggaataaaattttgattttctttgcacataaagcatttttcctagagatatgtgtatgtgtgtgtgtgtgtgtgtgtgtgtgtgtgtgtatatatatatatatatatatatatatatatgtattttttttgagatggaatctcgctctgtcacccaggctgaagtgcagtggcgtgatcttgtctcactgcaacctcctcctccctggttcaagcaattctcctgtctcagcatccctagtagctgggattacagacaccaccatgcctggctaatttttgtggtgtttttttttttttttttaatgagacagagtcttgcactgtcgcccaggctggagtgcagtggcgtgatctcgactcactgcaacctccgcctcccgggttcaagtgactctcctgcctcagcctcccgagtagctgggattacaggcgcccgccaccacacctggcgaatttttttgtatttttagtagagatggggttccactatgttggccaggctggtctcgaactcttgacctcgtgattcgcccgccttggcctcccaaagtgctgggattacaagtgtgagccactgagccagcctattttttgtatttttagtagagacagggtttcaccatgttggccaggctggtcttgaactgctgactgcaggtcatcctccgtctgccttggcctcccaaagtgctgggattataggtgtgagccactgcgcccggccttcctaaagatatttttatgctaagtttttaaaagtagaattaaatcagaggagaattttataatctcataataaaagttaatatatgtctattgtaattgagagtccaaaaatattaatagatgaaattacccaccctcacctctccctccccaacccctagcttcactccactttttactgtttcttcttgtggttctttttggaaccttctataactctaaacctctgtttgtcagcttctaatggtgtctgttgactctcttttaaaagatgaaagctgtcctcacctgtgctgttctcctctcctctttcctctgccttggctttgttagttctatttctgtttcttctgttgactacttttagagcatttggtgatattcactaagctctgttcttgtcccatcaccttcaggcagctttcccttcctgccacctgcccctggtttgggcactcctcctctcgtgcgtgcagtactgcagctgccactccgaggtctccttgccatgtcccttgtcacacgtttggttagtcccacacagtaattagaatgatcctcttgagatataagtcccaccatgtcgctcttgctgaaaccttcaatgcagtgagcgcccatctcattgggacctacaggctgaagttcttcctctgatggacatgacccccgtgttgtctctaataacctcactttcactctgttccagccacacggggtttctgtctttctcgggtcatgtcgggcttatgtgcctcgggccctttgctcatgctgttctctgcctgggatgcgctttactgggtgccaggatggtcagtgattccatttctctcagagtctattcacaggtccccttctcggtcacgccttctctggctccactgtctaaaatttcaacagctgcctctgccccccgaacttcatatcccccttatctgccttttttccttcagctcttacttccatcaaatacagtatgtatttttaaaagtcttatcttgttcacggtcattttcttccacaggtaattttggtaaactttgtaagattgatgatgtttaatactgttttgtttaatacagtacccccagtttagcacacagcttttgaatgaatgaccagtttttattcccctctgaagcgctaagagctgccgctgaggtggcatctgtagctgctcccgttcctgctccgtggtggcagagtgtgtgtctcactcactgttaatattgctcctggcatggggttggttcccagttactgtctgtatttgggatttgtgtagttagtgaacctttagcctgtgcagaaaggtcagcaagcccattttaatttcagaatttcagtaactgctggcggccttggttttaaacaacaggtggcgtgcggctgccccgggcatggcccctgctgtgtgtgctcctagcatcttggctgcttacctttgtcaccagcaagttccacttctcagtggcctgagcacagacggcacgcactttgcagacttgagtttttctgttaaaatttaaatttttttttaagtgagcctaatagtttcctgaactattatgttcagggaagttatgttgttgctgattctgatggggggtgtgtgtgtgtgtgtgtgtgtgtgtgtgtgtgtgtgtgtgtgacagagacagagagaagtcgagtctaaagttctgtcaggcttagactatgcctgaatacttgaacgtttctagacagagtgcccaatgtttaaagagaatacgaccaagcctaactaactgcgggttttcttcttttcagagatggggctggcaactccttcgacctctcgtccctgtcaaggtacagtgacaactgggaagccatcactgggacgggggacccggagcactacctcatcaatgtctgcaagtctctggccccgcaggctggcactggtgagagagggcctcctcgtggggtggtgtttgcagtgagtgtatcacaggccagcactggtgagagggggcctcctcgtggggtggtggttgtagtgagtgtatcacaggctggcactggtgagagagggcctcctcgtggggtggtgtttgctgtgagtgtatcacaggccagcactggtgagagaggtcctcctcgtggggtggtggttgtagtgagtgtatcgaaggctggcactggtgagagaggacctcctcatggggtggtggttgcaatgaatgtattgaaagctggcactggtgagagagggcctcctcgtgggatggtgtttgcagtgagtgtattgaaggctggcactggtgagagagggcctcttcatggggtggtggcttgtcatgagtttatcagggaagatcaagtaggatggggattctttggaggcgctttactctctgcagcatggacgtggttcggccgagaaacagcaggacgaagaatgatttaagggtgttaacagttgatccctagtatggcccagggtaaatcagtgctgaggactgctgggaacatgataaccctttctgaacatgaggagatgaagatataatagatagaaataatagccatggtgaggaatccttcttagcaggtagaagatggggggtgtgacgtggaggtcttggtgtgtgcctgcgtatgttgagagttgtatggtcggtccttttgtgatgcagggacagctcactcaaacctgcggtggttggctgagactggatgtcagctgtacatgggaaaccaagggcacctccagggatcttggtaccactcatggcccctcggaaccctgaagatgaaactcatcccatgttcgtggagtttcatacagccccacctgcatcttgggtggctcacctcaaaggcggtgtggttatttttagctgcagaaggtggttccatcctctgtgtggtttgaggctgtggttccacttccccttgctgcgttgtgctgtgcagacttcgacagtggctgtacccctgtggcatgggactagttcttcacccagggcacatggcacaggcattttagggactgggaaacaggcagaattcttggtagcttcttgaataaagaaggtgcatggacgtaggccatttaaaatgttcctctgtcttaatttgggaatataaccttcatcctatatggggttcagaaagaatttcgactgctacagcctagctattcctctacactcacgcccgcctgccccagtccatctgtgacaaaacagcatgtaagtgagtgagaactaacgtgatgtcattgtcatctgacttatgtgaaagaaatagcaggtattttgaagtgactcttagaaagcgtatgaagttctgcagcgtgtgtgacatttattgcctgatgaagttctgttctagcctggggagtcactaaaggcaactctttcttgtgtctggtgctgcagagccgtgccctccagaagcagccgcgtgtctgctgggtggctccaagcccgtgaacctcggcagggtaagggacggacctcagtggagagatggcataattgtcctgaaatacgttgatggcgacttatgtccagatgggattcggaaaaagtcaaccaccatccgattcacctgcagcgagagccaagtggtaagggactgttcctgcaccttctgctgttgcagctttgggaattgagcccatgtgcagggcggtgagccgcacgtcctcatctgccttgggatgcgagttctagagcctgggatgatgcgcccttaccagaggttgggggaacagcgtcgccgcggcctgcaatctggggaaccctcgtgctgtctggctccttagaagcttgcctggcagttcccgactcagaattggttctcttcagagtttgactcagacccctaaaggctgtggaggagattgttgtttgactacatgcccttttgtcttcacggcggcagcttgggaagcacgagaaggttggctgggcccgggtcacaggtagcgctgccacttcccagccacataacttggttaattactcaggtagtctgccctgctcagccgttcataacatgaggcatacttgtcctgcccattgcagggtttcgagagaagaggtaggaagtgccaggtgtcatttctgacacacgggagatgcacagtcagtgagcatgagtgcctgtgatcagttcttcccttacttgtttggcatgcacgtaagcaggtgtcgactgcatacaggtttttctgtgtgtgagattgtggtgagccccagtgctagcgtgcatgacaagctcggtggctgagttgggcattaactcgggcaagaccagctcgctgggtgtcagggtggctcgccccatgctctccagcggtgggcagcagtggtaggggagcttgggatggggggctccaggagcttcaggcctgccctcttgcctggagcggcagggaagtttcctcttgggaagattgtgcagaggcttagtccagactcatgagctgctggggcctctgagcattctcctctgtgacctgagaggctcatggccgaggacaaaagggctgccccacatgtggggggcaaaggtgagagggtgtgtggggcccctgtgcccagggcccagaaggctgggagggaagggtgaaggggtgtgtggggttccccatgtccagagcccaggaggctgggagggaaggatgagggtggtgtgtgggggcctctgtgccccagacccaggaggctgggagggaaaggtgaagggtgtgtggaggccctgtgccccagacccaggaggctgggagggaagggtgggggtgtgtcgaggcccctgtgcccagggcccaggaggctgggagggaagggtgggggtgtgtcgaggcccctgtgcccagggcctgggaggctggactgcagcgtggcttatcagggtgcccagcaggaatcatggggtttacctgggaaggaaggtgctgctgaactcatcatgctaactctgcagtggacatgaagcgttttgagatgagcagagtaagccttggctggtgccagtgggaggatgcgtggaatgggctagttctcttggtatatctttttgttttgactgtgataatggattttacctcatttggtttttagaattttatcaatgatttacacatttgtgtctccctgtagcccttccagcatcctttgcacgcctgtccccaacccctgtcctgttcctcagcctgagggagcttcctggtcccctaagtgtgttgctgcctgtgggtgtttcacttacctgcaggggaagcccatggtggcagctcaggacacattctgaccctttgcttttcctaatctgcgcctcatcccacaggcacatggagacagaaatgtcacatgctgtggagtttttcagagaagcttccacttgtaagttgaaatcatgatagacatggagtttttgcgtgatcccttcaggacctgtctgtgctttgttgtagaactccaggcccatgttcatcagcgccgtggaggactgtgagtacacctttgcctggcccacagccacagcctgtcccatgaagagcaacgagcatgatgactgccaggtcaccaacccaagcacaggtgagaggtggtgccagtcgttaaccccagcgcaggtgagagacggtgcccccaccaaacccagctcatcaggggagagacccaaagagaagctatgggcagcaggcgccctgggcagaggtgtcatggtgtgtgggtgtgtttggcctttctctggatgggctgctgtgtgttctcctggctctccttcagtggaggagagaatgctcccacagagaatccatccctcctgtcactctcctggtgtgagaggtgctcctgactggggttactgacagtgtcagtccagcagctctaggctctccagggcaggttagagctagcccctggctgcctttcagcatcagtgtagtggattgccaggagtctctcacctgcccttgtgctgggcacccagaaaggcacaggcacagtccattggcagcaagaggtgtgctgggcaggctctccccatgcccaccagactcttagtggctgctgtggtatggcccagcagagggtgctgtgagccacgatcttttcagctaaggatgggacatctcatggatcaagggactgacagtctcatgatacagcctggctgttggtggaggatttaggacaggggtcgtggtgagaagtcagaagtcccgatgctgacataatctgtgtgtgagctcgccgatgatgagcctcccaagtctcagctccctggagtcactgtgtccccatcttcttccaccctacaggacacctgtttgatctgagctccttaagtggcagggcgggattcacagctgcttacagcgagaaggggttggtttacatgagcatctgtggggagaatgaaaactgccctcctggcgtgggtgagtgctgtggtctctcgtgtgttgtctgactctcccgtcctctggggttgtcctcagtctctttgcatgctaatggcaaaaaggatgagcagagccaggaagctgagacgcttttgtctcctgcagcagtcaccccatgtgggggacacatggtcatgtgatggaatgaacattcaatgtaaaacaatggttaaagccggattggacacttgaagttataagtgttggctatgaaattgatggtcctgacttgcgaaagttctcatcagaaaattggccatcgagtctgtgattgtgttttctccgcctttcccttgtggtgcaggggcctgctttggacagaccaggattagcgtgggcaaggccaacaagaggctgagatacgtggaccaggtcctgcagctggtgtacaaggatgggtccccttgtccctccaaatccggcctgagctataagagtgtgatcagtttcgtgtgcaggcctgaggccaggccaaccaataggcccatgctcatctccctggacaagcagacatgcactctcttcttctcctggcacacgccgctggcctgcgagcaagcggtgagttttcagatgggcacgggagaagtgcatgtccagtgcctggctgcacccgggccccttcgtcaggttcacttgcccactagtagatgcccagctgaactgtccactcctgatcaccccaataataaagttgactggaagtgcccagtgctatgtaatgaagcattttgacacctttctactttttttgttgttgttattcagcttttaaattcttatggatgacctagtggtgattaggaaaatttttttgtagactcaaagcagtctttcctacttaacagaccgaatgttccgtgaggaatggaagctctattgttgacttgtctccccttattcatcgcactggtggttatgaggcttatgatgagagtgaggatgatgcctccgataccaaccctgatttctacatcaatatttgtcagccactaaatcccatgcacggagtgccctgtcctgccggagccgctgtgtgcaaagttcctattgatggtccccccatagtaagtatgacaaatccaagggtggagataatttttgcaagacttttagtgataacctttgcgttgtttcttgccttcagtggggagttgctcaagcataaaaaaaatggagaaagtaagtgggactgtgtatgttctgggtccgctactggaagattaaaggtttgcacattgaactgttcgctgatgatggtagccagccagtctttgagcatgggaggtaacacgaatatgtgtgtagggactctacttgtcatgagcctcagggttgacccaaatcaagaagtttttaggtgaagtgacaggaaagcacattgccctagcctggtttctttgtgtgaaatgccttgtcttctgtagttaaaacgcttgcgaaatgcaaacagtttctttggcaaggagttataattaagggcaagagtacgtttgctaatagctaaatattttgccttaaaagctttggttttatgcattaaaaaattattttgtagagatgggagtattgctatgtcacccagccaggctggcctcaggctcctggccttaagtgatcctcctgaagttctgggattacaggcatgagccacagtgcctggcttactagcatgttttaatagaaatttggatctttaaaaattgtctccatgagttatattcatattttgtcaaatccttggtatgttttaatatttgaatgtatctcacaagtcgtctgtatttctgtctgtatcatctattatgctttaaagatggatcctcttgtaacatatctagatgtcctttagaaagatggccattatatgtggcagtgatatggggagatgtcaggagtgtgtaaggagatcggccacagcctgaattagcacagctccagctctgtgtgagatggaggcctggacaagctgagtctccccaggaagctctttggtagcgtcctttctgacagcgcagaccggggatcctcgatcgggaatcattgcctggccacccattgtcaaatgttaaaagatgtagaaagttatttaactggagaaggtgtggtgccacgtggtctgaacgtgccccacagtggtgaatgaagagcactgtagctgagaacaaaatcatggggaagctgcttatacacacactcacacccacatgcacacacacgtgcatgcacacacacattcatcacatacacagttcctggccattcacctttatttactttttaaaaataaaaaaagagttttttgttttttttctcataatactcagactggtcttttatttatttgtttattcactcaaaaatatctcttgggcagccgctgtgtgccaggtgctgtgctaagcaatgaaaatgaacagtgaacacctcctgtcccctctcccaaggacatagccagtggttactgctgggccacgtcagtgggcagtcccggggcagcactgggcagtgagggtggcaggtcagcatggaggttccggccttcccctgtcaggtggtgggaggaccgtgtagcatccttagaggtttttcaggttccgggcttccctcatcagctgatgggaggactctgtagtctccttgatgtgactggagagattcctattgcttaggatctttgaaaattgaagatacctagaaatagaaccaaccttagaactaacgttaggatcaaaacgataaccactgacatacggaggttacacagcatctgtcaagccttccaactggagttggtataaacccagtttctttagatgctgctcattctcagaacctatgaggtctggtttttgcaattctgtatcaattcttaattccactaaccttgggaatggttaatttcctgaaatactgtttgccctcgctctttgtttaggatatcggccgggtagcaggaccaccaatactcaatccaatagcaaatgagatttacttgaattttgaaagcagtactccttgcttagcggacaagcatttcaactacacctcgctcatcgcgtttcactgtaagagaggtgtgagcatggtaagtgtgggcctgtgacgatctagatgctcaactgcgggttagtgagccaaggctagacaaccagaaagtgcgtgtcaggtccaaggatactcttattcaaaatgtctgccttgggtaagatggtacgctagtagtgtgtctgaataatttaaaccactgattgagggctgagtgagctcccccgcagttaacagcatatagaaacttgctgtaatttaaaaacatagaacacaagtatagaaatgacattcagctttgactgctgatgcataaaagtgtcataacttttgtttttactttaacaattactgattttattctaactgggaagtcagaaagacatttgggcagctatagtcactcaggacatagcccagaagttaacaagtaacaaaagacccctggaatcagaatagctacaacaaagtggcaccttttacttataatgaggtattgacttccattttatgtgcattaaaaaaagaataccagcttccattataatgagttcggtattggttatagtctttgaggacgttttcttttgatccctgctctgtgagataaattggtagattatggcccctattccacagggactcagagtagctctgcaggggcagagccaggtcccagctactgcacaggggaacagctctttgctccagggacacagcaccacagcctgtcgtctgtgcttctgaaatctctgaagctctgaaaacttggggctcctttgacatgaatggactgaggctatttatggtgtggatttgtcccacctaatgtggatattgatacatctagctgcagaaatattaatatgtttgatcacaggatctgggggtgtgagaattgcctcttaaaatcctaataaagatgttggattccaaggctcatctgacccctaggagttcaggtgatggattaggatctgttgggtgtcttgtaattctgataaagacatccttctgatgtttgggcctggagcaggtttgtaaagggactgttagacatgggtgtgctgacagtgacagaaagtgacctggcagccgcctgaccagtgagagagacagtatttgagaaggaggaggaaacagtcctgctgtttggggctactccacaggggcccagagcacctcaaagcccttggatgtgttcatgaatcttagagtgtagtgacagtcctagttagtaaggaaaggcagagctgtattcagtccacccattgcatctgtttataagcgtattggcatatttttataggggtgtctgggtgtgcctctgtagatgcacacagcatggggcaacgtggattttgccttgcggggggcttctgcattaagttcttcgttctttaaaggacagtcttcacttctaagacccacctcatcatgagtgatgctttgttatctacaccaccagctaaagagtgtggaactatgccttgctttgactctgctgccaacgtgacaaatcgaattagctaatgtgattttagttaattctcagcagctgcacattgagggtgattagtgtttacttgattttagaaatgaagcatcttatgctgaatgtgtgttctagcgttccagaaagatttttagaagatttttcttccccagcagttttcattttcaatggaagtacttttaccactgaatcatagggaaaaagatgcttaacattaattacaaatggaattcctgagagctgcctcatctttttttgttgctgttgaatgagggagggaataaataaagtgattctacaatacttggcctatggaatatctggccatgtggcatcttgccccttgaataaatgtctcccgtgtctagagacagtagattggagcacttgtgaggcagggtctcagtttcacagacctctctcatgacatataagccctccccctttcttcctttgaacccgtagcacagaacattgaggctttctctctaagtagaagacaagacctggattcagccagggagctcacaggatgtgtagggggcaagggcagggtgatgtctgtgccttgaagatggcattgggtctttcagctgctgttgtctagcatcccttccctctgagaggccgctgtgggttatgcacagcccctgtagggacgtggtgtgtcactgctatctatccctatgccatggggtttttaagacccgtgctcttcctggcaacagggaacgcctaagctgttaaggaccagcgagtgcgactttgtgttcgaatgggagactcctgtcgtctgtcctgatgaagtgaggatggatggctgtaccctgacagatgagcagctcctctacagcttcaacttgtccagcctttccacgagcacctttaaggtaatgcgttcaccctgggcgttgctggtgcaggtgtaccaggtgccaggtgctgtgaggctgctgggagtgttttggataatgtggtacctgtgagctgagagggtgtatgtggccactgggcagcatcttggtgctctcgtagggcatgccaggtctcaggaaggttcttggattgcgtggccaactcagcgcagctgacacttgcgttgtacctcatggctctgcacttaacgctttttgatgataagtaacctcatgaggcgggtagtgggaccctttgtatcagacagagggcaggtggggcagcccggagacatgaatgtaaggtatccatggggacagggccagctcctgggtggctgaaatctacagggatttaattcctccaacctggttgaagatgatcaaggcagttgtttgctgattgtggcagctttgggaagagggaggtaggaggtgccctggaattgagaggcacttgggcatgtgcctccatgccatgccagagccctggcgtgtgctgattctttgggctgctggtcttactgatgtggtgtcgtggtcactggtgcctgggggcccctgactccctaagcctagatatctagatgttaccatgccagtgcctggactggggtacggaaccccagcacctgctgtggcacggcggctggtgagtgatgagcctggagttttgggcccaggtgtcaacaccctggctcctgtgatggagccctctgcctgggtacaggtcctcccgacaggtgtgcagtaggtgtgagccttctgggcgctgggtgggccaggagagtcaggtccatgcttcagcgtgcagcgtcggctctgctcattcactcacttggcccgcacaatgtcttattacacaggtgagggaggtggggtgaccccactgctgggtcccttctcactgggctctgactggagacgacagccagagcagtggctggctggcaggggtggccgaggcccccagcagggagcaggaggagcaagcaagctgggcctaggggttgggggaggccccccagggaaagcctagggccaaggcgattgcgtggctctgatgcacacagaggagtctttgctcttcctcatgaacctgcctccagcatcagctgcaatagtggttctctcttcactttgagacctgggtgctgccactctgctgacggccacgcatggtttttgtccaggtgactcgcgactcgcgcacctacagcgttggggtgtgcacctttgcagtcgggccagaacaaggaggctgtaaggacggaggagtctgtctgctctcaggcaccaagggggcatcctttggacggctgcaatcaatgaaactggattacaggcaccaggatgaagcggtcgttttaagttacgtgaatggtgatcgttgccctccaggtaaatatttgcaatgaggtaaataaacttcaagctcatagtaaactagaaattagacatagcagcagaaagaagctgcggagtggagctccacggtcctatgagtgctgtaaccttgggcgtgaatgtgagctgttcctctgtacacccccggtgtgaatgctggtgtgtgaatcacgctgtgttctctcagttgcctggtgagttttggcaggtgaatgccggttgtcacgtaggtgctttaggatgggcagcttccttagggactgctgctgcattctgaggtgattgtgcctggcgaggcacagctgccacactgataatgttcttcttctttccagaaaccgatgacggcgtcccctgtgtcttccccttcatattcaatgggaagagctacgaggagtgcatcatagagagcagggcgaagctgtggtgtagcacaactgcggactacgacagagaccacgagtggggcttctgcagacactgtgagtaggacggctccgcgtccccacatggcctggggccttgatactgtcaaggctcgattcacactgagacctttgtggatgccccagtcagtggcaggaattctcttgcataaaatattttcttactcgggctgtttcccacagagaaacgtttgaattgctctgtgggattgctgggtaaccgtatctacagaccgtggtagagctgccgtgagatgctgtgctgggtggctggctaggcccactcactagctggagggccttgtgtccacataccaggttttagccctggtggttcagattatgcctcaggaaaatgaatgtctgctatgggtcttcaggattctgaagctagtgaggattccggtaaaccaggcgactcatttattgactttccgccatgtggcagcccaggtggggatggaggtttcttggtgagccacactcagtgccttgcccctgcggtgctcaggaagtttcatgagaggagccaactgctgtgacttgtgtctacggaccgtgagatgagggaaatgcatgaaaaattactaatttttggccaggcgcggtggctcacgcctgtaatcccagcactttgggaggctgaggcgggtggatcacgaggtcaggagattgagaccatcctggctagcatggtgaaaccccgtctctactaaaaatacaaaaaaaaaaaaaaattagctgggcgtggtggcgggcgcctgtagtcccagctactggggaggctgaggcaggaggatggtgtgtacccgggaggcggagcttgcagtgagccgagatcatgccacttcactccagcctgggtgacagagtgagactcggtctcaaaaaaaaaaaaaagaaaaattactaattttcataaatgtccagtatcgggggaaccagcccccgatttttcaacgtaggttcttttctatttccctaagtgttggccggtctgagaaataaggggaaagagtacaaaagagagaaattttaaagctggtgtccgggggagacattacatgttggcaggttctgtgatgcccccgagccgcaaaaccagcaagtttttattagcaattttcaaaggggagggagtgtacgaatagggtgtgggtcatggagatcacatgcttcaaggatgacaagaggtcacaaggcagaaggtcagggcaggatcacaaggtcagcgcgaaactagaatcactaaataacttccatgtcccactgtgcacacattgtgagggttcaagagcagagaaccggtttaactagaattcgccaggctggaatttccaaatcctagcaagcctgggggcgctgcaggaggccagggcgtgtttcatcccttatctgcaactgcataaggcagacacccctagagtggccatttaagaggcgcccctgccttcctcccgggaatgcattcttttcccagggctgttaattattaaaattccttactggggaaagaattcagcgatatttctcttacccgttttcggtaataagagaaatatggctctgtcctcaccggcccacagtcagccagactttaaggttatctcacttgttccttgaaaatcactgttatcctgttcttaaggtgcccagatttcatattgttcaaacacacatgctttacgaacaatttgtgcagttaatgcaatcatcacagggtcctgaggcgacatacatcctcagcttacgaagatgatgggattaagagattaaagtaaagacaggcataggaaattataatattgattggggaagtgataaatgtccatgaaatcttcacaatgtatattcttctgtcacggcttcagcaggtccctccgttcatggtccctgacttcccgcaatagtccagggaccaaaatgggatgtattaaggaaccaaacgtgttaaatttacgaaggattgctatagctttgttttgaggcttattttgacaaaacgttattccctattttctgaatcacactcctgttttcaagtacttgtaggtattacattattatcttaaattttttttttttttgagatggagttttgctcttgttgcccaggctagagtgcagtggtgcagtcttggctcactgcaagctccaccttctggtttcaagtgatactcctgcctcagcctcccaagtagctgggattacaggggcccgccacctcacccagctaatttttttgtatttttggtagagatgggatttcaccatgttggtcaggctggtctccaactgctgacctcatgatccgcccacctcggcctcccagagtgctgggattacaggcgtgagccaccgcgcccagctatcttattttttttcgtgatcattagtagattggtcaaatattgaatacccgtgtgaggaatcacctagggctgtggggttattaagaagtacgatgaaaggctgtgtgccaaggagctgggtctatttggagtcaggatacacatgagtgaatcaacatgagatgtggccagggcagcacgtggtgtgttgccagatggcggatggagtctgcaggtgctcctgaggcagcatggggaaggcgtgcaggaacgtgccctggtgcaggccttggtctgacattctcccgcctctgctcccctgaaggggtggcctgcccctccacacttgtgggtatttctagtcgggtgggatgagagactgagaaaagaaataagacacagagacaaagtatagagaaacaacagtgggcccaggggaccggcactcagcacaccaaggacctgcaccggcatcggcctctgagttccctcagtttttattgattattattttcattattttagcaaaaaaggaatgtagtaggagagcagggtgatgataaggagaaggtcaacaaaaaacatgtgagcaaaagaatctatatcataattaagtttaagggatggtactatgcctggacatgcacataggccaaatttatgtttctccccacccaaacatctcagcggagtaaagaataacaaggcagcattactgcaaacgtgtctcgcctcccgccacagggcagcttttctcctatctcagagttgaacaaatgtacaatcgggttttataccgagacattcagttcccaggggcaagcaggagaaagtggccttcctccatctcacctgcaagaggctttcctcttttactaatccacctcagcacagaccctttacgggtgtcaggctgggggacagtcaggtctttctcatcccacgaggccatatttcagactatcacatggggagaaaccttggacaataccgagctttccagggcagaggtccctgcggccttccgcagtgcattgtgcccctggtttattgagactagagaatggcaatgacttttaccgagtatactgcttataaacattttgttaacaaggcacgtccttcacagccctagatcccttaaaccttaattttatacaacacatatttttgtgagctccaagttgggtcaaagtggctggggcagagtggctggggcaaagctacaaattaacaacatctcagcaaagcaattgtttaaagtacagggctttttcaaaatggagtctcttatgtcttccctttctgcatagacacagtgacagtctgatctctctctcttttccctacactccccagcaaacagctaccggacatccagcatcatatttaagtgtgatgaagatgaggacattgggaggccacaagtcttcagtgaagtgcgtgggtgtgatgtgacatttgagtggaaaacaaaagttgtctgccctccaaagaagttggagtgcaaattcgtccagaaacacaaaacctacgacctgcggctgctctcctctctcaccgggtcctggtccctcgtccacaacggagtctcgtgagtgccttcccagtccacccgcggcgccacaccctcagcatgtgaacttcagactgcttgacgatggttggctcttttgggttctcaagatgggaatactatgcccatgtgaggctgatggtggttgagttgtgactgttcctggaagcagcccgcagtgtcaatcctggcacagagggtggttctgaggtcagagtgggggcaggagctttggtgactggaaacggagcctctggagctggaagaacctgggcggactgagttaggctgggtttgatttgcgtttgtgtgtagctcaggttgtgggaggcgtgtgggttttctcgggtctttggcaggagctccttaggctttgctggctggggtcagcccatggtcctgaccactctgcgtggggagcgcccgcttggccaggtgctcctgcaagacatcaccgaggagcaggggcatggactcacagggtttaagtggttctaagtgaggtgggaaacttgccgagattctagccactgcctctcccagccccggagcccttctttctactgtaccacgctgtgtccagggtggccgcaggtgtggacattccactccgcgtgtgtctggttggtgagctcccttcttcagtgaagacttcttttgccctttttttttttaattggaaaagctattttagtgctacattcagtgatggaatggagcccttagttatcagaacctttctctgaaagtaaagtgaagagccctcctgtgtcagggcagagacgtcacttgcatgccttttacctgcccctttgtgtcgttttctaggtactatataaatctgtgccagaaaatatataaagggcccctgggctgctctgaaagggccagcatttgcagaaggaccacaactggtgacgtccaggtcctgggactcgttcacacgcagaagctgggtgtcataggtaaggcctgtgggtcctggtccttggttcaaggagcagcatctgaaccgggaaggtgagggtgttctcaggatggcaaggagagtgagcatgtgctttggtggaaacctccagatatgattgcctgtcactgtctcacaggcattttggctctcctggcacattaaaataagtgctgctttgtattatatgagactgcaggtcctagtctgtgtgtttagaggggttgggctatctcggggaagtgcgtctatccaggaggaagtctcagaatgttcagagttcctctgaagttcacgttctagctgtagatcaagtgcctaaattggcataaacacacgtgtttgtttaggaaagccaaacagttgcatgaggacttggtacaggtagttcagaggtacatctttgtaaaatgtcttaacaatttttcacgggaaattgatcttgtacttggttgctgagtgaaagttgttttctttcattatttaaaggaggaaaatagaggtttcttagtaagagcaattaggatttgttggagggaccagtaaaggaaaatattcacctttgcctcttaggctggagtggggtttcccgagttgtcctgattcagccacagggctacttcagattagcttgagatgttgagatggagaaagagaattccgagaaaactactgccacccttgataaaaatcacacacagactctgcaggttggtaggtggagggagagctgccatacaggaagtggcgcccagaccgccagcctgagacccgccctccctgggaggttcttactgctttagaggtcagttattgctgccactcccacactgccccagaagggggaaggagggaaggtcgtggagggttgctttttcccctgtaatcttgcagtatatatggatattcgactagtctttccccaacttcagccaactgaaatgactaaaacacttaaggcttcctaaaagtttgaggcaggaggagcaaaagagagtagtgaacacagggggtgacatggaactagatcatctgacttcttagcggtgacctgcaggccacctccatttggagagcaccattttgcaagtccagcctcgcctggcgggaagagctcatgctttctcctgggactggcatttggcatcctgagcacctgctgaccggaacgagaaataatctggtgtctgacaccaaatgagctcttaatctttggcgccaacaagacagcatctaaggacaaccacggtgcccccattgtccgcttagggaatggacccctgttggggtgggaggtagactttttgttttcagaaccaacatgtctcaagcagctgtgcttaatatatgtttaatccccatccactccatggggcagcgttgtcatccgtttcacaggctgggcccctgagccgaggaggttgagcctcctgcccaatcagtaagggctgtctacactattaaagttttttcttgtttgatcccatatgccagaagttttaaaaattttccgtaaaacagtggaattcttttttccaaaattttacacagaagcccaatatttaaaacaaattcagctggagcagctttgagtttggggcaggcctgagagcctagagtcccacctcccacctcaccatccagcagccctcagtacctcagcctgtgtcctgtggaaaacactcgggaagtgagcactgtgcccatgttgcctccaccgcatgcccctgcctggaaggatctgtgtgtgtgtggtcagggtggaaggcacctgcttcccctggacaccctgcgccatgccctggagacatcatctgtccatgcagccaggctgggcccagaccgttcccagaacagccccctgcgcagccacaagcagcctcttggtggtggcttgagagttggaacctggcggccatgctgccccagtgatacctgcagcttaaagcatgtactcacttttctctcagaccctgcgggttcgagggctcaggtttttcttttaatgggtcacttttaaaagcagacagtgctcgactgaaagctagaagaccctagaaaaccacagttggtttctgtttctggcttttcactttttccattctgtgctctgttattactgggaggctcacatgagggtacctgtcaggaaagcacctaatatgatagagagagtttacacaattggagcgataatgaaggctgccattacccggggtcccactgttcacatgagtttgttgggcactttctatacatgcccgaaacctgcccactttggacagtgccctgttctgcaggtaaggccctcaaggctcagaagctcagcaacccagggccacaaagtacgggagtaggagggtttgggtttgaccccaggtcttaggctgtgacaattgtgcagtgggccaggtgaccacccctgagtgtgggaatgcaagaacaggtcgataaacctttagggagcccaaaatttattttcttctggcctttaaaccagatttttactcctaacattgaagctttgtttgtttgttttttgtttttgtttttgagatggagttttgctcttgttgcccaggctggagtgcaatggcgccatctcgatcttggctcactgcaacttctgcctcccgggttcaagcaattctcctgcctcagcctcctgagtagctgggattacaggcacctgccaccgtgcccgaataatttttgtatttttagtagagacggggtttcaccatgttggtcaggctggtctctaactcctgacctcaagtgatctgccctctttggtttcccaaagtgttggaattgacaggtgtgagccactgcgcctgcctgaggctttttataatgcactagaaataatgtcagttcaatcatttgtgtgtttcaggtgacaaagttgttgtcacgtactccaaaggttatccgtgtggtggaaataagaccgcatcctccgtgatagaattgacctgtacaaagacggtgggcagacctgcattcaagaggtcaggagactgggggctcagagcgggactgtgcagtgagcatactggagggaattcctccttggggttttcatgggcaggttttggctgagtcttaggagctcagggccagagccgctgattgtgctgtattgggcggggctgctccaggcagggaagacctccagatacagtgctgagacactgttacaagaccagtgcaacttctctgggctagcttgtctcttgaactaggtttagcactggctgagcagtacttaactgacctctacctttgaatgtcatagtagaaacaaaggggcgtggatttgtcccacccgaggtgttcaagcagcctggctgggaccctcgagcagctgggacctgcatctggacctgggatgtgcttggattatattcaagttttcccggccacattgcatctggtgccagggagagcttggccaacagagggtgcatgtgagctgctgtttgtgaacagaactgattccttccagacgctgagtttggaaaaggggtgactcagaaattgccaaaggatttatgaatgtatgagtctgagaagcttaaacaaaaatctaaaaatctaggagcaaattttccaggttttgaatgttgcacggtttacaaattttaaaaaatttatattgaatgcttgcctgctttgtcacattactgatgtgtgcaccacagtcatcttccctgtccattgtggtgatgaaaagaagtgagtaaaataaccaccctcgctccgagctgccgtcagtgttgagtcgggaaattctgcctaggcctgcgcagcccggggagtgggggcctcgggacccaactgaagtctcgcagcaccttgactgaaagccagtgagctgcttcaagggctccgcagtgttcattgttttgcagtcttcccttatgtctggctggggaagtgactgtagcctgtgcttccctcctcctaggtttgatatcgacagctgcacttactacttcagctgggactcccgggctgcctgcgccgtgaagcctcaggaggtgcagatggtgaatgggaccatcaccaaccctataaatggcaagagcttcagcctcggagatatttattttaagtaagtaaaacgttttccttctgagctgtgaaatgtgttcaaaattaaaccagcaatgccgctctttccctatcggggagcactgcaggataaataggtctgtgttttagttactgttgctggagtcatcgtcatcttttgcttaaactgaggaaaagcgttactcaatcattaagttttaacaccaaagatggtgaattctcatgagtgtaaaaataaatcccccgtccttctccctctcttcatgataatctcaggggttgaagccgaagccttctgacatgtttgagcaggaatcttctgggcttaccagtgtttagaaaataagtttctcagcagtgttactggggctgctcttgggggtggtggccgaggtgcacagacagggcgagggccgtgtggtgctggatacggcacctgaggaaggtggattagcactcagaggccagaactggttggggagaaagcctcttgagagggaaactggtgtcctcagaattgctgtggggtcacagacgtgctgccctagcgtgtccgtgcttcctttccctaggaaaggaagcatcctggggccctgcagtgattctgaggactgagggtttatgtcatgaatgccttcttgaaggacttccatgtcactgtgatcttttctgtctcttcaggctgttcagagcctctggggacatgaggaccaatggggacaactacctgtatgagatccaactttcctccatcacaagctccagaaacccggcgtgctctggagccaacatatgccaggtgaagcccaacgatcagcacttcagtcggaaagttggaacctctgacaagaccaagtactaccttcaaggtaatccgtggcttcccacaaagttccacatttaacttcctccaaggaaggggattaaaattttcaactaactcccttcagttgaaatctcggaccacttttaaaacaaaaaccttggtctaattctttactttgttatgaatttcttgacagtggattgagcgatacgtgtcagaactaagcatttcactgtaggcaaattgtgtcttagttatcaagtaaatgtacaaaaaaactaaaacctggtctgatccagtggttctgaggttgggtggaggctgagctgtgcacagtcagaattgcctttgatttggttttaaccatgacacttccttattttggaatgccaaataatattagagaagggtaagagattttatatttgtaagaaggatgaaaggaaactggcctaaatgttaggatgtaggttaaaatcaaccaggacgcacatagggcagagtccagggtgtgaaggaaggttttaaactggcactaataagggtgttgccctttgttccctcacataatcgtgaaaggctgcttttgttttgaacagctagtcttaactatatacctttcataatttgatttttgaaccgtgtgtggatgtaataactctttaaaaaaaaatgaagtgtgtttaaagaaaaccccagcctgctctgatgtcaaagagctgccgatcatgtcctctgggaggggagagtagtgatagctgagaaggagcaggtgctctgtgccctggtgctgagcacattgccgagaaggagcaggtgctccgtgccctggtgctgagctcatcgccgagaaggagcaggtgctccgtgccctggtgctgagcgcatcgccgagaaggagcgggtgctctgtgccctggtgctgagcgcatcgctgagaaggagcgggtgctctgtgccctggtgctgagcgcatcgctgagaaggagcgggtgctctgtgccctggtgcggctgagaaggagcgggtgctccgtgccctggtgctgagcacatcgccgagaaggagcaggtgctccgtgccctggtgctgagcacatcgccgagaaggagcaggtgctccgtgccctggtgctgagcgcatcgccgagaaggagcaggtgctccgtgccctggtgctgagcgcatcgccgagaaggagcaggtgctccgtgccctggtgctgagcgcatcgccgagaaggagcaggtgctccgtgccctggtgctgagcgcatcgccgagaaggagcaggtgctctgtgccctggtgctgagcgcatcgccgagaaggagcaggtgctccgtgccctggtgctgagtgcatctccacgacggcagcacctgatggagggaagctgggtcagcatcgctgctcctggtcacagattgtagacagcgccctggtgcatctgctcatagcacctgtggcccctgaatagaactgggaaagtgaatgttctgctttctgggtgagttgatgatgggaaagttgatcagcctcattcacttgcataactccacagcacggagctagcactctgtgtttctctgttctctgccttcctcacacttcggtgaatccttcagtcattcagaatcagatgttgcatgtcacaggttgtgccttctcttgctgtcctctttcccagtgctcggtaaatcttgattaaaggaaggaaggaaggattgtttcagaagccttcaggggccctatcatgcagagaaggaaagtctaggctctctctgacacagcttgaagatgtctgagaggctcccatgtaccagggtagccttgcaagctgctgctcctacacatgcctcagccatcaggttattcactagttcccaaagtcaccctgtaacctggtgggtttacatatgctgctcttggtgctggaatgccttggcccaccttcctcatccttccaaacctacttctagtgcccctcctgggaaggcccaccttctcatagcagggtgacaccgctggtgtgtctgcaggattccaaacctacctccagtgcccctcctgggaaggcccaccttctcatagcagggtgacaccgctggtgtgtctgcaggattccaaacctacctccagtgcccctcctgggaaggcccaccttctcatagcagggtgacaccgctggtgtgtctgcaggattccaaacctacctccagtgcccctcctgggaaggcccaccttctcatagcaggtgatactgctggtgtgtctgcaggagtcttcacgctccatcgcgcagcactggccacttgtctggttacacataagacctccacgttcacaagtggtatgtctagcagacctttgaggatccccagctttcagagtgcttgtgcatgcgcatttagtcattcttggtaaataaaatccctttcagaccttttcactttcttcattcaccagccccaggaagtagctttagttttaagacatcttttcatctttcatgaagaaatgaagtttctatctcttcctgaggcttgccattccttcgggagggcagagctgtctctcatcaggacgtggagctgctgggcggtttgcttccccacatcagccctgtggaacagtccattcagcagcccctgcttcagctactcccaagcgagaatgtggggccctcccggagcggagccgcaccgcctgtctctgggccccatctgtgtgtggacatgtccgtctcctaccctgcactctcgcctctgcattcctggcacccagcagcaccagccacaaagattttcagccagtgacaaaggttgggagcagcagagttcatgcaaggagtccacacaagggttcctcacttctgacagcaacagcacactgaaggggttcccaagccaacttcagatttaccctttcaccataactcacagagctccctggaagcagttacacttatagttatgatttactgcagcaaaaagatacaggttaaaatcaaccaagatgcacacagggcagagtccaggagggaattgaatgcagagttcccaccagctctcccgtggaatcagatgtgttgtgttcccagcacccacgtgtggcagtgcacatggagtatcatcagccggaggtgcttccccaagccttggtgtccagagtttttcccggggctctgacatgggcaggattggtccattgatcactcaggtactgcatggccagcccctgctccgtatcctgtcattagccaaggagcaaggccagccctctttttgggcaaggttaaattcttgccttccctcttgttgccgttgcttctgttcctggaggagctcctggcacagtgatggggtctcaggcctccaccttactgcacgatgaagagtttgaggagatcaagaaggagactggcttttcccacagtcaaatcacacgtctgtacagccggttcagcaacctggacaaaggagagaacaggacgatttccaggggattccagaacttgccatcaacccagtgggggactggatcatcaatgccttccttccagagggagaggaccaggtaaacttccgtggattcctgcaaactctggctcatttccaaaccattgaggataatgaaaagagcaaagttgtgaatggacctgaaccactcaacagccgaagcaacaaactgcagtttgcttttcgactatatgatttggataaagataacaagatctctcgtgatgagctgttaagggtgctgtgcatgatggtccaaataaatatctcagataagcagctgggcagtatcgcagacaggaccattcaggaggctgatcagcatggggacagtgccatatctttatcacagactttgctaaggttttggagaaggtggatgtagaacagaaaatgagcatctgatttcttcactaaaggacagacagcaaactattccttgcagtctagtatttaagtactggaacttgacagtcctcctgtccaccagccctacctccaccccatcattccccttctcccaaagtactactgctgttgcataacaaccccaaatatgttctgtcaacacaaacctgcttttggtctataaacagggcgttacagaatggtacacccagtctatttcttctcagtatccattcgccagttcttcatttataaatatcgtcttcctctgttctgctgctgaatgccacacatccatccagtctgagaaagtaagatagggaatcctgccgaggaacaagccagcaaagctctttcactggatgtagactgcacctgctgccttccctctggcgagtctgccagcatgcttctccatcctttttatatgtcctttgcttcccacttctgtgtacattcaacatactgttcacgtagtcatgcagtctttctgctttttgtgaagcctcagaatctcctctgttctacttggcaccccaagctatgcctggtattgtatttctgacttggctcgatagttcggtggtctggcagtttttatctaccttcattattaaaaggccctctggagctgggcgtggtggctcacgcctgtaatcccagcactgtgggaggctgaggtgggcagatcacgaggtcaggagatcgagaccatcctggctaacacggtgaaaccccgtctttactaaaaatacaaaaaattagccgggcgtggtggcgggtgcctgtagtcccagctactcgggaggctgaggcaggagaatggcgtgaacctgggaggcagagcttgcagtgagccaagatcgtgccactacactccagcctgggcgacagagcgagactccatctcaaaaaaaaaaaaaaaaaaaggccctctgggatgttgcctctccaggagctttttggtaaccaacacttctctcgggagtatgagatcatcctctgcactcttctctgtcatcaaagggctgctgggtggagatattcttgaaaggtggccttggtgagaggtgtggagtcaagtcttttaggttgcttgcccacgtcactctacctctggcctctgattctcaactttgtacctatggggcgtctcttgttagtgcagtgttgactattcaaaaagtagcaatatgcctgcagatttgcttagtcttgggacacggttaccaccagaacggctgctcagacaatatgcttggggactttctcatggctttttgaacaaggaggctgcgcaccctgtgaagcctcctgcattcacacctctgctgcatggtttatgcctcagtgttatgtgcactggaatgcttttcactatacgtttccaagttagaaagattagtgttatggaagtgcctaatgtatcctagtccaaaatatttaaagattgttctctgtgtcttgaagttttgcacaaaattctttatgaattttacacttggcaaatgttaatgctagaagccatagtccgcttcttatacaagtccaaagcgttgactgttgtatcattagctccctggttacactggtttcccagctccttgtgtagaccactgctaatcccttagaaacaagaggtctggcactagtagcacaacctaaggtggcattccaagtctttaagcaagtcacagcaacttttctgccaaagtcagcttagtttagacttcagtgaatcaggctgttgccatcctaatgtatgtctctgtgagtctgttcattcacatatctgccgttggctgactttcttgactcgctgcttgcttgcttgtttccttgctttggaaagctattgaagatgtgtacataattctttaggaaggggattgctaaaaaatacactgcaaagcgatggaaaacagtggagaacaggggagtagccaggctggatggctcaaatataaatgaatgaggaattctttatgaagtgtcagttggactttgtgattgagtgatgtaatacaggaattatatagaaagggaagaatatctgatactgatctgttagatacttcagaggctccttgatttgcatatttaaagttcctaaaattgtagcttttcccttcttttggctgtacagcagactgttttaatccacggttgtgccttattgttccattaaaattgtgtcttcagtccatcaataaatactcgtggttaaaacaaaacaaaaattctttactgcatgctgactaagggcagggctctatccatgtgcatcgagtggcctcgtaagctgtgaacagagtgcctgtgggacgtgggatgaagtctcttctgcctgattttaagtctttgcaaactttttagaccgtaaggagctaagctcagtctgctcgtgaaaaatgatggtgacatgccatgtgtgcccttcccgtttgacagacggcgatctcgatgtcgtgtttgcctcttcctctaagtgcggaaaggataagaccaagtctgtttcttccaccatcttcttccactgtgaccctctggtggaggacgggatccccgagttcagtcacgagactgccgactgccagtacctcttctcttggtacacctcagccgtgtgtcctctggggtgagtatgacatccggaagcttagcacttgtaccccacatcttcccttaagaataagtgtatgtgtgttttttccccaatgttttcttgtgaaatattcagaacatgcaccaaaaaatagagaaaatgatagaagcggaccccacatagtcagtgccccgctccgttgcttgtcagcatcctgccactgatttttggtccatggctgcgtcacctcccaccacccccagcagcagtgccattgtttcctttgtgtgtaccatgccccgaatagggtccagtcagggcaccccagctctgtccctctaccctgttcccattgctgcctccctctccttagctcctgggaggcaagtactggtggtgcctcctctgtgtaatcctggaacatcttttgtgtcgtaatacaaatgattgtttggtaaagtttcactttgatttgagtgcagtatttttactttgatttgagtgcagtatttttacgtttgtttgaatgaatgaaaagcttactctccagattttgagaatcagcatgagaacagagggagcagtttctgctctgaaggaaggtggcacctccattggttgtcttgtgtcccacagccgttttatactttgccacgaataacatgttgtcagttgctttcctcttggatttattttcttcttatgttacccccacccatcattgtatttatatttatttttattttttatttttttgggatggactcttgctctgtcactcaggctggagtgcagtggtgcggtcttggctcgttgcaacctctgcctcctggttcagacgattctcctgcctcagcctcccaagtagctgggattgcaggcatgtgtcattatgccctgctaatttttgtatttttggtagagatggggtttcaccatgttgaccaggctggtcttgaactcctcacctcagataatctgcctgccttggcctcccaaagtgctggcattacaagcgtgagctgccatgcccggcctggcccaccattttacataagcttttcattctctgtcctgagactttaagattgggggaacatgaattcttgccatgtaattgtttccttcatgtcctgaaaaagggaccgtagagtcagcagacgacagtggtgggggtcatgggggaatgaagatcacacattttacatcttaaatcagcactccccctgcccacccttaacagtggacatgagctcagcaaaaaccagctttgtcctgtgctgttcaggcctgtgtacttagggatcctcagctgcacagtcagggaaagaggcttttggttgaaatttcacttgtggtattttcagcttttgaatgtttatggtgttccggtgacgtcattacaaaatgaaaggattgaaactggaagttcttcctgaaagaagcaaaatgtgaatttttataaaagataaaacccagaagtgaactttccctgcattctctgtcatggagaggctacagctgccatgagatgaatcctgcctcctgacatggcagctggtcttctgtgtgggtttgagggaccaggccaggctaggatcccgtccatgttgaatgtttagagttcgacttctgtgagtaggaaaagcactgtttatagggctttggtgtttgactctaaaaccagagaggaagattctccaggaaacctcggtttcatgatgttcagaacatcaggattgggagctgtttaaatcccttaacacactgacaaggtaataaggactttaaaaaaaagaaacagaagttgaaaccaagagcaaaaactcagatggtggattttgagggatgcaggtaccacccgggggtgacgtggaatagtgcctgagatttttttttccccaaatgttatcagtgttgtacattgtagaatcatgtaaatatggccagacgcggtggctcacgcttgtaatcccaacattttgggaggctaaggtgggcggatcacttgaggtcaggagttctagaccagcctgggcaacatggtgaaaccccgtctctactaaaaatacaaaaattagccaggtgtggtggtgcacacctgtaatcgcagctactcagaaggctgaggcaggagaattgcttgaacctggaaggtggaggttgcagtgagccgagatggcgtcactgtactgcagcctgggtgacagagcgagactagatctcaggaaaaaaaatcatgtaactataacaaacaggtagcaatgttcgccctaatagattaccatttttagttcttttagctatttcttctggaatttacctcagtattttaaattaacatcctatatctcatctgttgacttcctgcaatagtagatgaagatagagctgtcttacaccttcctcctactttacaaaaatggttctttcacaatatttgattaaagtcaaaaaatttacacaaagctaaaagacaggcatctacagatggaaggggcaggctatgtgcccagcacagttattgatgacaagacccacccacttatgaaataccaggagagcagatacaaagaaaagactgtaaaagctttaggggaggctaatttgttgtattagaaaataattcaagaaaggttaaaatactttaaatcctcactttatatcatcgataggttcttggaaactgcaactttatgtgaaatgatgtataatgaaaccagttttttttcctcagctttatgttatgttatgttatgttatgttatgttatgttatgttatgttatttttttgagacagagtctcgctctcgcccaggctggagtgcagtggcgcgatctcggctcactgcaagctctgcctcccaggttcacgccattctcctgcctcagcctcccaagtaactgggactacaggggcccgctaccatgcccggctaatttttttgtatttttagtagagacggggtttcaccgtgttagccaggttgatctcgatctcctgatcttgtgatccgcctgcctcagcctcccaaagtgctgggattacaggcgtgagccaccgtgcccggcctcatcaactttataatgagacagttttgaaggaaatgatgtcattcgaggacctcccatagtcgcttcacggaaggttgcagtttgaaggaaactgtcagcgaccctatgaggacacactgtactggacaacagtggtgtctaagctgagaggggtggcagagttcccagcttttaaaatttcttacagtgatagcatcatatgaaagtaaaaccattttcttgaaagaaatgaaggaaggaagaaaaggtagagttcctaattgtttggaagacatactgttagacttcctgtcttagtatgcatgccagtattttaagaataaccactaaaataatataaatatagtatgtaacttccaaaacagcggagaagaaaaggagaagtaaaaatacttaaatccccaaagaagacaagcaaggagaaaaataaaacaaaaatcagataagtagaaatttcagcccagtatggtagaaataaatctaaatatatctataatcataagtatagcttgactaaacttgtcagctaaaaaacaagttgtcaaactggatttcaaaaacaactctgtttacagggaacatgcctaaaacaaggatacagaaaagaccaaagtcaaaggagaagaaaagatataccagaaaataatctgaaagaaagctgcagtagttatgttaatataagataaaataggatattaaagaaaaatattagggataaagaataaagagggtcattataattttaaaagggctaatttcctaggaagatacaagaatcctaaacttccatctacctaataaaaaagccttgatatgtaaagcagaaattgacaaaaccacacacaagaaacaagcctagtgattgctgggttgagtagacaaagagtaaagctttttttggaagattgagacagcacagtgaaaagcaagatttaatagacatgcgcagaacactgttccctgcgttgggagaacactgtttgcccaagcttacatcaaacacttagaaaactttagcaaaaattaaccacaaagcaggcaagtcagcaatttccctttttttttttttttttttttttttttttttttttttttttttttttttttttttttttttttttttttttttttttttttttggagacagagacttgctcttttgcccaggctggagtgcagtggtgcgatcttggctcactgcaacctctgcttcccagattcaagtgattctcatgcctcagcctcctgagtagctgggattatgggcgtgtgccactacctcctggctaatttttgtatttttagtagagatggggtttcaccatgttggccaggctggtctcaaactcctgacctcaggtgatccacctgcctcagcctcctagagtgctgggattacaggcatgagccactgtgctcggcctaagtcagcagatttctgactgatgcaattaactacatacatgatgcaattaagttaggaaccaagaacaaacaactgaaaaatagaaatacgtttgaagactaaaactcacttctgaataatctatggtccaaagaagaaatcaaaggtagaaagtaaaatacgcttagaactgagtgatgatgtgtctcttggatgcatttcgagtggtcctgagtggctggagctgcttctgggtgagtgggtttctggcttggagggagaggtctgcatagctctcagacctgtctgtggagtgtggtggtgcttctttctgagcagaggtcaacccttgcaggcccacctagaactggacgccaggctgtccctgtggtttcttgtcttgctgatgttttagattgtttggcttaagctgaactttgagagcggcagcccttgcggctgggccgcgggttggcctgttgccctcaacctcagttctttgagcagccggcatcttcagcagcacaagatgcgccccgctggggttgcctcttatcaccagcagcacaggaggaatttctgtttatgtgatcctgttcctgtgtgtgtggccccaagtgacagagggccagagagattagaagtgtcaagtcgttacactcttgagtgtcatcttgctccctaagcgcaaagggaagtctccgtggttgtttctcattttctattattgtcccaactctgcttgagtgttcgatgtcatggaaacgcactgctttttcccacaagtgtgcatgtgggtcttgggtgggaatggtgaactccgctggtgaggcagctggtgtgctcaagagccttctcctgggatggagcaggcttggagagaggagacccgtcgggggctgtgctgggctctgctgctccctgggccccaccctggtctgtggccgcccctgggccccgtcctggcctgtttctaaggccccctgggcccctttcgtgtggagatggtgtctcatggtgggctgcgctcactgcttccagaagaaattctgagaggaaagagctctgaccctggagagaagtgtggtgcttcgggacagcctctgccccagcctagtcctgccgtggattgggccacctagagggggccgcgtccctcctgcctgtctcctctgtgtttgggtgaatgatagttcatggagctggaagcagtgccttcttgtctgctttctgacaaccctgccacaaactcatcatcaggaactttttgcagccctcttccatgtggagtgggacttgtggccttgttttctgggcaggagtaagaatcacatggtgttgggaaagtcagagctgctcttgccttggggactcaggtctcaggttgtggctgtggcagcaggaccaccctgtgacacggctccttttctgtgacgtccttgcagggtgggctttgacagcgagaatcccggggacgacgggcagatgcacaaggggctgtcagaacggagccaggcagtcggcgcggtgctcagcctgctgctggtggcgctcacctgctgcctgctggccctgttgctctacaagaaggagaggaggtaagcgggtggcagggcgaggtggggcgggtggatgcatgcctcccatagctaatcttggggtcagttttgtggggttttatttatttgtttttaagccctacagcagcgaaggctcgaggttcttagtccaaaactctctggaagcagtccccagcgttgtggtttttaaatgcctgcatttctgtctgaccaaggccgaggccctcgcacatcacccgtgcctgcggcttctaggaccgtggtcctttgtgtccaaagatgagtagaacattaaacggcacctttcatgggtgccttttcccactgagcagctgacccctctgccctcctcacatcataaatgcaggagtttattaagcgcctgctatgtaccaggtatgatgccatccttttgcgccactttgctgggtgaaaggactctccatgtgacggtcaagcagattttcacgtcaggcgtcagtgttagtggctctgacctgggggcaggagctggccagctcaggcgttccctgctgccactgtcatttgccagctgagccacaggccaatgagagaggtggtcagaaagtaccaaccatggaggttgcagtgagccaagatctcaccactgcactctagcctgggcaacacagtgagactctgtccaaaaaaaaaaaaaaagtaccgattgtggccctctacacccaaaatgcagaatggggcagaagaaggtctgggccgggaagggcatgtgatgtctgtctctgcgagccaccattgggcaggcttagtggcgacggactggtgtggtcctgttagtcatgtgaaaaagtccttgccctaatgttaagttgctctagagggccctctgctgttggattccaaagcccatcttctttccactcaatcacaacaaatacattagggtatatataacctgtcacggctactcatttgtcattcagaatgtgggagaaatgcagccaccaccagccccctggtggtgcagatgggggtggggctggcgggggtggggctcctgcccatgccctctctacactggagtaattattgtctcctttttttttatagggaaacagtgataagtaagctgaccacttgctgtaggagaagttccaacgtgtcctacaaatactcaaaggtaattttctgtggcgagtctcttgaaggcctgcctccccggccccctgtgctgcgctgtccatgtcgttctcatcaggggtgccaaggaaagcagtcacaggctgactggaatccagaaaggaaagcaacacccgttgcctcagccacttacgccagcacatttttttgttatttttttccctcaagtttctctcgtggttacaactgatttccttgaagtatttaataattaggttgtttccactgtttttggctgttctttaaaaaaaaaacaaaacacacacacacacagtagtgaagatagttgtgcatgtagcatttggatgatttctttcaggtaaatttgcagaaaagaggcattatctggatcaaaggacataatgtttgtggtctcgatgggtaatgatgaattgctctctaaaactaggcttttgactggagtccctcctttgacattcctcccctgccatgcagtgggcacctttcagtctatgagtagcccggaagagccccttctcccccagctgcgctgggggatcactggtctgcttttcggtccaggccatcccgaacgccttctgcttggtcccacccttggctgtgagactcctgccaaatgaccccactgccaccctcccaaaccctcctgccttggtgcagtctcattaggaacaggaaggtgttgccagccctcgtcttcctttccctgggaactggagatgcagtgactgtgaggacagtgggccagttcttccccagctcgtgccagcagagagcatccctgatgtggtggatggtggagcagaatggggtctcttagggggctcacgtggtctctgctgttgatccctggcaggtgaataaggaagaagagacagatgagaatgaaacagagtggctgatggaagagatccagctgcctcctccacggcagggaaaggaagggcaggagaacggccatattaccaccaagtcagtgaaagccctcagctccctgcatggggatgaccaggacagtgaggatgaggttctgaccatcccagaggtgaaagttcactcgggcaggggagctggggcagagagctcccacccagtgagaaacgcacagagcaatgcccttcaggagcgtgaggacgatagggtggggctggtcaggggtgagaaggcgaggaaagggaagtccagctctgcacagcagaagacagtgagctccaccaagctggtgtccttccatgacgacagcgacgaggacctcttacacatctgactccgcagtgcctgcaggggagcacggagccgcgggacagccaagcacctccaaccaaataagacttccactcgatgatgcttctataattttgcctttaacagaaactttcaaaagggaagagtttttgtgatgggggagagggtgaaggaggtcaggccccactccttcctgattgtttacagtcattggaataaggcatggctcagatcggccacagggcggtaccttgtgcccagggttttgccccaagtcctcatttaaaagcataaggccggacgcatctcaaaacagagggctgcattcgaagaaacccttgctgctttagtcccgatagggtatttgaccccgatatattttagcattttaattctctccccctatttattgactttgacaattactcaggtttgagaaaaaggaaaaaaaaacagccaccgtttcttcctgccagcaggggtgtgatgtaccagtttgtccatcttgagatggtgaggctgtcagtgtatggggcagcttccggcgggatgttgaactggtcattaatgtgtcccctgagttggagctcattctgtctcttttctcttttgctttctgtttcttaagggcacacacacgtgcgtgcgagcacacacacacatacgtgcacagggtccccgagtgcctaggttttggagagtttgcctgttctatgcctttagtcaggaatggctgcacctttttgcatgatatcttcaagcctgggcgtacagagcacatttgtcagtatttttgccggctggtgaattcaaacaacctgcccaaagattgatttgtgtgtttgtgtgtgtgtgtgtgtgtgtgtgtgtgtgtgtgagtggagttgaggtgtcagagaaaatgaattttttccagatttggggtataggtctcatctcttcaggttctcatgataccacctttactgtgcttatttttttaagaaaaaagtgttgatcaaccattcgacctataagaagccttaatttgcacagtgtgtgacttacagaaactgcatgaaaaatcatgggccagagcctcggccctagcattgcacttggcctcatgctggagggaggctgggcgggtacagcgcggaggaggagggaggccaggcgggcatggcgtggaggaggagggaggccgggcggtcacagcatggaggaggagggaggcgctgctggtgttcttattctggcggcagcgcctttcctgccatgtttagtgaatgacttttctcgcattgtagaattgtatatagactctggtgttctattgctgagaagcaaaccgccctgcagcatccctcagcctgtaccggtttggctggcttgtttgatttcaacatgagtgtattttttaaaattgatttttctcttcatttttttttcaatcaactttactgtaatataaagtattcaacaatttcaataaaagataaattattaa

SEQ ID NO: 1254 - DNA, 4375 bp, Homo sapiens
agaattctgttggatatttaagatgatacctggttgagttttggatacaactcatgtttttatctgatttatggtctctcctgatagtctggcaatacctgttaacattttaaaacgtatattcacataatcttttgtgactcaaacggatagaagaagtagtactatatgtagatatttgtacaaaaggtttttggtagcattgtttattgtggcaaatatgctggaacaatctactgtgtgggtatggttcaataatttatagtgtattttcttcttatttacttggttaaatcatctaaaattatatgtgtacattatattaaaacatagccaacagttaatgtttatttataataactatttgactatcagtcatatgtaggcaccggtttaggtactggaattgaatcagtcactacaacaggcaagaatctctttttttcatggagcttacattttagtagggtgggagacagatgaaaaaagcaatggctaagtagtatgttaaactgtgatgactgctacagaaaaggaaaggaagggtaatcaggagtactgggggctcgggtgtgtgtgtgaggatattaaatagggtaagtgtcactgagaatgtgacacgtaagtaaagaccttgagttgagggagtgagctgtgtgtctctctgggggaacagccagttcaggggacaagaagggtagccaaggagtgtgttggtggtagcaagaaaataaaaatcttttaaaaagagtatccatataaatagagaagctggaggttaaaaaattggatgagtatttttttttttaatttggcaaaatagcgtgaatagtatatgttgaaggaaacgctaagtgggtggtgcaggggagagaggaagacttgcttgagcacatcgggaagtaggacaggaagggttctctgtttgccttgtaggttctaattgccatggcaataatataattgctgtggccgctgcggtaggcaggagggctgcctgtgaagtcaggatcaccaggctttgtggcttcaaggaggccaaatcaccatgggcttgcttgggcttggaggtgcgacctggtgggcctgcagaatgcgacttggtggcctgactgagcagcacgtgagggcctggtgcagcctggcatggtggtacccttgagagcgtggcctagagggctccgaggtgcagcctggccagtgtggtctggaggggtctggcaagcgctatctggagcactcagaggtgtggcctgtttttccgggtgggtctagtgagtgtagcttggagtgctgggtggtgtggcctggctggcaccgaggtccctgcggattctggagaacctcaaggtgcggccccgggggtgtggccaagtgtggtgtgtggagggcccttgtgtgcagcctggtggttcctgtgagcatggtttggagggcctggtgaatgtgtcctggtaggcctggtgagtgtgtgagcatggcctagagtgtcaccaaaccaaagtggacccgcctgcctgtgcaccagggaaagccaaacaccaaagcgcagggtttttgctggagagagtggactgcactgcgacgagacaggaggaaaggtcaaacctgtctccccaagctggcggctgggtcgggttttataagcataagcttattaccataaggtaatgaggtgtgttctgattggatcttgcaattagatgacaccagggctctatctgattggatcctggatcttgccatgtggtgtgcgcttcttatttcagtcccgctcctcagtccagcgcttaggttcctcccgtgttgcaagcttggttcatctgtgcaggctccggtgacatgatgtcgaactgggagccatggcagctgaaaaacaacgaacagctttgtacataaaagatgatacagcttggtctaatgtggttctaaggaggctctgccggcgagtcttaggggttccggcgggcagccgcgtgaacctggagcttggggtctgcagtgctgggaggccgaggcctggcatgttggggacaggtcttgggagctgactgggggcctggcgtggtggcggcagcccgcagtccctgcctggcccttgtctgggaggccgcggttctctgcggcctctcgccggtgtcgcccttggccactgggctgcgaggaagccggcgaggagtgggtgtgcgccccgcccggctctaccggcgagggatgcagtggccgccagcgtggccgtgcggctgggtcactcccttcccgcttccagggcctttttctgcctccttttcaggacgtgacccgcacattatgagggacccgtaggggctcttgacacagaggggtcaccctatgtgtgaacaggttacgaggttgggggcttggcttctgaacttgccaggaaacaccgcatcccttttcctgcagcggccgccccccatcccccacccgccccattctctcccctccccaactgcagccttccgcgcctccttggcccctcgagcctccctgggtcccctgcacctccccatgtcccccacgactcctaggcctctcgcgcttccccaggaccccgcgcatcctgggcctcttgcgcctccccggtcctcagcgcctcctcggccgccgtgcctccccgcaccttttgcgcctcatggggctcccggtgccttctgcccgccgcctcgccgcgcccctcgcctcctcatgcccctccgcgccccatacctccccacccctgtgcctctctgcctatcccctgtaccacccggcatcctccgtgccccatgcgcctcacccctcacgcctccctgtaccctgcatgccccgtgtgcctgctgtgccccacgcgcctcccccctcgcgcctccctgtaccctgcatgccctgtgcgcctgctgcgccccacgcgcctcccccctcgcgcctccccccttcgcgcctccctgtaccctgcataccccgtgagcctgctgcgccccatgcgccttccgcgtctccagccctcatgcgcctccagctgcgcatctccctaggcgggtacctcagcaccgctgagcccacccccgcccctgctcagtgcctcccagacacgcccactgcgggcgggacagtgggagctgtccaggcgcggagctgtccaggcgcgggagctgtccaggcgcgggagctgtccacgaggcactgaccttggtttcagagcctctgcagggcttctgtgtccttttggctgagccgactgggcaaaagttttagaaaagaccctgggtgttgcagatggagaaggatgatcgtggctgacttttgcttgcaggcagaagaaccacggggccatcagcctggtgctgtgggggcgcgctgactcgtggtccgcccctgccccaagacttcaggtgtatatgggattggatcagctatcatcccgagctcatggcacgtacagtgagccatgtgttaatccatagactaacctttttccttttaaaaaattagttgttttgtataatgtagcgagcactgtttccaacaaaaatctaggatcttggcagtaaccactatctgttttactctttcctctttcacttttcgctaggagtaatcattagctcccatcttgtattaatttttttttttttttactgtatctaatttccaaaaaaaaaaaatctgtgtgtttgcaactaagttatcttcctatgtgtaactttttgggacttaagtgataacagtaatattactaaaaatcaaccgtattgttgtttttcactgtggtttattccttctgactgctgtgatattttgtgtggatctgctgaagttaatttatccactcttctgttgatgggcctttggtcatttccaggtttttgctcttctgaagagcatgagatattctttcacattttctgctgtgcatgttccatatgtgcatggttttctcttttatatagacctgagtggagtaactaggtcatagggcacacgaatgttcaattttaggacataatgtcctgctgacttacatagttgttgaaccagttaacatttcactagcaatacaggagagctctgagccacctcatggctgacacttggtatttaatttttgccagagggatggttgtaaatggtataccattttggtcttgatttgaaattccttgatcaccagtaacattgaacatgtcttaacatatttattgatgtacatttttctttgatttgcttgatcatgtcttgttcattttatattgggttattgtgtgtgacctagattagaattttttcttttcattggatattaagatccaccattgtgtggctaggagtgggtttttccttctctctcctttccagcatggtgtgtgctttc

SEQ ID NO: 1255 - DNA, 4375 bp, Homo sapiens; identical to SEQ ID NO: 1254

SEQ ID NO: 1256 - DNA, 10543 bp, Homo sapiens
tttattagagaaaaatgtacttttctatgcccgtgctttctacgtttttgaaactgatacagatccacagaggtgaactgaaatctaaattatctttaatgttaaaatttaattgaccatgtacataactgtgcaatccctgccttctcacagaagtgtctaggattcattcaacagatcatagaaacgaggtctggcatttaacagacaagtgacagaggagctataccgatttatacaacaattatcaaaacactgtcatgtagtttactgtagctcaagttgtgctcgtatcatataacataggttcaagttctttcttcagtcatcagaataacagaggttgaagagacaatgaagtgccaactcttccaaaagctgtttcaaaaaaaaatttaagtaactgtgatacacatttctgcaaataaaatattccagtgcttacatcaatcctgagtttttaaacttaaatatgcactacttacagttctgacacgattctttttaaaaacacggctagttatcaagttcactttcttcactggaagaaatgatgcaataattgtctttagtgtccttggcagcctaaaagaaaaagtctagttcactgacaaaccaccactttacatctcacgttttaaacagggttaatcagatgtcaaaaggaaacagcttttaatattcaaaggatgctggttatttatttcaatttgaaaaaaactgtaaccaatacatggagctccaaatacccacttaaattttttaatgccagatttcagtgaaatattattttagcaggtccaattgtcatgtactttgcttgaataaaatgggttgatgagcatcttaaggtcaagatggagcaaagacagaaaaagtcaggcaggcttaccatgaaatatattttttcagcaggtagtgacccatgtattatcagcaatagtctacggaaagtggtttccattgaagggataaaatggttggtgatatgacctcatcaagttagagaaaaatgtaactatgtttgaaatatatactattccctcaacaaatagttcaacagttcctactcctgaaaatggtgtatgttaatgctaaggaagatgtaaaaaatgtaagcacaatctcttccataatcctgtgacatgagcaaatgcacaaataaaaaaaattaatacaaaaattgtataactgctatggaagggcaactcactcagacatgtagccaaaaatggagacgtatgttgacttagttggcaaaaggtttaaattggtcttagtcaaaaaaaaatttttttaaagcattgtgagggaagagcatgagaaaagcataagagtaacagtgaattccttcagggaaagctgtcaacctggataggcaggagcaaagacagagggcggcaagcctaagagggggtcatgtaaaggggagagtctctgaatatctaagaactgagacggggcatcactgacaggctgggaagagggaagggctaggaagcattttaggaaggggagggttttaggaagataatattgccgatcaatgaaggatggctcagaagagaagagagaactcagaaaagagtttaatagtacaagcaaggaagaatgaggtcttgaactagggcagctgcggtgggaattttaaaaaaagaaatttaagggccattacagaggtaaaacttgcctcatgataactgcatgggaaggataagggacttagaagagtccaagatgatagcaaagttcctaccctaagtggtaacatgtagcattaacattgacaggaaaacttctagtctcatgttcataccaattaataaatggtttctggtgaacattatagcaacattttctctacttgtgacttctatttaaataactgttttgtgtatagatcattctcaagttgcttgaaaattttattttcaaactcttttctcagtttatttaacacatctcagttagtgtagaggagtgacatatgaacatgtcttttcacaaggttattaaaaagaataccttacctcccagaagggaattccattgttacctaaataatgtacatctacatgaagaagaggtcattgatgacaatttgctaatgtgctatacgacagcagataattcacaattcacaacgtgttaataatttgctggctttcccattctgttatacatctgaaccatctcttatgactacaaattgtcatgtaaaaccattactagtcgctgataattttgaaagtgaatatgccataaaacactcctgtattacagcaggaaataaaagagacactcagtagttacacttgcctacttcctatttaactaaaactcttgaaacaacacaagtaaaaaagacatccagaaaggatttatggtcttcctgccttccaccatagatgtgtcattgatgtcctgaaaactgaaaataaaatcttcattaaaacccatttatgcctagtgttccattattggaacgctaagcttgtgggaatcatgtatctcctaccgctcaagaacatagccaaggtctgtttcttcacacacaaaaaatgtgcagcctccggcataaatgtgtcaatgcgttaacaatatacacaagatgtatatttccaggtaaaatttccaatttaccttttcctgttctaaataactcccacaaaactattcacgaatcctaaaaatacatttaccagttatgttaaatttggaacaatacattcaaagtgaaaatggtaagtaatttaaaatgcataaccaaaatgtctttccatacattcggaaacaaacagactttcttctgttatgcacgtgttgtattttataatgtattatgttaccaaatagaacagacctttagtaattgctcaagtagcggcttcatctctctcagcctccagctcctaacacctgtaggttgttgccacctcttctgtttttcttgaaatgctttctagaagcacaaaaaaatagtgatgaaaattgggtaatttttaatacttacaaaacataattctgcattagctttataggaatactctttaaatctatacttcttaacactttcttttaaacaatgtttatgaccaattttaaacaactgtgttcaccacccatatgctaaaatgatataataacctttttcatcagtgattaaggaattttctttcttctacatacataatcaacacatatgtcttaattcttgattttgaatgtagagtatttgacgacccttcctataatttgttgaccacagatgggtaagatatatacagaaattaactaagaaacattctttcttactaagattttaaacaggtaataaatcttggtcatttcagtatgcacacggatgaaccttccaataatgattgcctttctgcaccttgacctaatctccaacaacagtgttctcctctcctctacgtggcactcacttatacagtcatcccctagattttatcattcccaatgactgcaacatctacataatattaataatagcaatgataaagagcaatcatgggtcagatcacatcctgaaaaatttaaataaacccattacacaggaacctttcaatcctccaaataactctgacataagttctcttaccgtgtctccttttgcagataaggaaatttcggcacagagataaataatttgcccatggttcccgagctagcaatcgtcaagctggagttgaattacaagcagtggggctgcagtgtcccagcccttgaccactgcactcagctgtttctccatcttcccaacatacagccactaccttcctgccactgtaggtcactcacttcagtactacagctcaggagtctgttgagacccgacacccactgaatggaacacttttcactgcccattgcccacccccatgtgctcaggtaactcagtcccagctgaaattccacagccagtcatcatatccccatccctgcatctatgccctgcccaactctccttctatcaacgtgcgcagctacaccccaacccaggaaattccaaccctacagctgcttttgcacaaatatgccaaccgggctcactttaacttctttatcgctatgatgctgacctcagttggacccctaatgctgcgtggcaattatattcccctagtacatgagtccacttatgggcccccctctctgggctcatgctctcttccttctttgctggatttctgcatgaactattactacctgagacattgatacaataggttaatcataaagctaagcctgataccaacaatttgttcttcctcttcctcttcttcttcttcctcttcctcttcttctgtttcttctccttctcctcctcctcctccttcttctccttcttctcctcctccttcttcttctccttcttcttcctcctcttctttctcctcctcctcctccttctcttcctcctcttcgtcttctactactattacttctgctgctgctgctgcggcttctgctgctgctgcggcttctgctgctgctgctgcggcttctgcttcttctgcttcatcatctttctgcttctctgcgatgtattctttaaggacattcagcaacttccgagtatgtctataatcacgtttctgcctgtaacacataataagtaatacggtcatatgtcatagagagatgaaaaattaatcctattcaaaccaaaactgacttcacataatttatactataaagtagcaagggagtaatagcagctgaaatcttctttttgggaaaaggtgaaatgagttactgtcattctgaaaggatcccttcctaactgactactagagcagctatcttacattctttatgtgctgaaaacaaaggagagtttactgcactataaatttcccagaaacaataattttctctaacagcagtttacttttcatttcctcaaactaaataacatatgggttctcataagtaggttcaagaatatcatagccattcatcctgtaagatttcccaaaagaaatacttcacttaactctttctccactttggcacaacaatgattttctaaaaggaatagtgaaaacaatttaactaaaatagataacatatttacaacataaggttgtccctttccacataacttaatattgttaaggatctacagactaaacgttgaagacatttatcttatatgcagctgccatatttctagaaatggataaaaattaattttacaggaagactatttttatctggaaggcaaaaagaggtcatcttcattggctttctagataatatgcctcaattctgttaaactgaggttataaaacaaaagaaacttacctgcttagggaacaatcaagtaaaatatgttgctccctagagacgccaatatgtacaggacagtttttgaaattatttgcaccaacaaatacaaagaaatgatataaatatcattatgcaaaaaagccaacaatcatacctttttagttgtttttttttcaaagcacgttcaattgtgttcttggttttcctgtaagctgctttatctatttttatcatttctctttttgcagcaaggccctttttaatgtcagctagatagtaaatgaaaatgcattaaaagttaatgttgaaaagtggtttcttcgcatatattgaaatcaacgtgagatatgatggttcagcaatatcggaaggacatttacattgtaaaatacaaagatcatttcaaaaagcaagatttactcacttgttttctgtaaaaccttttacgtattaatattagtactctaattccaattggtataactgcaaatcacttaatttatggatgatgaaaaaaagcaagtaattttcgattttttaaatgtgcagaaagcgttacaaacacagactctaatttctacatttataaaatgtcctgtaattcaaaggacatgtttccatgaaatactgtcacaattcattatgtaaaacatacagaaaagtatcttatttaataagaccatcaaaagggtagaaataacttagtacacaataagaagagcattttttaagcaatctggtgattgatgctattaactgtattttaataaaagaagcatcgtccatgggtataaaaatttaggcttaagtaaagaaatacattcaaaaacacttttgaaatattttcttggagctttttatatgacatttttatccacagtgctgtgtttcagaaaactgtcctactgcaaggaatgctttcctaaacatggtttcacatcagagatctaccatcaattgctaaaaatagttttcagcaatcataaaagatctgcaccataatacaaatattttttacattctccatctataatgctcagttaggtagctcacaaaaccagcacttactcaccaagcagagcaaagctttccaaatatactgcttgtatgaattatcgctagagaagagctgaaaactgaattgagcgttttaaaaataagagtattgtctccgccgtctctacagaaattttctcaatttttttttgaaaatatggtcctataacagtcagtgcaactaacagttcacatggcaatacaaaatttatgagtttttggatccaattacatgtttctcactgggtagaaaacttgtctttccttttctagtacacagtttattactggaataataatagaatatcatcattttagataattcaattttctcttgtactttaaagaaaacaaaatcagaaagctgtgacaatagaatagctaaattaggaacataaaaactcatattaaaaactcttgagtacatacggacaggaagaggggaacaaaagacacctgggcctacttgaggttggagggtaggaggagggtgaggatgaaaaccacccatcaggtgctatgcttataacctgggtgataaataatctgtataccaaacccctgtgacacgcaattatctatataacaaacctgcacatgtaccctcaaacctaaaataaaagataaaaaaacctgatatatatacttaatctgtgtacactaaaaggaaccaatagagctgtttctcctccagtgtcctctaatatcccccaaataattaaatttccatgtgtatgaaagaaaagccatccctctcacttcaccattgttagaagcattctcacattccacatcaacaatccaaaaggtaagtatgaaaatttattaaacgcattacattaaatacatatgttaaatgctatatatgagaagaaggcatgttaagacagtctcgtcgtccactaattcatataacctactataacagttgtatggttgaaaataattttcaaagactacgaatagctcctaaaacatacctgcaatatgttctagcttcatggtatgaatcctgtaaaaaaagttacatcaaaattttatcataatgctacacaaaatgccatgtttgttgggaagatatgtcttatgtgaaatgttccgcatagaatagaatagtgatgacatgaaccaaagctgacttttcctaaaagaccctatccgacaggcaaaagtgacttaaacactttaccccgtgtgttcatctttttcagcaaaaggttctctttccccatgctcatcagttacatcttcctcccttgtttctgtaaaagggtttctttcctcacattcatcacggactggatcctttcctgcattaaaatgtaaaagacaaaccatttttagaggaagacgctgttgtggacatcttttgtagagaaacttattatttgtggacttttttggctctctaccaattaaagctttaaagcagagctatgcatggaatcactgggctccggaccgttttaccgaggcatttttggaagcccttccggttcaagtcctagtaaacaacgctcacaagtcagaccccttggatgtcaggaccgcatccatggagaagagctgctctgcgagcatctgtaaccctgctatgagggggagcctcccacgggaagcctaaggccctcgatcctgctttgaaaacctggggcctcttggcacatgcacaatggactccaaagccacgaaggggccaggggtctcgggctgcccatgtgcctcccgcgcaaagagcagacagaccgtcctcttgggcgtgcaccttcttttctggccccttgggctgtgtttacctgtgtgcttcttcgccggggcggccctaacttgagcttccaactgagctttggcagccttcctgctgcgcttcctgcccacgggctccatggttggctgtcctgggaagttagaggcgatccctgaacctggttgagtgcaaagtcaaactaagtaagctaaggaaacaggatatgtgaaaggagagccaacgggatctcggattcaagaaagggtggggctggcccaccccgtgtatcctgtgggagcaggaggggatggagaagatgccagtgtcccctcctatccttcctggcccgtccagcccctccctggggctggctgcagaactcacagctgcctcgcacacctgaatggcccctgcaggatccttgcggtgtccctgggacagagctcagccctgcccctgtgtgccccagagacctgcgtggcccggaggaccacgggtgccacaggacctccccagccatctctgggagaatgtcaggggctgcactgccacttgcctgcctggatgcccaggtgacccctcgtgaccccaggtgtcctgtcctgaccggcggccgggctggagggacccactcgaactgtcccccacaacacccctgcttgtcgcctccccacacactccgcccctcctcctccccttcccccatcccctcaccccacgaaccccacacccctcccctcccctgcccccatccctggccccacacccggcccctgcctatctgccactcccccgaccctcccccctctgccaccacccctcccttgctcccctctccaccacctccattcccccaagcccccctcccctgccccacccctccccactgcacacatccacaagtccccgggacaatcccgggccctggggatcactcaggtgtctccagctccctccctgccctggcccatcccagcccaccctcagggcctcgccctgacccaggccccaggcaacgatgccagggccatttcctgctttgaaaacctggggcctcttagcacgtgcatggtggactccaaagccacaaaggggccaggggtctcgggctgcccatgtgccccccgcgcagagagcaaacagaccatctccttgggcgtgcaccttctttcgtggccccctgggcggccgtaacttgagcttccaactgagctttggcagccttcctgctgcgcttcctgcccacgggctccatggttggctgtcctgggaagttagaggcgatccctgaacctggttgagtgcaaagtcaaactaagtaagctaaggaaacaggatatgtgaaaggagagccaacgggatctcggattcaagaaagggtggggctggcccaccccgtgtatcctgtgggagcaggaggggtcggagaagatgccagtgtcccctcctatccttcgtggcccgtccagcccgtccctggggctggctgcagaactcacagctgcctcgcacacctgaatggcccctgcaggatccttgcggtgtccctgggacagagttcagccctgcccctgtgtgccccagagacctgcgtggcccggaggaccacgggtgtcacaggacctccccagccatctctgggggaatgtcaggggctgcactgccacttgcctgcctggatgcccaggtgacccctcgtgaccccaagtgtcctgtcctgacgggcggccgggctggagggacccactcgaactgtcccccacaacacccctgcttgtcgcctccccacacactccgcccctcctcctccccttcccccatcccctcaccccacgaaccccacacccctcccctcccctgcccccatccctggccccacacccggcccctgcctgtctgccacttccccgaccctccaccctctgccaccacccctcccttgctcccctctccaccccctccattcccccaagcccccctcccctgccccacccctacccactgcacacatgcacaagtcccggggacactcctgggccctggggatcactcaggtgtctccagctccctccctgccctggcccatcccagcccaccctcagggcctcgccctgacccaggccccaggcaacgatgccagggccatttcctgctttgaaaacctggggcctcttagcacgtgcatggtggactccaaagccaagaaggggccaggggtctcgggctgcccgtgtgcaggtcagccggccgctcagcgcttcacaccctggttgcgagagggcagcatgctcgacttcctgcctccctaccgcgagcgcttcacctgcgcttcacaccctggttgcgagagggccgcatgctcgacttcctgcctccccaccgcgagcgcttcacctgagggacccctgatgccgcttcctc

SEQ ID NO: 1257 - DNA, 10589 bp, Homo sapiens
tttattagagaaaaatgtacttttctatgcccgtgctttctacgtttttgaaactgatacagatccacagaggtgaactgaaatctaaattatctttaatgttaaaatttaattgaccatgtacataactgtgcaatccctgccttctcacagaagtgtctaggattcattcaacagatcatagaaacgaggtctggcatttaacagacaagtgacagaggagctataccgatttatacaacaattatcaaaacactgtcatgtagtttactgtagctcaagttgtgctcgtatcatataacataggttcaagttctttcttcagtcatcagaataacagaggttgaagagacaatgaagtgccaactcttccaaaagctgtttcaaaaaaaaatttaagtaactgtgatacacatttctgcaaataaaatattccagtgcttacatcaatcctgagtttttaaacttaaatatgcactacttacagttctgacacgattctttttaaaaacacggctagttatcaagttcactttcttcactggaagaaatgatgcaataattgtctttagtgtccttggcagcctaaaagaaaaagtctagttcactgacaaaccaccactttacatctcacgttttaaacagggttaatcagatgtcaaaaggaaacagcttttaatattcaaaggatgctggttatttatttcaatttgaaaaaaactgtaaccaatacatggagctccaaatacccacttaaattttttaatgccagatttcagtgaaatattattttagcaggtccaattgtcatgtactttgcttgaataaaatgggttgatgagcatcttaaggtcaagatggagcaaagacagaaaaagtcaggcaggcttaccatgaaatatattttttcagcaggtagtgacccatgtattatcagcaatagtctacggaaagtggtttccattgaagggataaaatggttggtgatatgacctcatcaagttagagaaaaatgtaactatgtttgaaatatatactattccctcaacaaatagttcaacagttcctactcctgaaaatggtgtatgttaatgctaaggaagatgtaaaaaatgtaagcacaatctcttccataatcctgtgacatgagcaaatgcacaaataaaaaaaattaatacaaaaattgtataactgctatggaagggcaactcactcagacatgtagccaaaaatggagacgtatgttgacttagttggcaaaaggtttaaattggtcttagtcaaaaaaaaatttttttaaagcattgtgagggaagagcatgagaaaagcataagagtaacagtgaattccttcagggaaagctgtcaacctggataggcaggagcaaagacagagggcggcaagcctaagagggggtcatgtaaaggggagagtctctgaatatctaagaactgagacggggcatcactgacaggctgggaagagggaagggctaggaagcattttaggaaggggagggttttaggaagataatattgccgatcaatgaaggatggctcagaagagaagagagaactcagaaaagagtttaatagtacaagcaaggaagaatgaggtcttgaactagggcagctgcggtgggaattttaaaaaaagaaatttaagggccattacagaggtaaaacttgcctcatgataactgcatgggaaggataagggacttagaagagtccaagatgatagcaaagttcctaccctaagtggtaacatgtagcattaacattgacaggaaaacttctagtctcatgttcataccaattaataaatggtttctggtgaacattatagcaacattttctctacttgtgacttctatttaaataactgttttgtgtatagatcattctcaagttgcttgaaaattttattttcaaactcttttctcagtttatttaacacatctcagttagtgtagaggagtgacatatgaacatgtcttttcacaaggttattaaaaagaataccttacctcccagaagggaattccattgttacctaaataatgtacatctacatgaagaagaggtcattgatgacaatttgctaatgtgctatacgacagcagataattcacaattcacaacgtgttaataatttgctggctttcccattctgttatacatctgaaccatctcttatgactacaaattgtcatgtaaaaccattactagtcgctgataattttgaaagtgaatatgccataaaacactcctgtattacagcaggaaataaaagagacactcagtagttacacttgcctacttcctatttaactaaaactcttgaaacaacacaagtaaaaaagacatccagaaaggatttatggtcttcctgccttccaccatagatgtgtcattgatgtcctgaaaactgaaaataaaatcttcattaaaacccatttatgcctagtgttccattattggaacgctaagcttgtgggaatcatgtatctcctaccgctcaagaacatagccaaggtctgtttcttcacacacaaaaaatgtgcagcctccggcataaatgtgtcaatgcgttaacaatatacacaagatgtatatttccaggtaaaatttccaatttaccttttcctgttctaaataactcccacaaaactattcacgaatcctaaaaatacatttaccagttatgttaaatttggaacaatacattcaaagtgaaaatggtaagtaatttaaaatgcataaccaaaatgtctttccatacattcggaaacaaacagactttcttctgttatgcacgtgttgtattttataatgtattatgttaccaaatagaacagacctttagtaattgctcaagtagcggcttcatctctctcagcctccagctcctaacacctgtaggttgttgccacctcttctgtttttcttgaaatgctttctagaagcacaaaaaaatagtgatgaaaattgggtaatttttaatacttacaaaacataattctgcattagctttataggaatactctttaaatctatacttcttaacactttcttttaaacaatgtttatgaccaattttaaacaactgtgttcaccacccatatgctaaaatgatataataacctttttcatcagtgattaaggaattttctttcttctacatacataatcaacacatatgtcttaattcttgattttgaatgtagagtatttgacgacccttcctataatttgttgaccacagatgggtaagatatatacagaaattaactaagaaacattctttcttactaagattttaaacaggtaataaatcttggtcatttcagtatgcacacggatgaaccttccaataatgattgcctttctgcaccttgacctaatctccaacaacagtgttctcctctcctctacgtggcactcacttatacagtcatcccctagattttatcattcccaatgactgcaacatctacataatattaataatagcaatgataaagagcaatcatgggtcagatcacatcctgaaaaatttaaataaacccattacacaggaacctttcaatcctccaaataactctgacataagttctcttaccgtgtctccttttgcagataaggaaatttcggcacagagataaataatttgcccatggttcccgagctagcaatcgtcaagctggagttgaattacaagcagtggggctgcagtgtcccagcccttgaccactgcactcagctgtttctccatcttcccaacatacagccactaccttcctgccactgtaggtcactcacttcagtactacagctcaggagtctgttgagacccgacacccactgaatggaacacttttcactgcccattgcccacccccatgtgctcaggtaactcagtcccagctgaaattccacagccagtcatcatatccccatccctgcatctatgccctgcccaactctccttctatcaacgtgcgcagctacaccccaacccaggaaattccaaccctacagctgcttttgcacaaatatgccaaccgggctcactttaacttctttatcgctatgatgctgacctcagttggacccctaatgctgcgtggcaattatattcccctagtacatgagtccacttatgggcccccctctctgggctcatgctctcttccttctttgctggatttctgcatgaactattactacctgagacattgatacaataggttaatcataaagctaagcctgataccaacaatttgttcttcctcttcctcttcttcttcttcctcttcctcttcttctgtttcttctccttctcctcctcctcctccttcttctccttcttctcctcctccttcttcttctccttcttcttcctcctcttctttctcctcctcctcctccttctcttcctcctcttcgtcttctactactattacttctgctgctgctgctgcggcttctgctgctgctgcggcttctgctgctgctgctgcggcttctgcttcttctgcttcatcatctttctgcttctctgcgatgtattctttaaggacattcagcaacttccgagtatgtctataatcacgtttctgcctgtaacacataataagtaatacggtcatatgtcatagagagatgaaaaattaatcctattcaaaccaaaactgacttcacataatttatactataaagtagcaagggagtaatagcagctgaaatcttctttttgggaaaaggtgaaatgagttactgtcattctgaaaggatcccttcctaactgactactagagcagctatcttacattctttatgtgctgaaaacaaaggagagtttactgcactataaatttcccagaaacaataattttctctaacagcagtttacttttcatttcctcaaactaaataacatatgggttctcataagtaggttcaagaatatcatagccattcatcctgtaagatttcccaaaagaaatacttcacttaactctttctccactttggcacaacaatgattttctaaaaggaatagtgaaaacaatttaactaaaatagataacatatttacaacataaggttgtccctttccacataacttaatattgttaaggatctacagactaaacgttgaagacatttatcttatatgcagctgccatatttctagaaatggataaaaattaattttacaggaagactatttttatctggaaggcaaaaagaggtcatcttcattggctttctagataatatgcctcaattctgttaaactgaggttataaaacaaaagaaacttacctgcttagggaacaatcaagtaaaatatgttgctccctagagacgccaatatgtacaggacagtttttgaaattatttgcaccaacaaatacaaagaaatgatataaatatcattatgcaaaaaagccaacaatcatacctttttagttgtttttttttcaaagcacgttcaattgtgttcttggttttcctgtaagctgctttatctatttttatcatttctctttttgcagcaaggccctttttaatgtcagctagatagtaaatgaaaatgcattaaaagttaatgttgaaaagtggtttcttcgcatatattgaaatcaacgtgagatatgatggttcagcaatatcggaaggacatttacattgtaaaatacaaagatcatttcaaaaagcaagatttactcacttgttttctgtaaaaccttttacgtattaatattagtactctaattccaattggtataactgcaaatcacttaatttatggatgatgaaaaaaagcaagtaattttcgattttttaaatgtgcagaaagcgttacaaacacagactctaatttctacatttataaaatgtcctgtaattcaaaggacatgtttccatgaaatactgtcacaattcattatgtaaaacatacagaaaagtatcttatttaataagaccatcaaaagggtagaaataacttagtacacaataagaagagcattttttaagcaatctggtgattgatgctattaactgtattttaataaaagaagcatcgtccatgggtataaaaatttaggcttaagtaaagaaatacattcaaaaacacttttgaaatattttcttggagctttttatatgacatttttatccacagtgctgtgtttcagaaaactgtcctactgcaaggaatgctttcctaaacatggtttcacatcagagatctaccatcaattgctaaaaatagttttcagcaatcataaaagatctgcaccataatacaaatattttttacattctccatctataatgctcagttaggtagctcacaaaaccagcacttactcaccaagcagagcaaagctttccaaatatactgcttgtatgaattatcgctagagaagagctgaaaactgaattgagcgttttaaaaataagagtattgtctccgccgtctctacagaaattttctcaatttttttttgaaaatatggtcctataacagtcagtgcaactaacagttcacatggcaatacaaaatttatgagtttttggatccaattacatgtttctcactgggtagaaaacttgtctttccttttctagtacacagtttattactggaataataatagaatatcatcattttagataattcaattttctcttgtactttaaagaaaacaaaatcagaaagctgtgacaatagaatagctaaattaggaacataaaaactcatattaaaaactcttgagtacatacggacaggaagaggggaacaaaagacacctgggcctacttgaggttggagggtaggaggagggtgaggatgaaaaccacccatcaggtgctatgcttataacctgggtgataaataatctgtataccaaacccctgtgacacgcaattatctatataacaaacctgcacatgtaccctcaaacctaaaataaaagataaaaaaacctgatatatatacttaatctgtgtacactaaaaggaaccaatagagctgtttctcctccagtgtcctctaatatcccccaaataattaaatttccatgtgtatgaaagaaaagccatccctctcacttcaccattgttagaagcattctcacattccacatcaacaatccaaaaggtaagtatgaaaatttattaaacgcattacattaaatacatatgttaaatgctatatatgagaagaaggcatgttaagacagtctcgtcgtccactaattcatataacctactataacagttgtatggttgaaaataattttcaaagactacgaatagctcctaaaacatacctgcaatatgttctagcttcatggtatgaatcctgtaaaaaaagttacatcaaaattttatcataatgctacacaaaatgccatgtttgttgggaagatatgtcttatgtgaaatgttccgcatagaatagaatagtgatgacatgaaccaaagctgacttttcctaaaagaccctatccgacaggcaaaagtgacttaaacactttaccccgtgtgttcatctttttcagcaaaaggttctctttccccatgctcatcagttacatcttcctcccttgtttctgtaaaagggtttctttcctcacattcatcacggactggatcctttcctgcattaaaatgtaaaagacaaaccatttttagaggaagacgctgttgtggacatcttttgtagagaaacttattatttgtggacttttttggctctctaccaattaaagctttaaagcagagctatgcatggaatcactgggctccggaccgttttaccgaggcatttttggaagcccttccggttcaagtcctagtaaacaacgctcacaagtcagaccccttggatgtcaggaccgcatccatggagaagagctgctctgcgagcatctgtaaccctgctatgagggggagcctcccacgggaagcctaaggccctcgatcctgctttgaaaacctggggcctcttggcacatgcacaatggactccaaagccacgaaggggccaggggtctcgggctgcccatgtgcctcccgcgcaaagagcagacagaccgtcctcttgggcgtgcaccttcttttctggccccttgggctgtgtttacctgtgtgcttcttcgccggggcggccctaacttgagcttccaactgagctttggcagccttcctgctgcgcttcctgcccacgggctccatggttggctgtcctgggaagttagaggcgatccctgaacctggttgagtgcaaagtcaaactaagtaagctaaggaaacaggatatgtgaaaggagagccaacgggatctcggattcaagaaagggtggggctggcccaccccgtgtatcctgtgggagcaggaggggatggagaagatgccagtgtcccctcctatccttcctggcccgtccagcccctccctggggctggctgcagaactcacagctgcctcgcacacctgaatggcccctgcaggatccttgcggtgtccctgggacagagctcagccctgcccctgtgtgccccagagacctgcgtggcccggaggaccacgggtgccacaggacctccccagccatctctgggagaatgtcaggggctgcactgccacttgcctgcctggatgcccaggtgacccctcgtgaccccaggtgtcctgtcctgaccggcggccgggctggagggacccactcgaactgtcccccacaacacccctgcttgtcgcctccccacacactccgcccctcctcctccccttcccccatcccctcaccccacgaaccccacacccctcccctcccctgcccccatccctggccccacacccggcccctgcctatctgccactcccccgaccctcccccctctgccaccacccctcccttgctcccctctccaccacctccattcccccaagcccccctcccctgccccacccctccccactgcacacatccacaagtccccgggacaatcccgggccctggggatcactcaggtgtctccagctccctccctgccctggcccatcccagcccaccctcagggcctcgccctgacccaggccccaggcaacgatgccagggccatttcctgctttgaaaacctggggcctcttagcacgtgcatggtggactccaaagccacaaaggggccaggggtctcgggctgcccatgtgccccccgcgcagagagcaaacagaccatctccttgggcgtgcaccttctttcgtggccccctgggcggccgtaacttgagcttccaactgagctttggcagccttcctgctgcgcttcctgcccacgggctccatggttggctgtcctgggaagttagaggcgatccctgaacctggttgagtgcaaagtcaaactaagtaagctaaggaaacaggatatgtgaaaggagagccaacgggatctcggattcaagaaagggtggggctggcccaccccgtgtatcctgtgggagcaggaggggtcggagaagatgccagtgtcccctcctatccttcgtggcccgtccagcccgtccctggggctggctgcagaactcacagctgcctcgcacacctgaatggcccctgcaggatccttgcggtgtccctgggacagagttcagccctgcccctgtgtgccccagagacctgcgtggcccggaggaccacgggtgtcacaggacctccccagccatctctgggggaatgtcaggggctgcactgccacttgcctgcctggatgcccaggtgacccctcgtgaccccaagtgtcctgtcctgacgggcggccgggctggagggacccactcgaactgtcccccacaacacccctgcttgtcgcctccccacacactccgcccctcctcctccccttcccccatcccctcaccccacgaaccccacacccctcccctcccctgcccccatccctggccccacacccggcccctgcctgtctgccacttccccgaccctccaccctctgccaccacccctcccttgctcccctctccaccccctccattcccccaagcccccctcccctgccccacccctacccactgcacacatgcacaagtcccggggacactcctgggccctggggatcactcaggtgtctccagctccctccctgccctggcccatcccagcccaccctcagggcctcgccctgacccaggccccaggcaacgatgccagggccatttcctgctttgaaaacctggggcctcttagcacgtgcatggtggactccaaagccaagaaggggccaggggtctcgggctgcccgtgtgcaggtcagccggccgctcagcgcttcacaccctggttgcgagagggcagcatgctcgacttcctgcctccctaccgcgagcgcttcacctgcgcttcacaccctggttgcgagagggccgcatgctcgacttcctgcctccccaccgcgagcgcttcacctgagggacccctgatgccgcttcctcacagaacctgcaggcactggcaccacgacgctctcttagaaaaatg

SEQ ID NO: 1258 - DNA, 31 bp, Homo sapiens
acaatttttatatgtgctgccaaagcaagca

SEQ ID NO: 1259 - DNA, 1739 bp, Homo sapiens
tcaaaccatttaccctcgacaaaagtataggagatagaaattacttattctggtgcaatagatatagtaccgtaagggaacaatgaaagaactatatcaagcaccaaaaagcaaagacaaatccttgcatcttttgaataatgaattaactagaataaacttcacaaagagagctctagccaagtcccccaaaatcagaggagcttctccagaacagctagaagagtacactcatttatgtggcaaaatagtgagaagattcattagtagcagtgacaagcctacggaggctggtgatagctgattgtccaaggtagaattttagttcaactttaaacttaacctacagaattacttaatcctcctgtaagtttaactgttaaagggggacggatcttcagatactagaaaataaccgtcctatagagagtaaaagattttaccaccataattggcctaaaagcagccaccaattaagaaagcgtttaagctcaacatctgactaacttcatttctaatcaccctgttaaactcctaatattacattggactaatctattattcagtagaagcaataatgttagtgtaagtaacattaagacattatccattgcataagcttacatcagaccagaataatccactgacagttaacaacctaatattaacaaatgattaatagacatcttattatctttattttaacccaatacagtcatgctctaaggaaagattacaaaaagtaaaaggaactcggcacatttcaccccatctctctaccaaaaacatcacccctagcattgctagtattagaggcactgcctgctcagtgacatatgtttaagggttgcggtatcctgaacttgcaaaggtagcataatcacttgttccctaagtagggacttgtatgaatggccacaccagggtttagctgtctcttactttcaaccagtgaaattgacctacctatgaagaggcgggtataaataaataggagaagaccctgtggagcttgaattcattaatgcaaatagattcaaacaagccaacaggccccaatgtatcatccctgcattaaaaattttggttggggtggccgggcacagtggctcacgcctgtaatcccagcactttgggaggccgaggtgggtggatcacgaggtcaggagatcgagaccatcctggctaacatagtaaaaccctgtatctactaaaaatacaaaaaattagccgggtgtggtggcacatgcctgtagtcccagctacccaggaggatgaggcaggagaatggcatgaacctgggaagcagagcttgcagtgagcggagatggtgccactgcactccagcctgagagacagagtgagactctgtcttaaaaaaaaaaaaaattggttggggtgaccttggagcataattcaacctccgaaacgacttaaactaagaccgcactagtgtaagtcagttattacacattgacccaataattctatcaacaggataagtgaccctagggttaagagtgcaatcctattctagcatccatatcaacaacagggtttacgaccttgatgttggatcgggacatcctaaatggtgtagccgctattaagggatcatttgttcaatgattaaagtccttcgtgatctgagttcagaccagagcaatccaggttggtttctatctatttagcatttttcccagtatgaaaggatatgagaaaccgggcccacttcacaa

SEQ ID NO: 1260 - DNA, 97316 bp, Homo sapiens
ggacaggcaccgggaccacggcggggacgcgaggactggagccgcgacctccccactgcgagcgagctggcctcccttgcggcgcgccggcgtcggaggggcgacctgcgggggctgggcttcggcggaacccgagcggggcctaccggtgagcgcagccgaggactggcgcttgggggcggggccacggcggtgagcgcagcccgggactggagtttggggcggggcctcgtcggtgggcgacaccggggactagagctaagggtggggcctcgcggtgagtgcagccggggacgggacccaaggctggcgacgggacccaaggctggcgacgcgacctaaggcagtgggcgggcccttggcgatgaacgcagtcggggactaaagctggacgcggggcagaggagggtcctcctcggatagtgagcgcggtctccagcggcgagcgaggcctggggtgaggactcagccggatgcggggctgagggtggggggcggggcctcccgtggagagacggcctgcgaagggaactggagctgtgggcgggggaagggggcggagcctgggtctggacccgaactgtgggcggggcttgaggcgagggggccgagcgtggtgggcggggccttggctcctgagggcgacctgggacccaaccccgggctctgggagtggtgggcggggccagggcagctgcgctggggggcctggccgcagaggtggagacacccgccaggggccaccctgccccgccctccgcatttgcggcgtccgccgctccgctcgcccaggttccagagcctccccgtgcgccccgctattctccgttttctgttcccctaaaattcccactttctagcagtcattcgtggccacctgtggttacccgtgagtcacctcgctgtgccccctgcccagagcgggaaccctggctgcgcacgccctcaaatatctgcaggtgctgttcacaatcgccatagggccggtgacatacccaggaatgagcctaaaaagaaatgcgtaaccaggcgtagtggctcacgcttgtaatcccagcactttgggaggccaaggcaggcggatcacgtaaggtgaggagttcgagaccagcctggccaacatggcgaaaccccgtctccactaaaaatacaaaaaaattagccaggcttggtggtgggcgcctgtaatcccagctactcgcgagtctgagacaggagaaccacttgaacctgagaggtggaggttgcagtgagctgagatcccgccattgcactccagcctgggtgacgggtgacaagagtgaaactctgtctcaaaaaaaaaaaagagaaaaaaggaaatgcggaagaccccaccctcttttttttctttcttttttttttttttttgagacggagtctctgctctgttgcccaggctggagtgcagtggtgagatatcggctcactgcaacctctgcctcctgggtttaagcgattctcctctctcagcctcccgagtagctgggattacaggtatgcaccaccacacctggctaattttgtatttttagtagagacggggtttctccatgttggtcaggccagtcttgaactcccgacctcaggtgatccgcccacttcagcctcccaaagtgctgggattacaggcatgagccaccgtgcatggccctatttcattaatttctgctctcatttttgttagatccttctttccacttaatttggttcaatgtgttccctttttctagtttcttcattttttaaaaattgagatagtgtctcattctgtcacccaaggtggagtgcagtagcataatcaagcctcactgcagactctacctcctgggctcaggtgatcctcccacctcagcctcccgagtagctggaactacaggcatgtgccaccacacccagataatattttttgtagagatgggtttttgcctcatttgcccaggctggtctggaactcctgggctcaagtgagccacccgccttgtcttcccaaagtgctgggattacaggcatgagccactgctccccgccctgtcctcccaaagtgctgggattacaggcatgagccactgctccccgccctttctctagttcttttttttttttgagatagagaacacccaggctggagttcagtggtgccatctcagctcactgcaacttccacctcccaggttcaagtgattctgtcacttcagcctcccaagtagctggaattacaggcatgtgccaccacgcccagctaatttttgtatttttagtagagatggggtttcaccatgttggctaggctggtcccaaactcctgacctcaagtgatccacctgtcttggtctcccaaagtgttgagattctacacgtgagccaatgcacccggcccctttttctagtttttgttttgttttgttttttgaggtggagtctcgctctgtcacccaggctggaatgcagtggtgcgatcttggctcactgtaacctccacctcccgggttcatgccattctcctgcctcagcctcccaagtagctgggactacaggtgcccaccaccatgcctggctaattttttgtatttttagtagagacagggtttcactgtgttagccaggatggtcttgatctcctgacctcgtgatccacctgtctcgccctcccaaagtgctgggactatgggcgtgagccatcgcgcctggccttttcctagttttttaaggtgaaagatgaaatcattgatttaagatctcttttcctttataaataggcattttattgctataattctccctgtaattaccactttagctgaatcctgcacatttcaatgtgctgtgttttcattttcattcagctcaagattgtctccactcttaatttcctcccggatccaagggttattaggaagtgtattgttttgtttctaaatgttggggatttttcaaatatgtattattgatctctatgcaaaatgctctctgtccatgatgacatttcatccttatggcaacactagcttgcagacactgttgtctccattttatggagggagcccttgaggatgtgaggggtgacagccccaaatctcatagccagtaggtaacaaagccagaatccaatctgaggccatgtggccactggatccttgctctcacctgacagactagaggggttatttcgtgtgctccctcaccaaagcctgtgaggtgcctgcaggtgcaaggggcagcatgcctcccaggccacagcggtgcaggacagtcaggcagtacaggacagtcaggctgtacaggacaggattggccagaggagcagagggtggggaagaccacacccacaacggtaagaggtttaaagggtgtggtttcagccaggctcggtggctcaggactgtaatcccagcactttgggaggctgaggagggcagatcacgaggtcaagagatcaagaccgtcctggccaacatggtgaaacccatctttccaaaaaatacaaaaattagcaggtgtgatggtgggcgcctgtagttccagctactcgggaggctgaggcaggagaattgcttgaacctgggaggcgggagttgtggtgaggcgagatggcgtcattgcacttcagcctggacgacaagagtgaaactccatctcacaataaataaaataaaataaaataaaatataaaaaagggtgaggctctactgggcaatggcccaaggtgcgtgctgccagaactaagcctttgctcagatgggctgcagaggaggggtgctatggtctgaatgtgcattgtatcagtctgttttcacactgctgataaagacatacgtgagactgggcgattaacaaacaaaagaggtttattggacctgtagttccacgtggctgcagaggcctcacaatcatggaggaaggcaaggaggagcaagtcacgtcttacgtggatggcagcagggagagagagagcttctgcagggaaactccctcttataaaaccgtcagatctcgtgagacttattcgcaatcacaagaacagcacgggaaagacctgcccccatgattcaattccctcccaccaggtccctccacaatatgtgggaattcaagatgagatctgggtgggtacacagagccaaatcatatcatgtgtgttcccccaaagtccatatgttgacgtccttgccccaaggcgatggttttagagaggtggggcctttgggagatgaggtcatgagggctgcttccctcatgagcgggattaatgccctcagaaaagtggctggctgggcacagtggctcacatctgtgatctcagcactttgggaggctgaggagggaggattgcttgagtccaggagtttgagaccagcctaagcaacatggcaaaaccctgactctacaaaaactacaaaaacttagccggttgtggtagcatgtgtctgtagtcccagctacttgggaggctgaggtaggaggattgcttgagcccagaaagttgaggctgcagtgagctgagatcacaccactccactccagcctgggcgacagattgagaacctgtctcaaagaaaaaagaaacaagaaaaaagaaaaaacgtggctggagggagcttgtctgctgcttcccccatgtgaggatgcaggaagagggcactgtctatgaaccaggaagtggccctcaccagacacggcatctgccagcaccgtcctgtgaaatgaatagtggtttataagccacttggactgtggtggtttgccattgcagtgtgaaccaactgaggcagggagtaacgctccccacgtgatgtgaaggcataaagaatggagccaggttagagggagaatgcggagaactgccctggggaccggttaggtgccccatgctgcaagcgccccaggaagcttggaaacatttaggactgactgacaagctcaaagagtcaagcaagggcggccaaggggcaccagtgccctcagagcacccacactgggcacccagcaccagcttcctgtgcccagggtcctctgtactcctcattcagccctgcaaggcaggaccctcactcgcaccgcgccaaagaggacgctggaaacgtgcagtgatctccgctctggctgtaaacagggagaggctgtgggcttgcccctagacctgactccagcacacagcagcagagcggggcccaggctgggggtgtggggcaggaacattccttcatgggggccccagagagctggaaagtaatgtaggtgttgcactgaaatgagagaattgctttaatctgaactgaacgtgctcgtaacacttagaccaggaaggatttccttttctcagggcctgagaaaaatgacctgaccagcagggttagagttttgaaggacacgcctaggcacctgcaaacttcccctcctggaggctttcttcattcatggtgtcttttgtttttgggtttgttttgttttgttttgttttgttttgtttttgagacacagtcttgctctgtcccccaggctggagtgcagcggcgccatctcgactcagtgcaacctctgcctcccaggttcaagcgattctcctgcctcagcctcccgattagctgggattacaggtgcatgccaccatgcccggctaattttttgtatttttagtagagatggggtttcaccatgttggccaggatggcctcgatctcctgacctcgtgatctgcccacctcaacctcccaaagtgctgggattataggcatgagccaccacacctggcctgttttttgggggttttttttgagactgagtctcgctgtgtcgcccaggctgtagtgcaatggcacgatcttgatgtaccgcaatctctacctcccgggttcaagcaattctcctgcctcagcctcccaagtagctaggattacaggcacctgccactgcgcccagctaatttttgtatttttagtagagtcagggttccatcatgttggccaggctcgtcttgaattcctgacctcaaatgatccatctgccttggcctcccaaagtgctgggattacaggcgtgagccaccgtgccaagccccatcgtgttctcatctgtggtgctttgacatcttggggtctcgtggacctagagagggactcccctcccagggttagctaattcctagagacagctgaccacttgcctctgagtatgccttatttactttattttttctttttttcttttttttttgaggcagggtctcactctgtcacccaggctggagtgcagtggtatgatcatagctcactgtcgtctcaaactgctgggctcaagagatcctttggccccagcctcccaaagtactgagatcccaggcttgagccaccgtgcaggctgagcatacctttgatatgcagagcaaccatcatgagtcccacctgcctcctttcatcaggctcctgcattcctgaacactagccccctgccctaaatcaccccaaggccaggtaccagctagctagataccacccccaagcccagagcccactgaaatgacccagttctaattctgctcagcttgcctcctctgccttgcctggaaaatggcaataaaggctcttgcccaccctttcccttcaccccctccctgtcctgactggccctgggtgcttccccacgtgcccctcctcctgggaactgtgagtaataaactcctctttcaaaggcggttgtctctgtgtctgtcatcttatcacatttgatcaaaataactcctgggtactcaatagccctgtccccccatgcagcagtcagcaggggaaatgagaaagcaagcttctatggccttctcaccttctcacctgctgcctggccttgggcaagtgcttcaatctctctaggtttctacttcctcatctgcataacagggataagaatagcccaccctagcactgcggagtatgatggaggacatgtgtctggtagacagactgctcagaaggcaagtccctgttcctgtctgttctccgcaactcgagtgagacttggtgaggctccagtccaccttccaccacagaagtcaagggccaggccaggacagtggctcacgcctgtcatcccagcactttgggaggcagaggtgggaggatagcttgagcccaggagttcgagaccagcctgggcaacaaagtgagatccctgtctctacaaaaaatttaaaaattagctgtgcgtggtggtgcgtgcctctagttcagctacttgggaggctgaggcaggagaatcgcttgaacccaggtgactgaggctgcagtgagttatgatcacaccacagcactccagcctggaccatagagtgagactctgtcccccccaaaaaaacaattaggccgggcacagtggctcacacctgttatcccagcactttgggaggctgaggtgagaggattgattgagcccaggtgtttgagaccagcctgggaaatatggcaaaacagcatctctaacaaaaatacaaaaattagccaggtgtggtggtacatgcctgtggtcccagctactcgggaggctgaagagggaggattgcctgagcccaggagacagaagttgcagtgagctgagatggcaccattgtactccagcctgggcacgacagaggcagattctgtctttttttttttttttttttgagatggagtcttgctctgtcgtccgggctggagtgcagtggtgcaatcttggctcactgcaacctccgcctcctgggttcaagtgattctcctgcctcagccttctgagtagctgggattacaggtatgagccactgtgcccagctaagttttgcagttttagtagagacagggtttcaccatgttggccaggctggtctggaactcctgacttcatgatccgcctgcctcagccccccaaagtgctgggattacaggcatgagccactgtgcccagccatgactttgtctctaaataaataaataattttttaaaacccttagggacccagcacagtggttcacacttgtaatcccagcactttgagaggctgaggcaggaggatggtttgagtccaggagatctggcctacagtgagccatgatggcaccactgcactccagcctggttgacagagcaagaccctgtcaagaaaacaaaagaaaaaaaaagaaaaagacaaacaaaacctaacaaaaccagaaatccatcctgcacgaagagcactgaggttgagtgttggttgacacgtgttgcggtaattgctgttctgatgtctgtgaatgtccttggctgatttctgtattagggcctgggtgttttcctttcttttctaatatttaagttatgtcctggcttattgtgatgatattctattgtgggaaagaaagaagtgttaaaatttatgcatcaaggtccctcttaatcttggggctcaggataaccacagtcaagaggggagagttttattcctgaatccaggtcatgctgtgttcaactttacaccctgatttgtcacacaatcacatatctgagaatttccccatgttgctaaaactgaggcagcgttccgttttgctggttattccacatcccatggggtggatgtgccagggcaagttttgtcatttcccctggactggacattcctttctgtaggtgttgctgtttgaaatatctcacacacctggacctgtgtccctgttgacatttccagtgtcacctgcaggatgccatgggatacccatgagcccaggcaaatctcccaagacgctgccaagccactctgcagagctgctctgggtcctgccccaggtgctgtgtgagggagctgcgctgcctgcgcccaacccaggaggggagcagcgtgcaggacaccgaggatgtcatcacgaccttaggtctgtattaggtctagattagcctgcattaaggagaaggtggtgatgtgtgtcttttttttttttttttttttttttttttagacggagtctcactctcttgcccaggcaggagtgcagtggcacaatctcggctcactgcaagctccgcctcctggattcaagcaattctcctgtctcagcctcccgactagctgggactacaggcgcccgccaccacacccgactaatttttgtatttttagtagagacggggtttcagtgtattggtcaggctagttttgaactcctgacctggagatccacccgcctcggcctcccaaagtgctgggattacaggtatgagccaccgcacccagccatgtgcatctttttataatttacaattcgtgatagtagtgacaactgtctcacttattcttttgtgaatcttttgtagcttctctaaccattttccactgggaattttttagtggtcttatggacttgtatgatttcctttgatattaagaatgttaccctagtgagccaggcacagtggctcacgcctgtaatcccagcactttgggaggtcgaggcgggcggatcatgaggtcaggagatcaagaccatcctggctaacacggtgaaaccccgtctctaataaaaatacaaaaaattagccaggcgtggtggcaggcgcctgtagtcccccctactcaggaggctgaggcaggagaatggcatgaacccgggaggcagagcttgcagtgagctgagatggcaccactgcactccagcctgggcgacagacagagcgagactctgtctcaaaaaaaaaaaaaaaaaaaaaagaatgttaccctagtgaaacattcagtattcttacaaagatcatcctcaatagtttgttgcgttgggtgagggttccctttgcacgtttggttttttcaggacggggcgcagccccagccagatggcgcccggctctccagccagcggcagctcaccctgctgtggtttgattttccctacacaattaatacatgttcatcatggagaaaataggagataaagataagcaaaaaggagaaaccaaatcaatggaatccccatcacacagagatactttcttaacactttggattaatttgtatcctatcaatatttttctatacctgaaaataggtgttttatatgtataatcactaacatgtaaatacatactgcacatggacatgcattttcacatacatttttgttttcttgagacagagtttcactcttgtcacccaggctggagtgcagtggcacaatcttggctcaatggaacctctgcctgctgggttcaagcgattctcctgcctcagcctcccgagtagctgggattacaggcgcgcaccatcatgccccactaattttttgtatttttagtagagatggggtttcactatgttggccaggatggtcacaaactcctgacctcaggtgatccacccacttcggcctcccaaagtgctaagattacaggcatgagccactgtgcccggcctttttatttttattttttgagatggagcctggctctgtcccccagactggagtgcagtggtgtgatcctggttcactgcaacctccacctcctgggttcaagtgattctcccacctcagcttcccaagtcactgggatcacagatgcgcaccaccatgcccaggtacgtttttgtatttttgttagagatgggactttgccatattgcccaagctggtcttgaactcctgaggtcacgggatctgtgcgctttggcctcccaaagtgctgggattacaggtgtgagcccctgcgactggcctgtttttagctacttttaactcactatttctgccagctgtagaatattctatcaggttctatcatggctcacctaaccctgttctactctacaaccccggggttgattccaggcctcactctcagcagttgagctgctctaagggtgaccgtgggaactgtccacaggtgcggctgcgggtgcagcgatctcagcggtcttagagctcttggccatcccccacatggcttcccagaaaatgcctccaggaggagggccctgctgtaccttttttgtgaccattcctcctcagcctcagtcatggccatgtgctccaaccatgggagtggatgcggcagggcctgtctaggggttcggcagttctgtccctctgccatagcatgggctgggcagggacctggccacgtggggctgcttcctcagcccagctcctggcaggagaaggagtaggggcgctgtgggctggagccgccaactgaccagtgctggccctggaggaggcccctcccccactccccgacttcagcagggcctgctgtgtgtctgtgtcatcttagcccaggctgaggagatgaatgcgtttccaagcagcccatggtcctggcgcccgactggaaaagcctgagccttcaccctaggtggagggacctagcgaagccaggcggacagaggaaaggcctcggcccatcctgtcccatgactgggggttggggcttcgtctttttaataccaatggaatcctagccaagcattcagaaccttgaagctttaacttcttaaataataataactcccacaacctccggggaccccgggcagcacgtggtaggaccagctttcaggttgtcctcctgagaccccagggctctgaaggatcctcttcttggacctcctccccaaccgtgcccagccaccccagtcatccgagaggtttgtctcaaaccaagttcctgctttaaagaaaacgctaccagagaaagcacctgtgctccaaacacgggggtgagggctcacaccatgccagggtcatagcatggggagggatgcctcccagccttcaggggatctcctcctgtgacccacagccctcaagagaaggaccagcacagcatcattttccgacagaggagggcagtgcaaataacaagttctggctaaaaagttactctgatcacccaagggacatctgtgcacttggaaaatacagaagaccacagtcccatcaccaccatcccaccttaaaaacaaacataaacgtggtcgcaggcgtgacacatggtgtgtttcgtgtccctgctttcctgcctggcagaagcattgatgtagacccaccatacgggttcttcgggccactctggtacagactgtgtgggtcatatcccgacccctggcagctgcataacctcacaggccgccatctcctcttttgtcacttgggatgggacagaactgtcacgtcccttaagggctcacaacggtgcctggcacagaggaggggcaccgctcaatggtggcagctggtgccaagccctgctgtgcacggcttagtcaccccgcatctcctcacttgacccccagttgtagtccctgcctgggttagacgctggcatacacaggcaccatgtgtcaggcggcccatccgtctgactgcaactgcacgctcgccaggtccagcagcgccgtacgctcagttctggggtcaatgggtgcctgtctcctgccctcccatcacagacagcctgtcctcctggggtatggctaccccctctctggacatagtcacttctccccctaccctgtctcaaaggtatgagatccaccggccctctgcccgccgagcagctggccaaggtcagacagaccctcatggctctcagtgtaccaccttagaggagccaggggcgcgtgggaaacacagagtcccttgttctctccgaagtgggaccctgactttaagcagtcgcagctgtttgcagttctagatacaggagttacagctggaggctgagctctctcaacggaggaagcagcggcatgagggcctttgcagaaggagctgacggggcactggggtggcaagccccgtgggccaggaaagaaaccagctccaggtcaatttgctcgggctggatttgtttcagtaaaactacttgtagacaagacacagggcgaagagaaaagcaactgtaaactaactgtgaaacaaggaaacagaagagaggccagaaaaccgtttcctaaatctcggcttggcatctggtgctggaccacagccgctgccaaacagatgggggaagcaccctccctgagccccagagcctacacgtcgggccccagcggctctagccattgcctcctctttgcttgggtccccaagttcactgttaaccccagggccaggagccagccttggccccagacatttgttctccattgtcctgagcacaacgctgaaaagcggcgctgaataaggatgctgggacgcaaagagggcgcccggggtcatctggagccctggaggctaagctcggcagcctggcgccccgagtggcttcgagtccccgcgaccgccgccaggcccggccacctccttgccacctccctgcgtcccggggaacccacgcaggggggcgcgagggaggggctcggggacgggcggggcccgcacagccgggccaacccagcgggggtcggcaggagacaaggggcggcgagggcaggggggcggggagactcggggcatggcggggtggaggcgggaaagtgtcgaggccggggaatccgcgcgtggggaggtgggcatcgccagggcgacgatgagctttccttagggggcggcgcctgaagctggccgggacccggtggacccccacgactctcccggcccttgcccgcggctcccggggggcggggcggggcgccccgggcggggtctgtgcgcaggcgcgtgagtgcgcgctctcgcgcaccggcgggcggggacgccccgtgaggcgccgccggaggaagcgcgcgcgcacctcacttccggcgcgcgctgcgccggcggcgattggacccgaggcggcgagctggcgccccgcccagccaatcggcggcgccggcgcgggtcggagggcgccgggcgcgcgcggggcggccgggggcgcgcggggcgcgggcggggcgccgggcggggcggggcggagcggccgcagctcgtcgccgcccgcgggcctgtccgacgccggggcccggcccgtcccctccgccgcccggcagccatgtgaccgcgccgccgccctccgcgcgcccggcccgcccgccgcgcgtccgcggcccggccgcagccccaggccgccgagggagcggcggggccggcgccatggccgagcgaggccgcctcggcctccccggcgcgcccggcgcgctcaacacgcccgtgcccatgaacctgttcgccacctgggaggtggacggctccagccccagctgcgtgcccaggtacgcgccgcccgccgcgctttgttcccgccgggcacctgctgggggtgtcctggccgcggcctctgcgcgccccatccccggcccgggtcccccagcggagcccaggtcgccccccgcgcccccgcccgccggttcgacgcgtgcagccgccgcccccccgcagctccggcaagcgcggccccagccccccaggtcccgagcaccgggggccgcgctcagcttccgaggacccggtgctgctcagacccggcgggaccttggggctcccgggcggcgctcacctggctcgccgcaaccgcacctgcacacctgcctcaatgcggtgccggccggggtgacgagggtgcttcctctctcgggtaccacacgcttcctttcgcgttcggcgacactgtcagacctcggcctgggagcgacccccggcgcacggggcgcgcaggactcggttgtatcctccgtccagcgcgcggtggagatgccctgtcctgcggggcggggtcgtcctcgcgggtacctggttggcgctgtctctcatttagaggcgtcgccaagccagtactgctatttgcgcctcccagttgatcttgccattgcggaagactggctgttctgcacttggtaggggggcgcccggtcgcccagcggtaacgattggacagggtttaccctccggccatagcccagccttccttggacttgcagcttccctgagtctcctgctcagtttgaaacttttgtaatttcttcgtgacttggtagttcctgctcaggaagctcccaggctaaggaggagagagacacgctctccggaaaagttctggttctagaatagacagcaggcgagaagaggaggcggttgggggtagtgagagttctccctggggagatgggagggtgagcggaccttccaggcactggaagtggccagtatgcctggaggggaccccacgtggcattgagttgttccacccctagtcagctgcaggtgggcctctccgtgctttcctgtggctcccacagcctgcatctctgagcgtggtgttggagttgcagagccgctggacagtggggcttgccctcctggagcgcagggttgggacctcggggctttggttttgctgagtggacaggaaggatgcccacccggcacgactcttgcacctggcggggcctcccgaaggacccagtgtccatatgagacctaagggtcagcatttgcccaaggtctggggccgagcactgcagatgtgcctgcttgcctctcttctgggaagtctctggggcctcaaagccaaagccaggagcatctccccaggcctggctgcttctccattccaggtcttggcgattgccccaatgtcaggtcccacagccccacagcccttctcctgtctgcccctctgagtcactgcctcacccacagccccagaaccttcatgcgggctgttggcgctcccctgctccagcactgcagcacatagcctgcccttgctgaacctctgcagcagcttcctggggccctccgaatgagcagcaaagtctttaacccaagggaggtgggggcgtgtggcaggaggggccgggggccttatcagcccccctgtggagctgtgctctattctccaggggtctagaaagcccactctggtgtctgtggggagggtatgggtagggcgggtttcgagaagcctggttaggacaggcgggggtagatgggggcacctgggctgggtagcactaagtgctggggggggtcccgagctctggcctggacagggttgggaggaagggtaggcaggaggacaggatttgttctgttggtgtggagttaatgggcggaggagttaatgggcggaggggcgagtggcgcagctgaccaggtgggcagatgcagtttgttcgtaggacatgctcagcctcataatgagctcctgcccttacctgtcctggaacagggcccctcataggcgggcttgcccctagctttgctttgtgcttgtgccgcctgtccgtgcatcctcggacagtctgctacttagttttgctttgttcctcctgagttcttctgtactcctcacttttgcccagccatgaagcttctgggctgcgtgtgtgctgatgcctttcggcgtgttcactgctgcgtactattcactggcgtgacagtacctcggctttgcttctgtcaagggaccttggcttgtttccagttttttggttaattacaagccccgtgctgctgtggacatcgtgtgccagtcttctgcgtgtgtctttctggatgggcagggcctgtcttaagcatgtaccgccagctaccaggatttatggtgggggtgtgcacgcactcagcgttactgctgggcagttttccagagtggttgtgcctgctccggcccccactgacagggacgagagtccccactgctccacatttgtgccaacactcatttgacttaatttttgccagtctggtgggtgtgaagtggtatcgtggttttaacttgaatttctctgattactaatttaggccatttgtacttccttgtcagtgaaattcctgttcctttgccagtttttttttctctttttttctgcttgagtttcagcagtttctttagagatagtcatcctttctcggctgtgttgaggatgtccccgtccagttatgagcgagtctttgctctctgagcagcctctgggtgcactccccgtgtcagcctggtggagtgtgcacattgactgtttgccaggctggggtgctggtctcgtttcggttctccttctgggaggcagccggagaagtctgcccccgggagcttgaactgggcatgctgggctgttgttggggaggcctgtgctccgggtttccttgcgacgcttttggctcagcactgttacacacggtgctcctaggtggtccacggggtatgcgtcagtgcctgtctgtggcctctgcctcctgggttcccagagtgtcctcctggtgcccatgtccctgagcgcccccacctgctcttcagcaagggctgggctgctttgtaccttgcccttcccacttgattgttttttcggttgatgtttattaatttgtttttatttatgtattttgttgttgttgttgcagagacagggtctccctatgttgcccagactggtcttgaactcctgggctcaagtgatcctctcacctcggcctcccgaagtgctgagattacaggtatgagcccctgggcctggccatctgtttggtttttagagacagagcctcactttgtggcccagactggggtgcagtggcttgatcatggctcattgtaacccctaaaacctgggctcaagcagtcctcccacatcagcttcctgagcagctgggactacaggtgtacaccaccatgtctgtctaatttttttgttttgttttgtttttttgagacagagtctcactctgtcaccaggctggagtgcagtggtgcaatctcggctcactgcaacctccgcctccctgtttcgattttcctgcctcagcctcccaagtagctaggactacaggcgcctgccagcatgcccggctaatttttgtatttttattttatttatttatttatttatttttattttattttattttattttgagatggagtctcgctctgtcacccaggctggagtgcagtggtgctgtctcggctcactgcaagctccgcctcctgggttcacaccattctcctgcctcagcctcccgagtagctgggactacaggcgcccgccaccacgcccggctaattttttttatatttttagtagagatggggtttcaccgtgttagccaggatggtctcaattttctgacctcgtgatccgcccgcctcagcctcccaaagtgttgggattacaggcgtgagccaccacgccctgcctattttatttttttgagaagctctgtcgcccaggctggagtgcagtggcacgatctcagctcactacaacctccacttcccgggttcaagcaattctcctgcctcagcctcctgagtagttgggactacaggcgtgcaccaccacgcccagctaatttctgtatttttagtagagacagggtttcaccatgttggccaggatggtctcgatctcttgacctcgtgatccgcccgccttggcctctgaaagtgctgggattacaggcgtgagccaccacgcccagccagaattatctttttaagtttcacacaaagccacatttggtttataattggaagttctttaactctgtagagcaggttggggagaattgacgtttgtgtggtactgagtcttctcattcatgatcaagctatttacttaggtcttgaatgtattttgagagttttacaagattctgctgtcatgcatatcctttgttacatttattcctagatgcttgtattttagaagtcatagtaaaagtcagctttttattatgtttgttgctaacatatagaaattcagttgatttttcaaagaaatcagtgattttactatttttaacctagtaacttatctatagattattttgtattttcaaaatgtatgttttgtcttttgcaaaagacaaagttgtttcttttcaatcctcatacttttctttctttctcttgcctgactgtgccagttgtcatagtacagtgttgaatatggttggttgcgtggattacccgtgttctgtcttgaccttaaggaaggtttccagtgttttacctttaaggacgatgtttgctgcaactttttgtggatagcctttatgcacttaaaaagtctcatcctattcatgacttgcaaaggctttttaaagaaatcattatgagtggatgttgaatataatcaagtactttcattaagaggattatataatttttatcttttcattactattgtggtaaattacataaattgattttatttcttttcttttctttttgagacagagtctcgctctgttaccaggctggagtgcagtggcgtgatctcagctcactgcaacctctgcctcccaggttcaagcaattcccctgcctcagcctcccaagtagctgggactacaggtgtgcaccaccacgcccagcgaatttttgtatttttagtagagacggggtttcaccgtgttggccaggagggtctcgatctcctgaccttgttatccgtccacctcagcctcccaaagtgctgggattacaggcgtgagccaccatgcctggccgtaaattgattttctaacattaacctattcctggaaaaatactagtttaagcatgttgtattaccctttttaaaaattggtggatatatatttatttatgtatttattttttgagacagggtcttgctcttttgcctaggctggagtgcagtggtgtgaccatggctcaagcaatcctcctgcctcagcctcctgagtagctgagactacaggtgcatgccactggcctggctaattttaaattttttgtagagatggggtctcactatgttgctcaggctggtctccaactcctggcctcaagtgatcctctcaccttggcctctcaaagagctgggactccaggtgtgagcctccctacctgcccacattggtgggtttagatgatagtatcttgtttaggacttctgcatgtgtgtctggggtctatgtgcttcctttcttctgtagtccttagcagattttggcgctaagatttccttgtgaaatgaaatgagtactgcctcttttgctgtatcgtggtatagcttatgtaaaattggaatcatttcttccttgaatgtttgggataattcacttataaaataacctgactggccgggcctggtggttcacacctgtaatcccagcactttgggaggctgaggtgggtggattaccggaggttaggagttcgagaccagcctgggcaacgtagtgaaatcccatctctactaaacatacaaaaattagccaggcgtggtggcacgcacctgtaattccagctactcaggaggctgaagcaggagaatcacttgaacttgggaggcggaggttgcagtgagcccagatggcgccactgcaaaaacatttttttttgaacctgctttctgggtcagtgtgtcaattttaatgcacgttctgtttatacttaaaaggaatgtgtgtttggcagttgatggtgcagtgtttgtctattagatcaagcttggtttactgtggtcttcaagtccgttccctttttttgtctactagaaatgtatgttaaaatcttataatctgagaatagattggtccgggttttctaacagttctgtcagtttctgtttgatactttttttttttccagacaggatctcactctgtcacctaggctggagtgtagtgggacgatcacagctcactgtagccttgaactcccaggcttaatcgatcctcccacctcagcttcccgagtagctgggactacaggtgtgcaccaccacacctggctaaattttgtattttttgtagagactgggtttttccatgttgctcgggctgatcttgaattcttgggctcaagcagtctacctgcctcagcctcccaaagtgctgggattataggcatgaaccactaacgccccgtcacttaatatatttttgaggctatgttattaggtacatacatgtttagaattgtaattctaggtattttgaacttttctcattgtatgactgcttttatatctagtaatgctttttgtctttagtattgactttgatgcaagcattcttttggataatttttgcctgttagctatttttctatcctttttaaaaacctttgtatatccttacatattagatgtgtctttggttattcagcatgtatctagatttcattttcattcactctgaccttttctgacttttttttttttgagacagagtctcgctgtgtcgccaggctggagtacagtcgtgcaatcttggctcactgcaacctctcctcccgggttcaagcgattctcctgcctcagcctcccgagtagctgggactacaggcgcctgccaccacgcccagttaatttttgtatttttagtagagacggggtttcaccatgttggccaggctggtctcgaactctcgacctcgtgatccgcccgccttggcctcccaaagtgctgggattacaggctgagcctctgtgcccggcctttttttatttttattttttattttttgagacggagtctctctcttttgagatggagtcttgctctgttgcccagggtggaatgcagtggcgcaatcttggctcactgcaacctccacctcccaggtcaagtgattcttgtgcctcagcctcccgagtagctggaactacaggtgcgcgccaccgcacccggctcatttttttgtatttttagtagagacggggtttcaccatgttggccagactggtctcgaactcctgacctcaaatgatctgcccgcctcggcctcccaaagtgctgggattacaggcataagccaccacgcccagcctaccctgtacattttaatgtgcatagttaattgtatctttactctcctgctgaactatgcagggaccttagcccactttattctaatccaaccctttcatgtttatatttatatgattttgttactgtgtatcttaattgttttcttgtgaagcccacaagatgttgttactgctttatactgtgatatttgatgagcttcaaaactcaccacttcctttgttgctcattcttcttgcatgtcaggaatcattttccttcttctgttgaatatttgttcttaggatttcctttagtgaggatctgctgataactaccttctctttctgtttgtctgaagatgttttagtttaccctcaccctgagcagggcgtgtgctggttgtacgatgctggggtggtgtgtgctcctcccacaggtccaggcagggcgtccctggctttgacttccagctttgctgtaagaggtcagcggccgtgacaggctggagggagacgtctgggtggctttgtggtcatgtcatcgttgccaacggtcgtctcatggtgggtcctggtgtgggttctcttgtgattgcctgagtcggggttactagacttgctgactttgtggatcgatgattttcatgagtcccgggaagctctcagccactttttcttctgctgttggttctgcgctattctctctctcacctctggagcaacaattggacgtgttgctcttcctgccggatcctccacatccatagatgcactgggtggtgtcagtgggcggcggctggctggggcagtagcctgtctccagcccttccccctgcctctgtccacgtgcaggggcgtctcctcaggacgcatgttgcctactgaccgctgccagcctgcacgagactctcacggcgggaccctgtctgccttgctcggtgctgcccagagcctgcacagtgtagctccttggcggacgttcctgtaatggaaccaggatgtcatgccaaggagtgtggtttcattttgagtggtggggaagtcgctggactatttcaagtgtgtgtatttgggagagcagtgctgctggagtggtggaccacactggaggtggagattgcctcagggtgtgcaggtggagatgggtgggaggtgtcgtgcagggcttgggacagggctttcggaggtggtctgcagtgatccagggaagatgggctgctctgagggaggggctgaggaagctgacctgggcagccagtggcctgtaggctgggcagcactcgagctggggccaaggggcagcaggacggtgcccgtagccctggaggccttggggattcggaggacctggcccatcgccgtggcctgcacggtgcgtgcacaccgctctgtccgcgcaggctgtgccctgctttcaagatgcctggaaacctctggcagctctgtcctgctgtcaacactggagtcacatgtcagtgggtctcctgctggggactggcttttgtgcaggagatggagggcagggggctacagtgcccttggactaaaggatgctttccttggatctgggcactagaaccagccctttccctctctctgcccagcattctcagcatgcgtctcaggaaggtttgatggagtgggcagctgcggtgctgtggcggggtcggggggctgctgcagagagcgggtctgcggtcagtcacagtgacgggggtctctttggaccctgtgacttgtgtgtggtggtggcaggcagtggcgttgccgagacagggtgctcaggtgcaggtgggaaggggtggcaggatggaggttgtacagtgctttccccaggaccagggggcagggtgtggcgtgcttattcctgcctggccgtggagggtctctgtaggacaggctcccgctgagggcagccctgaggcctgtgagctgctggccccgcagggtggctgggcctggctggctcagcagctgctctgagaggcagccctaaaaatagccgagcgctgagaggccgtccctttctgctccgcaggcgcgcgccgatgtgtgctcagctcaggccgacttagcagggttgtgagagtgatgagagcgtggctgctggtcatggtgctggggtcgtcagcagctcctcgagggctccggcctgtggaggccggtggcgccccgtctcaccccacggatggggggcaggctctccaggagccccagggagcactggctactgctgggctgctctcaggcccgggacattcatggccgtagccccaggtcctctgcatggtcaggggccatgctgggtcccctggggtgcagatgccgctcaacagaggagtcaggacccaaaaggggcagaaatgggcaagggaagacactggggaaggggtgggtctgcccttcctgctgggggtgcacacgggcctggggctgagcaacccgctctgggcctggctgttccgctccactgccccaaccagcctttcctcagcaccccctggccaagctgtgggcaccccctgcccccggacacaggcagcacctggccaagtgcagagacactccagctggctcttcgcctgtgtcccagccctgagggcaccgtcgtagggtggtgggacgggggggggctcggacacagtggttgtggaggggtcagtgctgtggctcggggtggggtggggctgggggagggtttgcttcagggtagcggctctcttcaggggttcagcaaggagacagatgggttctaatgacccctgagtcctgagacaaggtggggtgagctggagcaggggaggggacttggaagggccttcagtccccatgcagcccttgcacaacctttcgggccaacatcctgggccttgcttggcagaggagtttgggatccacgggcttgaggcccaggtggtcagctcgctcggtgcaatgctgtgtctcgcatttctgtctctcgactgccccatccagcccgtgtcctaagagcagctggcagcagccgccacgcacaggcagctcagctcagcagccccaggagccaggtgtgtcttgagctgggcagcaaagtggccatgcagtccagcctcccttcagccttccccaggatgcctttcatcttggggagatggccattgtgggggtgaccagcactgtcccttccctggcaggccaggatgtggatccacagcgaggcagacctgcagatgcacatccctcttctcaaatgctgttcttgttctggtgagcacggggaacggcaccaagccaatgctgatgggaagggccctgaccttgggctgctgtcctgcgagcttggcccctctgctgggcccctcctccatgcctttgtttactctccaaccttctgggagtcccacatctgcatcaggacagaggtgaccagggaccagttgacagctaggatgccaccagcatcttttgtttaatttgagtctcatttcccagtgtaattctgtagctgaccttgcaggaggcattgacaatatttctttattgtatggccccagccaggacttccctctttttagatgcaaaataattgggcaagacttttcatgggcattgcatgctgggctcgtgcaggtgtctccagggccgcctcgagaccagcgcccgcctccctggtcctggatacaggtggggcgggggctcccccgcagcagtggagttgagacccgcacctgcttcctggtcctggacacgggtggggcgggggctccgcagcagcagtggagttgaggcttccgtatgagctcgctcctggtcagtttgagggtggacataccagacatcctgcatcttcccagtcgccccaggagcgcctcaggagggtgagtggcaggaggccgatgccctgctagcaggcagtccctcggggccaggccttcctggtgcggtgctgaattgggctgttcgttcctctgagcaccaaggagagggatggcggctcaggcttcaggcagtgcccgccggtgcctctagaaggtgctccgtggtggggcccgggagggtggcccttccacattctcgggctgcctgtgtgccacccaagtgtcaggtcatgaggcccctcggtctggcctagggctctccttcctcccccacctcaagcctggggtgtggcctagccagggaggggagcgggagctctggccgtgaagacccaccctgaggtctgggctctcctggcctgagcgtgctttctgctatgagctccacgttcaccctgcggccaggactctactgttcctcctggtgggagctgctgtggtgccctgggtggcctccagtcaccgccagcctgccccttgcagtcagtcctgctgttccttcggctcctgcagtttccagcttggccctggacttcctgtttttcccacctagctggacgtaaaggttgtcgcgccttggaaagttaagtcactacacccgaatcgacgcactcttggctcgcctggctatggcttcagctggaaacggagctgagcgtggcttatgtttataaatacagcacctatcaggtccagcgtcgctgtctcctgcgggaggtgtcagctttgggcgtgaagaacagctgcaaggccacagggccaaggggtatctcaccagctgggaggccggcgtgcctgacctggccacacagagcgagcctcagaagcgagggggaaggagggcaggccttggggaggggtccaggaaggtcgagaggctgcagtggtggtagcctgaggggatgtgcgcggccaggtcagtgcctgccgctactgcctgctgcgctgactgcctgagcactggggatcgtgggcctgaggggcggggaccttggctcccgtggatagctcctgcaccatcctcttgcttctcagaccctcggcaagtggtgacagggggctggggtggagttgttctcctgccgtggtcctgtcaaatggtgctgggggcggggccaggaatcacagcaggtgtctgccgctagcgctcggagcctgtgctgggggcagggtggtgcatctcatgcctctgccgcttgctcactgtacttgcctggggaggatgtggcaggggcagaggacagctggccaggctcttggactgcacctgactctggtgggctatcgaaggttttggaggtttctttaattagcaacatgatatccagagattgcgactgtggctcgagcggttccctgccagggagcaggaccattgacagccgagccttgactcaccggcccaggccacccgaggggccattgacaactgagccttggctcaccggcccaggccacccgatggaccattgacagccgagccttggctcaccggcccaggccacccgaggggccattgacaactgagccttggctcaccggcccaggccacccgaggggccattgacagccgagccttggctcaccggcccaggccacccgaggtttcactgcggattctatcagaacagtgcctccccccaggattcgtcaaccttcagtggaccaggccctgcagtggttccagttattccctgggaaaatttccagcactgattagggggtgactcttggtcagaggttgagtgtttccctaggtgtggaggtgcacggagaagagaggggtgcagttcttaaaggacacatggcttatgccacaccccctgccccaacccccggagtggccagctttcctttgactggggaggaggcagctgtccagggttgtcctcacctctcctcctggagaatgtggtcccttcagaaaggggacccagtagtgggtgacctggtgcaaaccacccactgcctcctctgggccttcctggggctcttcggctctcaggagaggagggagctcaggctgtggctgctctgtgagttggacacggacgctccagccgctgggcccagcagtgtgaatggccatagagaacaggggcccagaggctgctctcgaggacactggcagcagttgtgctctgggctcgccatccttgaagctggaatattccacaagtgccacgcacttgctggaggtactgcctgggggtagactgtggccaggccctcccagcagcccgagtcttggcgcgtgggctggactcccacactcagcacctttctgctgacctgaacacccagggcacagtggcagcggcgtcattaggatttccaactagctgtttctgttaagagtgaagaggaaaccttgtttgattagactcattgtaaaaaagattccagtgaatctcttgcctgctgtctttgcagttgcctctaagggtcacgaggcagggcggcgtcctctctcagtgccactgtgacctggcagcacctcttttgcatattattgacctagagagagaggtcaattgtaattcggagctgcacagtcggaaaatttgtagcaacagagaattataggcgctctaggcattcgatgaatcttctccaccttgctgtggggttaattcaggggagcagtggggagtgtgctgggagtgagattagagggaggactccctggaggctggccctgcgccctggaggccagcatggccctggtgctggctacatcctctggggctcttcctcatctgtctgcagaggaggcagctgtggagcgagggtgtgtacgggagcaggatgggctgcacagaagcctttccgggggtgcctgtggtttgcaggggcctggctgcagctgccctgtgtgatctctgtccccgtcttctcccggcttccttgggtcctgtgtgcccaacttggcacttcaagatttgctccctggcaactgttgcctttcccagaagagaagtccctggaaccaggaccagcctgctgtcacctgcctgctgctcctgccccaccagaaccatcctgagtccaaactggctgagagtcaagggggtgttcagggcctccaggagctctgggagagtctaggatgctctagatccttgggctcatggggcagtagagtggggggctgtggtcctgggcaccctctggagagaccgctctggtgtcagccaagtggcgggcaccttctgggcttgggggcggggcttctcacgatggctcagggaggtccagacagcccccttgtctaggtgcgcacctggagtcctttcctgcgtgacttgcaaacaggccttgcagggctctagtgtatcagctcccggactgcaggcagcagcaaactctgccgtgtggtactgcttctcatggacaggagaccaccaggctccttccaggagggtgaggtctctgcagcgggagcatccaggcctggaactcgagctgtggtgtggtggtgccagcccaggagccaagcacagccaggagatgaaacccatccctgtggtctgcacgtccatgccagggccgagcccccagctgggatgccctgggagggtgcagggtgggctctggatgcctgctgggggatttcagtgagaaccaggaagggttgagccagagcctccgagaagcctggggtccatgtgtgggaaggaacggggacagggagcctccgagaagcctggggtccgtgtgtgggaaggaacggggacagggagcctccgagaagcctggggtccgtgtgtgggacggaacggggacagggagcctccgagaagcctggggtccgtgtgtgggacggaacggggacagggagcctccgagaagcctggggtccgtgtgtgggacggaatggggacaggagcctccgagaagcctggggtccgtgtgtgggaaggaacggggacaggagcctccaagaagcctggggtccgtgtgtccgtaggaacgggggacaggaggttgtgaagggcgtgtgggttccgggaggctcactatagtgatgtcctgccttagacgaggtcacacaggggaaggttactgtgccgcagagttttctttccgagcactcaatgctcacctcctgggagggagtggggccgcagccagccctgacccagctgggtgtgtggccgctctctggacccccggtcccagggtggcagctagtgcagcctaggccacaccagcatgacccctcgcccctgtctccacggagcaccgtgggactctggcatcagaatcctggggccccacccaacacccacgcatttcctgtcttttctcaggcaatcgccatggtacccagggctggccttgtttcagcttcctgacgagtgccctgtggtcagtcatttctgtcctcgcctttacctcaaatcctgctttttgccttaagtgcgttcccaattccatctctgtgccagctgtgccccatgcagcctctaccggcatctcacgtgatgtcaaccttctgggtccttggggcctagccttgctctggtgaacggctttgttggatgctggggttggcattttttttttttttgagacagagtcatcctgttgcccaggctggagtgcagtggcacaatctcggctcactgcaaccttgcctccagggttcaggtgattctcctgcctcagcctcccgagtagctgggattacaggcatgcaccgtcacacccagctaatttttgtatttttagtagagacggggtttcaccgtgttggccaggctggtctcaaactcctgacctcaggtgatctgcctgcctcggcctcccaaagtgctgggattacaggcatgagccaccgtgcccagcctgggttggcttttaactggcaagtttagtctgtgtttctgtgcgatgatatagttgcatgtattcctgtcattttgatcattttgattgtgtttattacgtatttcctctcctaagttttgttatttcctcctcggaaattaaggaaggatcaagactgattgaatttatttgtatttttgagacaggttctcactctgttgctcaggctagagtgcagtggcatgatcatagctccctgcagcctcaaactctggggctcgagtcatcctcccatttcagcctcctaaagtgctgggattaacaggcacgaaccattgtgcctggcctgagttttatgtattacccactccaggaaatcactgtagtccttttaactgttactgatttgcttaaaatgtgaaaggcctgttgacatttaaggatagtcaacaaccctcccaccctccaaaggaaggagagctgaaatgcaggagaaacagcaatgcctttgatgagtatggctttgctgctactttgctcacctgtggccctgcctttcccaaggatagtttttgttttcctggagcacatccttcagaagctctttcagtctttcagtgcctgaagatggcgtttttgtccccctcatacttggtgatcacagagttcttctaggttgacagttttgtctcctcggtactttgacgattgttttattgtcttctggcctctgttgtggttttgaggagtctgcgatcagcctgctccttgttccttgtgggacacatgtgtgatctgtggttgcttttagcgtttttattttgatttggtgcggatttgttatcaacattgcttttgatcctccttgggacttactgaatatgagcatctctcttcttgttttggaagaatcctcagtcagacattgcatctccttccttgggtggaagctgctcagtcactgtcctgtgccttgccgtggggctgcctgtgcctctgtgcctgcttctccttccatggggagcccctcccagcccctcactggcgctgggaagcacagtggtcctcccctctgtgggctgtgttgagaaatgttgctggctagtcccagacccacaacacggagcacgggggttttgcctggtgcccgtgatatcagtggggagtgagaggagcaggtggccccctcggctgtgttcagggtgtgcctgtgtggccgaccacctccaggactgaggccacacaggaagcagttgggattgtgaaaacccccatgggaagctgtgctgatcctcccctgagcctgtgacagctgagggcacaggcaatggtggggctcggtgcctggggctgagttgggaaggtttggtgtctgacccacttcttcccaagtgggagctccctcctcgggcactgcatggcttctctgcggggcctctgcctggtcctctcgtgggcggtccaagacctggagcccaggaggtggattctgaggtctgagtcccccgcaggacagcagttccatcctctggtccctctcctgcccccaggggccagtaggttacagacaccttcctgaaactccctggaggggagcagccttgattcctaaacaagaagttggtcctaagtgcatcctcttgatgtggggcagagaagaaatctgagacagtctcatgcccccaccgccatcgtccccccacttttttgtgggggtgcccaatctgtgctctgccccctccccaggctccgctcctgtgggctgcgtcgtggtttctcctctctgtgggacgtgtgctgggcccctgggggtggatgcagaccgagcctgggcccatgtagaccaactggcgtgggtgtgagagagagagacgcatacccactcaggcacatacacgtgcacacacacacccatgcacgcgtgtgcacacacaccctggccctgttccctaccagtccccaccccctcctgctgcatgtgctcctggttccctctcttcacctgacagctggagtcatcctcctgcccacagccgtgccctgtgcagagcaggtgctggttctgccctcccctggcctgccccaggcggggacactacactgggaagctgccccgttgcaggcgttcccatggcgccactgctgtgttagctgcctgcagcacaggccggccagtcctggggtgctggacagaccctcctggaagccagtccctggccgtcctgtcctgctgggggcacagtgtctcggcagaaggttctggctgctccctggggtgctggcttgtgtcacctggctttgctgggtcccagtgacatgcagtctggggatgttcctgggacccgttgggcttgcggtggccacttgggaaagctgagcactgaaagtgccaaaacctgggacaccttcttgcaggcccactcttcagcctttgccccgtgggccattggggagggaggaggtgggaggttttggcaaagcagcccaaaggtccacacagacccagggctggcaaccggcccggcctgtcacccttctcactgagggtcacagcctgtggcccatggcagggctgcccaggacaggggcttggccccggaggcctgcagtgtgaggcgtggcccacaggccttcccagagggggttctgggagcctcccccagctgtcacacgcacctgcctgtgcctcacccgggctaaaatagcccctgcacagaaacgcccttgctgggcagggcccattcctgctgggagacacctgtcagggcccttcctgcctggggccatatggagtgtccagcctgggggtggtcgtggggtgtcgggggcctgggcctggatccacgatgccctgtctggtctagagcctggcctggcttccccttggcgtgactgcccacaggcagtggccgccgtctgctcagctgcatcctcctgcgttgggctcatctgtctgccttcccctgacacctcctcctgccagactccagggccaagggagtgggccccggctgcagaggcagtgccagctagctgagtgggtcaggccacagaccccacctgactccagggcagcgtggccaggagagcattggaaggagagagctgttcccaccttgaggctgacgcagaccagacctggctctgtcctgagcagcagaaagtatgtgcagggcttcaccctcttccctctgtctgtgtagagctccacctgaggcccagtgtgtgcgtagagtcccacctgaggcccagtgtctacgtagagctccacctgaggcccaatatgtgcgtagagctccacctgagggccagtgcctacgtagagctccacctgagggccagtatgtgcgtagagctccacctgaggcccagtgtctacatagagctccacctgagggtccagtgtgtgggtagagctccacctgagggccagtgtctgtgtagagctccacctgagggccagtgtgtgcttggtgcccacagctgagttagcccaggctcgtggtcatgctcacaggtgcacgtggccacacaagtcactgagcacagacccagatgggatgcagctcataacgtgcactgcgggggggagctgtggcatcttttcccagagcccctctggtctggcagcctcgggagtgtgtgcatggtatgggaggtgggaacagagctgggaggggctcccctccatggggtggggttcccctccagctgttggtgaggcacactgtacacctgcacacctgtgcctgggactgttgggctggacgtgtaggaacatggaatggcccctgggccttcgggtgactgagacagaagtacaggcccagcaggtctgaggacagggcctcctgatgactggacccagcctggacaatggccggcagctcccagccttgccacaggctgactggaatgcgtggtgtggtggagcccagcactgagggccggacgtgtgtttgcagcattgttctcacagccacctcggaggcttccctgctctggggcagatgccgttgctggagccgtggtgctcccagaggcaccctgggctcagctcagcccccataggccagtgcctggagtggctgtgacgctgtggccggcgcctggcgtggctgtgacgctgtggccggcgcctggcgtggctctgacgctgtggccggcgcctggcgtggctctgacgctgtggccggcgcctggcgtggctctgacgctgtggccggcgcctggcatggctgtgatgtgctgactccggcaccatcagttccttcccctattctggggcaggtggggaccacctcttcaccctccctcatgggcagggctggcctctgctgaggtggcccctcactgggcccaggcatggagacccagtggtcctagccctcggtgtagtctatccatgaggcacctggctgagcctgttcctctcactccacagcagcctccttggccctgaccactggccaacgaggacactgagaaggcaccctgaccttctgtcctcattagcagggagcagccatgtccagataaggctgtacatcagagaaagctgagtgaggctggcaagagctggcagccgccctcggccgcccgggcgagccttgggacgggctgggtggtaagtgctggtgatgcaggagcagagagccccgtggaactctctccatgaggacggcggtgccctggggcccagctacgaggatggctgtgcaggcacctggagcctggggatggcagggcgtgggctgagcatgtggagcaccagcctgtgacattcctctgcccaggggcagcagggcacggagcgtgtgtggccagctgccgccacaggcccccagctcccacgcgggcaggctcgcgaccgcaccaagggggcagctcctggagacaaaagctcctcagttttcccttccaacaaaacacagtcagcaggtttgggaccagctgcctggggtcttaaccatctgtgctctgtgcgcgcccccacccccttgcctgcctggaggaaagtggtggggttgacatgcgcctcgagggccagccgggcgctggtgcatttctcagaaatccgtgaagtgctcccttgtcctgctcgtgttctgtgctgtccttgggagtggcgcggccgcttgccagggctgcagagttggccacgcagcctctccaggaggccttgagccaagcacaggatgcagcccagcagtggtggcaccgtggagtggctgggcggaagagatcctggtccacgctgctgtctggagggcagggtcctcaggtgaccagagtccgtgcaggagcgagtgaggacagggctggggcaggcggcaggatgaggccgcccagagcaactcagtgagtgaatgagtgaaagcacgcacgccccatgctccagcggggccagagtgtgctgttgggtgagtctggccttccttcctggggttgtgggccctacttgtgggaggccactgtggggagggcgtccttgtagaagtgttaatcagagtgaaagccagtccctgtgcactgctgctgggaatgtagcatggtgcagctgttgcggggaacaggacggcagcccctcgggaaatgagacagagttaccgtcagagttactgtgtgagctagcagttgcacttctcagtagaacccgggagcactgacgcagggcctccaggggagatctccaccctgtgttcacagcagccttactcacggtgactgcgtgatggacgcagcctgtatccatcctcggacaaacaagtcagcaccatgtggccctccgcaccacccagcatcactgggccctcggtcagcaccgcgtggccctccacactgtggaatattacttagccctgaaaaggaaggaaatggacacaggctgcaacgtggatggaacttgagtatattgtgctgagtggaataagccagtcacaggaggacatgcactgtatgatcccatttgtgtcaggtccctagagtcattgcattcatagggacggaggtaggatggtgcagcctggtgatgccaggggccggggaaggtgggaatggggagttggggttgaatgggtagtttcagttgcgcaaggtgaagagagttctcgggatggatggcggtgagggctgcacaacagcatccacgcacgtagtgccactgacctgcacactgaaaaatggttcaaacggcaagttttacgttatatttaccacaataaaaaagagaaatagacatcgtcaagctgttctccaaaataaggctgtcaccgtttaccttcctaccagaaaaaaacagttaagtcccaaagccagggggagcaccagtgttaacctcctgggttggggctggctgagcccgtggctatgcctccctgggcttaggtggcaaccctgcgaggagcttgggcctctcgtcttttgggttcctgttcaaaatgggaagtggtctccaaaccccagggcccacctgagccccctgagatgggaacctctccagacctgcccctgagatcctgtcccacccctggacaagggcctctgtgcctctgaacaaaactggggggcctggtgcagagtcctagctcaggcttccagaagtcagtggtttgaaggggtgcccacccttgctccgttgggacatagggacgcaggtgcctgtctcagcccccacatgtgcacccccaggggcagcagcgtcccctccagtctctggtttgcatcatgcacaggagtgggtgggtgggagtttcagtctcccagagagcatactgttgggccatgctgtctctggcctcctcacccatggaggtcctgccccgcccccatctgaggctgggtggccgaggggtctgttctcagactggggcctggcgctggcccggtttcctggaggaggaagcgggggagtgacctgcggaggacttccagcctccccttccgcctgctgtgggctgcatggcgctggggctctgcccagccctggagagtgttggctgctctccttccagctgacatggaaatgccatgcagggcacgcacgtggggcactttctgctgagtcaggtttctctgaccttcctgaaatgtcacttgttctgtaactcacaaaaactggggtgctgggatatggtgccttccttctcccggaagtccctgccgaggggggcggtggtggggcattcccagggggtgtttgtcctttgctgtctttactttcccaccttgttccttgggcctcccctgacctattgaccctgccacagctcgctcaccccaggtccctgggggctgtgcaggattccgggtcctccagggccagtgtgatccttgctgggttctcagagtgaccctggagggaggtcccctgccgaccctcacctcccgttcccaggtcatctgccccagggccaggtgtccatccaccctgactgtgaccatgtgcctgtgacctgcgtgactgacccctgcccttgggtgcccaggcctagcagtgccccatgccactgggtccccaggcatctgccaggaaaggacagctctaaagtggccagggcagcaggggtcctgatgtctgttgaaggcccttggaattccctggcttcattgtgccatctccccgctcttctccctccctcctgcctcctgtcttcctactctctcccctccttccacccacccagctgctctcctctctgagcctggccccacaaccagaggtgctcactcctgccttcaactgactgcaggtatccaggcatctgggctgagggtgcctctgtggctttgttgaccaacccaggctgacttcagaggtgctcttcagcccctgctttgcaagttcctggggacccgtggctgtcactttggccccttgatgtttatggtggttcccgtagctaagtggatgctgccaaagatggaaagtgggggacgctattccactgccactcagagcgagaccaggtgcttcaaaaagactagcagggttgggtgtggtggctcatgcctgtaaccctagcactttgggaggtcaaggtggggggaccacctgaggtcaggagtttgagatcagcctggccaacatgagaaaagcccatctctactgaaaatacaaaaattagccgggtgtggtggtatgcacctgtagtcttagctacttgggaggctgaggcgaaagaatggcttgaacccgggggcagaggttgcagtgagctgagatcatgccattgcactccagcctgggcaacaagagcaaaactctgtctctataaaaaaaaaaaaaaaggaagaaaaagaaaagaccagcagggccaggtgtggtggctcatgcctgcaatcctagcactttgggaggctgaagggagaggatctcctgagcacaggggttcaaggctgcagtgagccgtgattgcaccactacactctagcctaggtgacagagcaagattctgtctctattaaaaaaaaaaaaaaaggaatggagatgacaaagaacaagtcttaattgaatattaacaaaagccagaagctgattggaaaagcttaataaagtagcaaacatgcctggctaatttttgtatttttagtagagaggagtttcaccatgttggccaggctggtttcaaactcctgacctcaggtgatcagccctcctcggcctcccgaagtcctgggattacaggcatgagccaccacatccggccaatttttgtattttttgtagagatggggtttcaccatgttgcccaggctggtcttgagctcctgggctcaggtgatccacctgccttggcctcccaaagggctgcgattccaagtgtgagccaccgcgtctggctaaggagtattttccttagcagatacaaatttatttaaattagctatgctagttaaaacaatatggaattggcagaagtataaacattgactaatggaatgtaccagcagaaacacatgcgatcgtaatgtgcttcagaaatggcctcattcatctgtggggaaaggatatacttctgggtaaatggtttggtgataactgaacattcatgtaggaaataaaatgcaatcacaacacacacaactccaaatggatggataatctcattgtgaaaaagaggaaggaacaaatgggggagtgggatggattaaagcagtggtccccaacctttttgccgccagggaccggttttgtggaagacagtttttccacagacggtgatgggaatggtttccagtgaaactgtcccacctccgatcatcagccatcagattctcataagcagcgtgcagcctggatccctcgcgtgcacagttacaatagggttcttccggagctcaggtgggaatgctcactccctggtgctcatctcctgctgtgcggccagttgctaacaggccaggaacctgtcctgggggttggggacctctggtctacagcacaggtgacttttctgtaccagagctaggaatgaagggctggctgagctggtgcttcctgccacctgtgtagtggtgcaggtgtccatggtccagggctggccaggggcatctcctgtcctggcttggcttctgcccctgggtccgtggtggctgcctgggacctgcccttgcagccagggtgaaaggagtgggcagggcctgctgcctctgctcagggcccctagtggggctgcttgctcagcacccttgccccgtctctggccacgtagccgtcacccagctagcatggggaggctcgctaccaaggggtggggggctggagaacggagcttggagacagctggcagtctcggccacacatagagacacccgctcctgagacctgcagtgcctgcagaggggaagaaacggggctggcggggagagcacacagtgcgtttctgtggtcaggcccctttatttcttcaaatagatcccaagtgtagagaacatgtgctcattcttgttggcaggcctgtgggtttttgtgtctcactctgaacttttcctgtatgcctctcgcttctctctgtcagaaaacaaaacagaagcctctattctctgggattcggattcaagtcggctcttttattcacctatttcgagcagacacaatgaaagaggaaacagataacactgtgggtattcagcaagttgtcttggatgtgaacattgagtttccacttgtcactgtgattttattttatattgagttgtttttaaaatatgctttgcttcactttcgttgctgttgaatctattacagctgcacggtgtcctgaacacagtggcaggctggtgatgaatcgtcttctgtaggttttctggtgtctttgttatgattctctcagggccaagtgtggtgcacctggcctgggcaaacctttaggcctcgctctcagaaccaactgtggataataagcaaataacatgttttgtttatctgcgcagtttctgaatgcaaatgattctttttattccttattttatttatttatgttttagagacagagtcttgccgtgttgcccaggctggagctttttattcttcgtgtttgcacagtggctgtagctatgtgtagtgacagcagagacaggcctgagaggggcagccacgttccccctgggcaggatctgtctgctacgggaccgcaagctgcgactttttccttctaagtgtgcggagaggagcccctgcctagggacggggagccgtagcctgctgtttttgtgacaagcatcttgggcgagggggcactgggctgtgctgcatagatggtgagcactggactcacccccagccccaagtcaaacgaatgtaaggaacgtgagcttctggaaacgagcgtggaagcctgagtggtgaggaagggaaatcttgcagtacctgcacactccccaaatgcctcttgtgggtttgcagtacctgcgcactccccaaatgcctcttgtggatttgtttgtttgtttgtttacaattagttcatccacagcaggatccaagctgctgcctgtgtgtgtgtgtgtgtgtgtgtgtgtgtgtgtgtgtgtgtctatgtgtgagagagagagagacagggtcctctgtcacccaggctgagtgtagtggtgcaatcacagctgactgcagcctccaactcctgggctcaggtgatcctcccacctcagcctcccaagtagctgggactgcaggtgcgccccaccaagcccagctaatttttgtatttttttgtagagacagggtttcgccatgttggccaggctggtctcgaactcctggcctcaagtgatccacccgcctcggcctcccacagtgctgggattacaggcatgattgtgcccagccacagtagagcttcttgtttgcagttggttggtgtgtgtcttgtggctgtctttaataaaacaaaaactttgcaagtatcgtctggtaggccaggcgcagtggctcacgcctgtaatcctagcacttcaggaggccgaggtgggcgggtcacttgaggtcaggagttcaaaaccagcctggccgatatggtgaaaccccatctctagtaaaaatataaaaaattagctgggtgtggtggtgcacgcctgtagtcccagctactcaggaggctgaggcaggtgaattgcttgaacccgggaggcggaggttgcagtgagccaagatcgcaccactgcactccagcctgggtgacagcaggactctgtcttaaaaaaaaaaaaaaaaaaagacagtattgttatggtaaaggttcacccctcacaccttttttcgtatgcagctctgagcttaacatccaccatacaaccaggcacagaacactgggcagtccacccaaaacagtccccagcagccaccctccctactgacctggccttgtgcccccagctctgccttttccagagtgccatagagatggacaaaaatggtgtgtgccctcttgacacgggcgtctctcactcaacacgatgccttccagatccatcctatcacgtatcgatctgttcctagctgttgctgaatagtaccaaaatgtccttgtctttgtgtgaaggacatcggggtttccagtgggtggcagttatgaatagagctgctgtgaatgtgcattagggatctgtgtagggacatatgctttcatttcccttggaccaattccaaggggtaggattgctgggtcctgtatgtttaactttgtaagaaactgccaaactgctttccagtgactctgccatgtggcgttctgcacgttcagagtatatggaagtcccagtggttttgcttcctcgccagcatttggtattagctttttttatttttcatgttttttaagccattctaataggtgtagttggtatctcgtttggttttaatttgcatttccctaataactaataattttgagcatcttttcatgtgcttatttgctatcaatgtatcttttctggtgaaacgtctgttcaaatattttgctcacttttttttttttttgagatggagtcttgctctgtcacccaggctagagtgcagtggcgcgacctcagctcactgcaacctttacctccctggttcaagcaattcccctgcctcagccttccgagtagctgggactacaggcttttctcactttttattaggttgtttgttttcatattgttgagttctgagagttcatatatttatatattctggataaaatttttgtcgaatgtgtgatctgtggccaggtgtggtggctcatgcctataatcccagcactttgggaggctgaggtgggcagatcactcgaggccaggagtttgagaccaggcctggcctacatgtagctgggactacagatgtgtgctgccgtacttggctaatttttatactttttgtagagacagggtctccctgtgtacccaggctggtctcaaactcctgggctcaagtgatccacccacctcagcttcccgaagtgttgggattacaggcatgagccacccttccctgcctcaacttttaatatatggttgaatttgcctggaagtttttttttgttttgttttgtttttggaagatttaattaattaattgatttatttttgagacagagtctcactctgtcccccaggctggcgtgcagtgatacgatctcggctcactacaacctctgcctccccagttcaagtgattctcccacacccggcccagaaaatttaacaattaattcaatttatttaatagttgtaggactataccagctatctatttcatcgtggggagttttagtagtttgtggctttctagggaaatgaaaattggtacattttatcaaagtagtcaaatttttgttcatgaagttgtttatagtatttcccagtagtctgtaaggtctgtagtgctttccttcttttacttctgataatggcaacttttgtctactttcttctttgtttgggtagaggttttatgaattttattgatcttcccaaagaactagcatttggttttattttattgtttatctattttcagtttagttgttcctctttatcattataatttccttccttttgcttacttggggtttaatatgttcttctagtttcttaagatggaaccttagggctgggcgcagtggcccagtaatcccagcactttgggaggccgaggtgggtggatcacctgaggtcaggagttcgagaccagcctggccaacatggtgaaatcgtgtctccaccaaaaatataaaaaattagctgggcgtggtagtgcacacctgtaatcccagctgcttgggaggctgaggcatgagaatcgtttgaacccaggaggtggaggttgcagtgagccgagatcacaccactgcactccagcctgggcaacacagtgtgactccatctcaaaaaagatggaatctggctgggcgcagtggctcaacgcctgtaatcccagcactttgggaggccaaggcaggcggatcacgaggtcgggagattgagaccatcctgcctaacacggtgaaaccccgtctccactaaaaatacaaaaaattagctgggtgtgatgtcgggcgcctgtagtcccagctactcgggaggctgaggcaggacaatagcgtgaacccaggaggcggagcttgcagtgagctgagatcacgccaccgcactccagcctgggcaacagagcgagactccgtcttgagaaaaaaaaaaatggaatctttagattgtgtatttgaatcttttttcttttctgacataagcacttaatgctataaattctcatttcagaacggctttagctgcacctggcagattgacgtgctgcgttttcatttacattccattcagagtgttctctgatttcctttgagacttcctttgatccataggtttttgttttttagtttcccaagcatcccaagaggatttccccgccatctttctgtgatagattgctagtctaacgccattttggtcagagaacgtattctttgtatgatatcagctcttttgtatttgtgaaggatttgtggtgtgacccagcctatggtctatcttggttcatatcacctctcttagtctctctcctctgtctttcttcctcttgcattgtgttgagtaagagagagtctgtgggaatccgggcagccccagtggagtggggtggaaccaggacgagggtccctgctggaggagcgccccctcaggccaggcccttccgcgtttctgccaagtcctaggagactctgacttaatgcctgacttattttgtgatatactgagttatgagaatgactttaaagctcacaggtggcctcagagtgcaccttgtgctcacaaacactgacgggcgacagtggacagtctgactgcagctcggggaatgagttgaaggactctgacagagatgtctgtagtaggcaggcttgtcacactcattgtttaagctccatgcctgtttacctaaaaagctggacttaaatacatcgaacttggaactcagaaaaataaaacatcttctgacctgggtaggtccgtcttccagtgttggaaagcagactcatttccgggttagtcctgtgctgctttttgacctacactgacccgatcttgtttggaacaggccgccctgtgcatgatttggtcccatgcagaatcacacagcccggttggtgactttgatggctgtcaggcactgctcgcgtctgcagccctgtctgcagagagcaccccgtggccctgcatgcacggctcccccacccccgcccacacaacatcccccccaccgcctgcacggctcccccacccacacccgcacaacttcccccccaccccctgcacagttcccccactcccacgcgcacgacttccccccctaccccctgcacggctcccccacccccacccgcacggcatcacccccaccgcctgcacggctcccccacccccacccgcacggcatcacccccaccgcctgcacggctcccccacccccacccgcacaacttcccccccaccccctgcacggctcccccacccccacccccacgcgcatgactttccccccaccccctgcacggctcccccactcccacgcgcatgacttcccccccaccccctgcacggctcccccactcccacgcgcatgacttcccccccaccccctgcacggctcccccacccccacccccacccgcacggcatcaccccctaccccctgcacggctcccccacccccacctgcacagcatccccccaccactgcatggctcccccacctctgcccacacagcttccctacccccgcctgcacggctcccccactgcctgttgtccgctgtccccgttgcacctcccacctgctgccctgctgtcaagtcaggcgcgtcccacccagagtgctctggtgtctgccccttggcttctctcagcagctcagtggagtgtagacagtgtagtagatcatcacctgagcagccaggatgggagtggggtctctgtggtctccattttacaaatgggttgacaggtgctcaggaagccctgtgatgtcctgaggccgcccaggcagtcatacacaggctgtacccatccagtgctcccgttgcctgggggcagggatgtgtgctggaagggcctgggactgccttcccaccgccatgtccacacccaatgcccaggggtggagacggaagcacgtggcggccactgtggcactggtgggtggctgcgttccatggcctgactgtgtctggcgcctgttctggtgttttacattcatactttgagggccaagcaccagcccaggaggtgggtgccacaagtccagacttccccaagggaaagtgtccccagcacagactcagccactcagaacttgttggtcttagagcctgaagccgggcagggcagacagtgccatccctatctggatggtggtgccttcacccttctgctgtcctgagcaagaagaaaaatgagccaagcttcaaagagagctgtgccaaagtttccggaaagcttgccagtgtgggtgttgcaccccacacaccttcaggcatgggtgggtggtgtgggcatcttcactggatggatttggagccctggcgcgtgtacggcagatgccccggggagatggcatgttcacacggggcagcactaggcagagtggagggtagggtctacacccctccactcctcagcaacagagccctggacactgggtgtgtccttcagactgtccctggcgtctccagcactcctgtggcctcaggacggaatgatggaggtgaaatgaacagaaggaaggttgggggaaagcgtatcccagctatgggcagggggtcctggggtgggcaggatttggggcggctgggcctggggctggatagggccgcgggagaggggaggcctgtgctctcacagctgggagctggctcaggactctcagatcttctctttgtggcctgtcatccctcctacctgcctgtccacaggcccacactgagtgagttccatgggagggaggctcaccctcaggggccttcaggagatgggacctctggcccggcagccaacggatgctgaggggtgcccaccatgtgcagggacagctggggtgatgtcttggagccctgtgaggtcctggggccgcccaggcagtcacaccccgccctgcaccccagggtgcaggctcccggggtgacacagtgctgggacggcacagggccgcgtcctgaggagagggcggagccccgaggctgagctgtgccttgcctcacaggttgtgcagcctgactctgaagaagctggtggtcttcaaggagctggagaaggagctgatctccgtggtgatcgctgtcaagatgcaggtgaggccgcttgtgaccccggctgtggctgggtgctgtgtaggctttccatgtgcctgggagacgagtcaggcggtgcgctactgtggggccttgtgccaaaacagcgggcagcccatgccatctccgggagcccggggggctgggaatgacaggatgctcctgggtccagtcctgtcccgcacaagggaggcaggcccggccttctgggatgtggaggtcacatgcatggggccttcccagggcagagctgccctcgagtcacctcacagtgatggacgggccccaagcacctggagccagggcttccctgctgcactcagcacccacttcctgcccactttttgtggggtggagggcgtcggtgggagaggggagcagggcactctgggaggcgagggcctagccagaactcccagcccctggtgccagggcctctctcctgaccctagtgggtcctgtgacctctcgaaggctttgaacaagtagcggttccagaggggtcatgctggtgtcttccccatgcctggcccaggccccgccccctccttggggtagagctgccatgacccttgcagcatggcctttgcccagtggcccagacagggaggtgtccccgccaactgtcagggccacccctgccctttcagggtcatacggttccaggtgtgtggcctgtatagggccaccgccagcgggctctccctagccggcaccactcatgggcaagtctcacccatgtcctcagcatacaggagtgtccttctgtgtggccgtccagcgtgacagggtggggtctcagtggctgttgtgctcctgaccccagcccatcagctcctcgaggatggggccctgcccttggagcccatgtccaaggccccacacaggtccctgcagctggccggattcttgacacctgctgtggctctgacacggggtctccgggtctccccgacctgcagagtagcacctgagcctcggccagtgtggctgaggtcaccagccaagcactgggtcttgagtgcgaggaggcctgaggcttgttgtctgtcccagtcaattgccactatgtgaaacctactgcatcttaaataaacgtctggagaaacccttttcctcgctgaacatgctcgtggattagcagcagcctacatctgcggcgtgtgctggtggccaggttccccgggtggtggggccttgccccaggaacttccaggagcgtgtggctaatagcaggaccccaagaacttccaggagtgcgtggctaatgcaggacccggagaacttccaggagagcgtggctaatagcaggaccccgagaacttccaggagagcgtggctaatgcaggaccccgagaacttccaggagagcgtggctaatagcaggaccccgagaacttccgggagcgcgtggctaatagcaggaccccgagaacttccgggagcgcgtggctaatagcaggaccccaagaacttccaggagtgcgtggctgatagcaggatggaagcgtctctccgcctgtcctgcccatgggtgtggccatgcccagggtgcccagtacctgctgcagtctggctgcgggtcgtccctggggaacagggagctctctgtgggccattgccaccaggccgtgaggctgtgtctggacctcttggcttggggggcaggggtcagggtctcattgggtcttcagagcaatgcagaaaggcatgaaggcaagagtcgacccctcactgacttctgagtctggtgctgttgacctctaacctctggcatggggccccaccccacactgaccctgttccttggccccattccttcctctgcctgtctctggtcctgccccagcctgtgtcttgaccgagagcttggccccagggcccctcagagccccacctctccagcccctctgtgtagcgcatggactggctgcccatgccctccctgcccaccccagctcagcagccacgtggcccttggcctcccttgatcaccccagctcctcatctgcttctcttggggtgtcctctccgcccaggccccctgtgggggaagcagccagcctggccccgcagccccacctgcccctcagccttctctggcgtgcaccttcgcctcactggctggtggcacacactgtccttttcccgacacagctgggtccctgcaggtcctctgaggggggaatgctaagagggacccgacgcagagcacatttgcagggaaacatctctgaagggtcaaggggaggagcagggagagtccagaccacaacgcaggggcagctggggagaggagaggggacaggagggctggccgaggagagccgcgctgcctcttgccacgctgcacgtgaggccccagcacaaggggaggaccagagtccgccatggacgtctcatggagcccgagtacggccatgcgggccgcccgcacctgtcctgaggccccgctgctcccacccgaacctgggctggccccgggctcccgttgtctgtcctggacccccgcccgccctccagccacctggcacctctcatccactgtgtcccgcgcgccggcctccgggaaccttgtgcctgggaccccgcagcggctgcttgtttctcggggcacgaggtccccaagctcatccttgttgggatggtcccatttaaaacagcactgcgataagcacgttcaatccattaggaatctattttgatataaagtttgcggttggggtcctgttgtctttcacgcaaatgactcgttatccatttagcaggtgcgtgtgatgtctcctgctggcctgaagctcactgggtatgaactgtgttttcaggtgctcatgcatttcctgcacctacatctaggcttctactaccctcatttttgtgacagcatctccgtattttaagtattgtatctctgtatgttttactttctgagaggaccagtcaggcctgatcattcttctttttagaaaatgctttaggccaggtgcagtggctcatgcctaatcccagcactgtgggaggccgaggagggtggattgcttgaactcaggagttggagaccagtctgggcaacatgactaatccttgtctcttaacaaaatacaaaaattattgtatatttttttgtggtggtacatgcctgtagtcccaggtgctagggaggctgaggctggaggattgcctgagcctaggaggtcaaggctgtagtgagttgagatcgagccactgccccacagcctgggtgacagagaccctgtctcaaaaaataaaaacaaaaaataaaaaaatgctttaagccaagcatggaggcacatgcctgtaaggctgagctacttaggaggctgaggcaggaggattgcttgagcccgggagctcaagtccagcctgagcaacacagcgagacctgtctctcaaaaccaaaaccagaagaggcttggtgcctccagatttgttctgccagacagacttgggcagcgcagtcaggtgctgctgcacctggccgtggaatctgttttgtgatcgcgttaacttcagcaggagccgctcctggtttctctctcatgtcttagggcagattcctggaggtggaacctgtgggccgaagggtctccatgtttttaaggttcttgggaaagatgccagggcacctctgagaattaccccagcctgtgcctaccacccccagactgcagggctgcaatcctgccagttttagagtgcaggagtcacggtgtctttgcctggtttcctgctgatatgcagtcctttgagctagaacaggtcttgcttaatcacagggctccaaacgaatcctgcggtcccatgagattgtgctgccccccagtggacaagtggagacagacctggccctgaccttctccttgcaggtgagtctttcaccagtggtgacgacaccctcatcactgtcccctggggagacgggcccccctcatcactgtcccctggggagacgggcccccctcatcactgtcccctggggtgatgggcccccctcatcagtgtcccctggggagacgggcacgcctcatcaccgtcccctggggagacgggcacccctcatcaccgtcccctggggcgacgggccccgtcatccctgtcccctggggtgacgggcccccccatcactatcccctggggtgacgggcacccccatcactgtaccctggggagacaggccctccccatcactgttccctggggagacgggcccccccatcactgtcccctggggagacgggcccccccatcagtgtcccctggggagacgggcacgcctcatcactgtcccctggggtgacgggccccctcatcactgtcccctggggagatgggcccccctcatcagtgtcccctggggagacgggcacccctcatcactgtcccctggggtgacgggccccctcatcactgtcccctggggagacgggcacccccatcactgtcccctggggagacgggcacccccatcactgtcccctggggtgacaggccccccccatcactgtcccctggggtgacgggcaccccctcatcactgtcccctggggagacgggcacccccatcactgtcccctggggtgacgggcccccccaatcactgtcccctggggtgatgggcaccccctcatcactgtcccctggggagacgggcacccccatcgctgtcccctggggtgacgggcccccccatcactgtcccctggggtgatgggccccctcgtcactgtcccctggggagacgggcgccctcatcactgtcccctggggtgatggccccccctcatcactgtcccctggggtgacggccccccctcatcactgtcccctggggtgatgggccccctcatcactgtcccctggggtgagagcatttgtctcatcattgccatcagtgtcctgcgttactgcagatcttctgttgattatggtttattcttaaatgattagaagatttgtatttgtttattaggttgagtttttctttgttttttctttgttttttgtttgtttgtttgtttttgagatggagtctctccttgtcacccaggctggtgcagtcttggctcactgcaacctccacctcccgagttcaagcgattctcctgcttcagcctcccgagcagctgggattacaggcatgtgccaccacgcccggctatttttcgtatctttagttgagacggggtttcaccatgtcggccaggctggtctcgaactcctgactgcatgatctgcctgcctcggcctctcaaagtgctgggattacaggcgtgggacaccatgcccagcctagtttttcattccttatctatgataaagagaatataaggccgggtgtggtggctcatgcctgtaatcccagcacttcgggaggccgaggtaggtggcaggagaatcgcttgaacccgggaggtggaggttggttgcagtgagctgagatcatgccatagcactccagcctgggggacagagtgagactccatctcaaaaaaaagagagaatataataacgagggcaaaaaaacacttactgagtcaaggctattttgctcttctatttaaaaagataggggaaactcagagttcacaagcaatcccagctcttcgggaggctgaggcaggaggattgcttgaacccaggaggtggaggtgacagtgagcccggctaatttttgtatttttgtagagatggggttttgccatgttggctagggtggtctcgaactccctacctcaggtgatccgcccagcttggcctcccaaagtgccgggattacaggtgtgagccaccgcgcctggcccaatgctccatggttcagtgggttttgataggcatgctcaggcatgtcagcaccaccgcagttagggtggtgaacagccccattttcccctaagtatttaaactgatttttatttgtgaactctgagtgtctaagagatacctgtgaacatcagcttgctggagccctgctggacagggagcctgtggtgagacgtgcaggcgagttgggtgaacagggggcctcggagggagagccctccccgccctgtgtgcccctcgcggaaaagcgtcctgggtcccaccttgctgattgcctcaggcacatgagccgccacactgtttccgagtgtccacaggcgcgctcggccatcccggacactgcagcacatagtccttgtccacctgccatggctgttagcgtggcgcggagccctcagggcctgagctctggcgactggctcactcttgattgtgttgggtaaaggatgggctctggggaccggcatgccactgggatgaacttgggggcccgtctgtgggtgcccttccgatctcatgggcagcaggttggcctggtcgcaggctgcagggtggctgggccgtcagaggccgtgatgctgcctggggccccggtgcaccctcagctgccactcgcacttgtgcccacagtatcctcacttcttgaagagggaaggcaacaagcttcagatcatgctgcagcgcagaaagcgctacaagaacagaaccatcctgggctacaagacgctggccgcgggctccatcagcatggctgaggtgagtgctccgtctggcgtggcctgcgtcgggctggccacctgggtgccagagcattcgcccgtgggagatggagatgtctctcccgggtccagatgtccagggatcaggtgaaaatgatgagaggagcctgggcggccgggctccgccataagggccaggtgcggccccaggtggtgcttcctctctgaccttcccttgccgcctagcatggctccccgcatgcctgcagccgcgcgcactcccctctaacgagcctgtcctgcccttcagtggaggctgggttttgggtcaggctgctctggagtccttcccatggaggaatcgctgctgtccccacaccacgggtgcgtcctgtgatgggttcgtgtctgcatcctgctcagcacgtgctctggcccaggattggctgagcaggagcaggacaggtgtcagttctgtgaaggggctagcgacaatacccgagcagggcgggggcagcacccagaggtcagaggggtggctggagttccctggaggggaaagaaggggaagtacctcaaaaggaaaagaaacagccaagcagcagcccaccttgctccagagaacccagcgttccaaggaggctgcagtagggcgtgggggcctgggagaagacaccccaggctgaggcctcggactttctcatggaccctttcggggctgcaagattggctctgggagaaggggcagcccagggccccagaccagtttgtctcttttgcttcagaactttccccatcgtggggttgtgttcaggggtccaggggctgcgggcgtgagtggtgcttggggcatgtgaagctgggttgctgcctgcctggggcctgggaaggtcagccagcgcagcccctcattgggagccggagatgccagagccccccagcccctcttcttcccactttgtccccctgctcctggggcttggggctgggacagtgggggtgcccacttgtagctggttcccccacacccccaggcccagcctgcaggcctcctgtctcccaggtcaagcgctaggtcccccagatcctcacacacccccacttacgcatccaggacaagtgccaagtactactctgggctcagccctccctgctaccccaggagatgggagcgtggagggtacaggaagcagcagtggcgtcccgaggcctcgcttctccgtgccgccgcagggcctcagacaagctttgcagtcttcccgattccttcggcaaaccacggacagcacgggtggaccgggcctccaggctgcacttcccagggccctgggacccctctggtggcctggagctgcccatcatcccagcctccctcctgcaggctgagcgatgggtgaacaggtagctcagggatgctctctgggctgtgagagcctcctgggagccaccgcttgcttcctgtggagcaggagggtccaggcactgtggggaggtcatgcaggctctgtttcccattagccatgcaggcgaggtcctgctgatccctgccggtccctgtgtttcccattagccatgcaggcgaggtcctgctgatccctgccggtccctgtgtttcccattagccatgcaggcgaggtcctgctgatccctgccggtccctgtgtttcccattagccatgcaggcgatgtcctgctgatccctgccggtccctgtgtttcccattagccattcaggcgatgtcctgctgatccctgctggtccctgtgtttcccattagccatgcaggcgatgtcctgctgatccctgccggtccctgtgtttcccattagccatgcaggcgatgtcctgctgatccctgctggtccctgtgtagccatgcaggtgatgtcctgctgatccctgccggtccctgtgagctcctgccccaggctgctccgcccacatctctcagtctgcaccccagtgccccaggcggctcctcccagcccctctcagcactggtgcttctgtgtttgacgtccttgccctgaatgctggcctctgctcccaggcccctccctcacctgtcctcccagccttgggctgtcccctcctgatccccggggagaggctggagcaaccttcccccaccccaggtcacaccagccacatcgtctgctgcttgaaatcccatcatctgttcttcactcttggcagaaaagccccacccctggatgtagttccagtgccctgcccctgagcctgtggcccccaccccaaggctccctcgccctgcacctgtggcttccaaagccgaggtcatctgactgctcctcgctctcccctccagcatctcctccaggccctcggggcatccttccaccttccactggcagcctggtcccagaacctagttgggtcctcccatgtgtccccgagcaccagggcggttcatgggctccctgtgtcctgccaccttttggggctggttcccacctgtgagcgttgctggcttgttgagagtatgagcacgggagattgcggaggcgggacagccccgagggcacagacggacacaggtggcagaggtggggggctctcaccagctgggctcaggcagctgtgccatgggggcttgctggctccgagactgcacgcctgagacgggggtgagggcatgggtgctgccatagggactgtcgtgagagtggggtgtcggtgaggctggcgccatgcatttgagagtagtgctcggcggtggggaagggtccttgagggcacagggtggggtgaggcgggctgttgggcggactcgaggccagggctgagagtgtggtgggagaggatgtggggggcacctgcccaggacctccaggctgtggggagaccaggaggcgatggctgtggggacacaggtgtcatctcccttcaaatgggtgcacacgcagggggcaggaggggctgggagcagcctgggcccctgccacaccatagctctgccctcacctggcactcattctgtgtgagctgaggcccagagccctggacttactctgaggctgaggaagtggagtccaaggtggcccagggtaggggccgggcctcatgggtgccaggagctggacgccggcgtggggtggcttaggtctgcaggctgaccagcagttctggctgggaccatcaggagtgaccgcagccccagggcctgctgggcacgcgcctctgcctgccacttctcaggaagcttgagctgactgcaggtggtccctctcagaggcagctccgcagaggcaggtgtgcggtgggggcagacgtggggccttctcctgtggtgtggctctcagaactcaccccagcacccgtagagggagtgtgtaggggtgggcgttcgtgtggccagaccaccctggggctgcagcctgggagacgcaggcatgccagctggtggccattgtctgaggctggggcctgtgggctccccgacaagacaggaaggttgacagacccatgaccaggcgaaggggtgacctgggagtgcggtggtggctgagggagcagccatgcttctttgcacagccggactcctcttgtggcctcgccacaagctgcacatgccactggggccaggtccagcccaaggggacctgtgaggggcgggcggctcatggtgggacacaggaagacctcagggtaaggacagcgcgggagcgtcaccctgaccgtttgcatgctggattccctttagtttctctctatgagtgtctgcacagccacaggctgctgatgacagcccagtcaggtgtgggctgcatatcaatgggtggccccgtgagaatatgatggcactggacacttcctatctcctgatgacatggtagccatcgtaacaccatagcacagttactttattcctgtgtgaactcagtgtggcccaggtgtccagggcctggtcacacacacgtccatccctacacggcggtgcatggcgacctcccaggccttcgcatccacacacacgtccacccctacgcggcggtgcgtggtgacctcccaggccttcgcattactcactcacccaccagcttgtccagagccacctccagccccgcaggctctgccatcgtcagtgccctattcacaggcaccacttaatgtcttttatactttatttttactgtgcttttttttttttgctttttatttttaaatttttttcgtgatgtggtttcacttttatagtgcagtggcgcgatctcagttcactgcaacctccacctcccgggttcaagtgattctccttcctccgcctcccgagtggttgggattacaggtgctcatcaccacacccaactaatttttttatttttagtggagacagggtttcaccctgttgtccaggctggtcttgaactcctgacctcaagtgatctgtctatctgggcctcccaaagtgttggtatttctttcttttttttttttttttttttttgagacagaatctcgctctgtcgcccaggctggagtgcagtgccgcaatctcagctcactgcaacctccacctcccaggttcacgccattctcctgcctcagcctcccgagtagctgggactacaggcgcccgccactacgcctggctaattttctgtatttttagtagagacggggtttcaccgtgttagccaagatggtctcgatctcctgacctcgcgatccgcccaccttggtctcccaaagtgctgggattacaggcgtgagccactgtacccggccaagtgttggtatttcaagcatgagccaccgtgcccagcctactttttctgtgtttaaatgtgtttagacacataaatacttaccatctgtaacaattgcctacagtattcagtacagtaacatgctttacaggtctgtggcctaggagcaggaggctgtctctcatataggctgaccttgaagatattgtgtgttcagttctaggccaccccaataaaaacggatattgaaataaagtgagtcacacaaatttcgtggtttttcagtgcatataaaagttatgtttacactgtactgtagtctgttaagtgtgcaatagcattacgtcaaaaaatatatacatacattaattttaaaatattgctaaagctgggtgcggtggctcatgcctgtaatcccagcactttgggaggccaaggcgggcgtatcacctgaggtcaggtgttcgaaaccagcctggccaatatggtgaaatgtcgtctctactaaaaatacaaaaaaaaattagccgggcgtcgtggctcacacctgtaatcccagctactagggaggggaggcaggagaatcactttaacccgggaggcggaggttgcagtgagccgagatcacgccactgcattctagcctgggtgacagagtaagacttcctctcaaaaaaaaaaaaaaaagaaaagaaaaagctaacaatcatctgagccttcggggagttgtaaccctttggctggtgggggtccttagtgtgggtgggtgctgaccggtcagagtgttggttgctgaaggctagggtgcctgtggcaatttcttaaataaaacaagaaagaagtttcctgcatacttgactcttcttttcgcagaatagttccctgtcgcatgcggtgctgtttggtaccatgttacccaccattatttcagaattggggtcagtcctctcaaaccccgttgctgcgttactaaccgagacggtggactctcccaagtcctgtgttgtcactccgcagtgttcacagcatcctcaccaggagcagattccatcttaagaaaccactttcgttgctcatccatgagaagccacttcttatcagctgaagtttcttcatgagactgcagcaattcagtcagtcctcaggctctgcttctaatcccagtcctcttgctatttccaccacatgtgcacttccttcctgcactgaagccttgagccctcaaagtcatccacgagagagttggaatccacttctcccaaattcctgtcaatgctgatatctcaactttttcccatgaatcacagatgttcttcatggcatcaagaatggtgaatccaggccacgcgcagtggctcacacctgtcatcccagcactttgggaggccaaggtgggcggatcatttgaggtcaggagttctaaaccagcctggccaatatggtgaaacgctgtctctgctaaaaatacaaaaaaagaaaaaaaggctgggcacggtggctcacacctgtaatcccagcactttggcaggccagggcgggtggattacctgaggtcaggagtttgagaccagcctggccaacatggtgaaaccttgtctctactaaaagtacaacaattagccaggtgtggtagaggacacctgtaattccagctactcagtaggctgagacagaagaatcggttgaacctgggaggcggaggttgcagtgagctgagattgcaccagtgcattccagcctgggtgacaagagtgagactccgtctcaaaacaaacaaacaaacaaaaaaattagtgggccgggtgcaatggctcacgccggtaatcccagcactttgggaggccaaggcgggcaggtcacctgaggtcgggagctcgagaccagcctgaccaacatggagaaaccccgtctctactaaaaatacaaaattagctgggtgtggtggcacatgcctgtaattccagctactcaggaggctgaggcaggagaatcgcttgaacccaggaggcggaaattgcaatgagccaagatcacgacattgcactccagcctgggcgccaagagtgagacttcatctcaaacaaacaaacaaaaaaaacgaattagtggagtgtggtggcaggcacctaaagtcccagctactcgggaggctgaggcaggagaattgcttgaacctgggaagtggaggttgtagtgagcgagatcgcaccattgcactccagcctgggcaacaagagttagaatctgtctcaaaaaaaaagaatgggccaggtgtggtggctcacgcctgtcatcccagcactttgggaggccacggtgggcggatcacgaggtcaggagatcaagaccatcctggctaacacagtgaaacaccgtctctactgaaaatataaaaaattagctgggcgtggtggcgggcgcctgtagtcccagctactcgggaggctgaggcaggagaatggtgtgaacctggaggtggagcttgcagtgagccgagatcgcgccactgcactccagcctgggcgacagagcgagactccgtctcaaaaaaaaaaaaaagaaaagaaaaaaaaagaatggtgagtcatttccagggggtttccaatttaccttgcccagatccatcagaggaatcactgtctatggcagctatagccttatgaatgaaatacattttttttaaataataagacttgaggccaggcgcagtggctcacacctgtaatcccagcactttgggaggtcaaggcaggtggatcatctgaggtcaggagttcaagaccagcctgaccaacatgttgaaatgccatctctgctaaaaatataaaaattagccaggcgtggtggcgggcccctgtaatcccagctactcaggaggctgaggcaggagaatcgcttgaacctgggaggcagaggttgtagtgagccaagatcgcgtcattgcactccagcctgggcaacagagcgaaactccaactcaaataataataagacttgaaagttgaaatgactccttgatgcatgggctgcctgatggatgtcgtgtgagcagccatgaaaacaacattcgtctcctgcgagtctccagcagagctcttgggtgaccaggtcatgtcaatgagcagtcatattttgaaaggaaccttttttttcccaagcaataggtctcatagtgggcttaaaacattcagccaattgtgctgtaaacagatgtgctgtcatccaggctttgttgttccattttcagaacacagacagtcgactttgcataattcttaagggccctaggatttcaggaatggtaaatgagcactggcttcaacttaaagtcaccagctgccttcactcctaacaagagaggcagcctgtcctttgaagctttgaggccaggcatcgacttctcctctctagctatgaaagtcctagatggcatcttcttccaatggaaggctgtgtcttctacgttgaaaatctgttgtttagtgttagccaccttcgtcaagatctgaactagaccttctagagaactcgctgcagcttctccgtcagcacttgccgcttcaccttgcatttctgttatggagacggctgctttactaaaacctcatgaaccaacttctgccagctccaaacttcttctgcagcctcctcgcctctctcagccttcacagaggtgaagggagtcagggccttgctccggatgaggctttggcttaaaggagtgttgtctggttcaatcttcatcccggccactcactctctccacaccgtcactgaggctgctctgctgattctccttcctgtgttcgctggagcagcgattttcctttccctcaggagctttctctttgcattcactgcttggtgatttagtataaggggcctcgccctcaccctgtctcggctctgacgtgccttcttcactaaactcagtcatttctaggttctcattgaaagagatgtgcaacccctcctttcacttgaacacttaggggcccgtagagttagtaattggcctaatttccatattattgtgtctcggaagagagaggccacaggagagacagacatgggaatggccggtgggctgagcagtcagacgcacacacctactgattaagttcactgtcttacatgggtgatgttcgtggtgccccagagcagttgtgatagtcacaccgtagctcactgatcacagatcaccatacagatataataatagtgaagaagtttgaaatattgggagaattaccaaaatgtgacacagacaccaagtgaacacgtgctgttggaaaagtggcgctgatagacttgcttgatgcagggttgccaaaagccttcactgtaaaaaacagaagatcagcaaagtgcagcagagcagagtgagggctgcagcccgggtgcgcggtgggcggcggcctgcgggtgtggtgggcgtcccgggtgcgcggtgggcggcggcccgggggtgtggtgggcggtgtcccgggtgcacggtgggcgtcccgggtgcgcggtgggcggtgtcccgggtgcgcggtgggcggtgtcccgggtgcgcggtgggcggcgtcccgggtgcgcggtgggcggcgtcccgggtgcgcggtgggtggcggcccgggtgcgcggtgggcggtggcctgggtgcgcggtgggcggcaccatccaggcttgctgcgatgttggcaagaggacgaggtctcctcaccatgcatgtctcagaacatacctctgtcgttacgtggtgcatgactgtttttgtaaaatttttattgtagtatttgtacaattaagtgtgacatcctgagcaattttcttttctttttttttttttttttttgagacggggtcttactttgccacccaggctggagtgcagtggtgtgatcttggctcactgcagcctcaagcccctgggcccaagcagtcctcccacctcagtcctcaagtagctgggactacaggtgcgcaccaccatgcccagctaattttttatactttttgtagagataagagtttcgccatgttgcccaggctggtctcaaactcctgagctcaagccatccacctgcctcaacctcccaaagtgttaggattacaggcgtgaaccattatgcccggcctcaattttcctagtcactaaaatctatttgaaaatggaagagggaggagcctgtcagggtcaggggtggagggagctgggccctggggccaccctccctggtgaggcagctccagccctttgctgaggattgcagagcatccacagagcatctgctggactaacccgggagggtggtctcagggtcagcaggggcaggagtgggaatggccacagtccaggacagtgacctgccggccagcatcaccccaggggagtgcccagctcaggggtggctggccccttggcaggaggacgcacgccccaaggagcactgtcaggaggagaggaacatgcagcctggagtgtcggggcctgggacttccagggcctgcagatatcaaaatagtgttcacatataggtcgaccacaggctgagtggagcgggggctaatcaacaacccgcccctggcccgctgcgggcccagcagagcattcccactacagccagctccagggatcccggcaaaagcatctttgataagaggccccattccttcctgccctcccacctgaaggaggaagcgagcagggttttcttaggagaaaaagggcccagacccctctgagccccgtggaggttggtatgagcaggtgcagcaccacctgagccccaccttgattcctccgggaccccagcccggcagccccctcccctctgagctcattttactgggatccccagcaagggctcagcatttctgaccgagggcttctgagcttccaggttctcacccctgtgtgacactgagaccctgccacatcagatgccactctgagaaggcgactcagggtgctgggggcctggacaacagcagcctccaagtacgtgaagctgcgtgtgccccggcgagttgtgggcacgagggcgtcagcagtgggtgcgagtgttggcagaagctgccagctgcccttcgtcattttctgaaatgaagatgagggcaaatgtaaacttttaaacatttttttaccttgattaattgaagaattagcagcccaaatcaggaccccacaatcaaaataaatctggtcggctgggcgtggtggctcacgcctgtaatcccagcactttgggaggccgaggcaggcagatcatttgaggtcaggagtttgagaccatcctggccaacatggtgaaactgtttctactaaaaatacaaaacttagctgggcgtgctggcagatgcctgtaatcccaggtacttgggaagctgaggcaggagaatcacttgaacccaggaggcggaggttgcagtgagccaagatcgcaccattgcacaccagcctgggccacagaatgagactccgtctcaaaaaagtaataaataaataaatctggtctataaaatcctaacatctggatgtgaaccgatagccccaaaaggcggcttctagagcacagctggccccaaggctgtgagtgtctgagagttgtcgtcatggcgtgtggttctgaggctggcgtggggcacggcggggctgtgcctgggtacaggtcgtggctgcaggaggggccggggcttgttctgcagctccgtggtttgagtgcctcacaacagaggagctggacctggcctgtgagccaggcctggtgggtgtctcctgctgctggagattccggcctggctgagagtgctgggctcctccttggtcccccacagacactggtccctgggcattggctcctgtgggttgggcagccggcttcacacactgctttgctgctgctgagctcttgggtgggtggagggtggaggcagggttggagcagggggccaggatcttcctgggtggcactgcatggacagcagtcgtgcctgagatcaggagggccgcggacacccctgtctgtccatctcagtccctcgtgactgtgcctggcactggcctctccagcacagcccagtgccctctgcttatggcccgttcgtgaaagctcccacgtgttcctctcgtctgtccgcctggctcctgtgtcctcctctcgtatctgtcccctctccccagtggccacgtttcctgtccactggatgctccctgccctgtggctgccctgctgagggtcccccttgctgtcactgagagagaaagcccttcagaaaccccagcccacacatcagggcaccggggctccttcccgtcgtgctgctttctagaaccgtgcccctggcctgcaggtgatgcaacacccgtctgaaggtggccaggtgctgagcctctgcagcagcatcaaggaggcccccgtcaaggcggccgagatctggatcgcctccctgtccagccagcccattgaccacgaagacagcaccatgcaggccggccccaaggccaagtccacgggtgagtgtggtgccagcccgctcctgcccctgctgtggggaggccctgccttccagccatggcacatcgggtggcagaaactgtccagcctggcttaaggagttgggggtccggagcacgtgtcagttgctctcctgtctggaagccacagcagaggtgcgcgctgttgtagggtccgggctgccacaggtccctgttctgcccccgtggctgcagctccttggtcaagaggcctgagtcctgagtgtcctcaaaaaggaggtgtggggtcgcactgtgatgcccttgctggtctgggtgcagggcccgccatgggcaggtgccacagctgccgccaccccagtggggtcaccagggcctcccctactcctcaggcgggggagacccagtcggtgcaaatccaggctgaaatgccagctggcaggaggggccgtggaggccggagcagttcatgtggccccctttgccctccctgcccctccccacttcctgccaaccccgacctggaccgttgccagtggacttgggggactcgggggctcggggccacggcacctgtgtctggagcccctctgtcctgcatggatccacctcctcgctgcccccactctgtgtccagggaagcctgggggtggtcactgcctggtttcccgggtggaatctcacggcaccctcccttctgtctgttcattccgcagataactactccgaggaggagtatgagagcttctcctccgagcaggaggccagtgacgacgccgtgcaggggcaggtgacctggggccggggctccgcgccctctcctggctcacaccgggtgtcctggggtctgtggggtcctcaccagctgtcaccagggcctcgtgagggtgggtgagccacgggcctggcccctggttggccgcccatctctcgtctcccgaccccaggggcccgagtttatgctcaggtggctctgagagtcttgggacacaggtgggctctcagtgccgggcctctcccatcgcccacgctgaggctggcagggtcctgccagcactatgcaggctgccgtggcctcagccactgcatatgtctctgcaggacttggacgaggacgactttgacgtggggaagccgaagaagcagcggagatcgattgtaagaacgacgtccatgaccagggttggtggagactgcttctatgaatgctggggaaggcgagggtcggggaggacgctgggagcctgggcgtgggggggacacgggcgtgggaagtgagatctcaccccaggtcacagcagcatgtcccgtggcagaccccctgattgccagtctcctgccgggtgccactgtctcccctgcctcgccacatctcctggctttagccttgtgtggccgctaggctcagtgggccctgagcaaggctgggaggctgcctcgctgccaggctcactccatgtgcagaaactccgggaggccatcctcccttttgtcccgtcaggtgcccacatacacctgagtgggctggttcccccatttttgtttgggatctggcctacctacctccacggtccccaggagcttggcagggctgttcagcattttttccctgaggaaagctcaggcagctctttcctcagaggccgtgtccggcactggcacagagggtccaccgcctggcgcctggacaccccaaggacaggcacggttccagggaggccagcgcaggtgggcggggagctctgtgcctggtgctgacaagggacatgggcacagcccagcccggacaccgccgcctcctctggcagcattcaagggggcgctgtgggcagacggtgccagggacgggcaagctgctcccaaagtggtgaagctgtgtcttgctggcctggagagcagcccccgctgtgcagaacaccagcttgagcctccattccagggcccccttgggcccaactgttgtgaagggagggcgtgggctgcctttgtagggttggtccccgagagggtggctgagggtcccgctcacccagtggctggagccgaggttctgcagtccagggtggcacgaggcacccacggggctcaggctcttggagcacgccccaccccacactcgcccacctgcccaccccacgtgggtgcccagcaccttccttctggggtcggccagggcctttcctgggagggggtgctgagggaagggccccgtgagcctgggaagggctgcagaggcttctggaagaaccatggagtccgcacacgcctccccgggtcccccttggccaggaatggaactgtcagacctcaggcctgttgggaagcctctgggagccacgagcgaatccatcagcgtggctggtgctgaggccttgctgctctcccacggcgggcctgggtgcggcctgggcctgaggaaggggctccagcggcgggtctgcagctctggcggcggctctgactctgcaccgcctgtcttgcagcaacagaacttcaagcagaaagtggtagcgctgctgcggaggttcaaagtgtccgacgaggtgagtgcgccgcgccttctgctcgcggcccccacgcctgcaacagcacctggtcgggaggaggcctctggggtctgtctccgggccacctctggttctgccgctcaccgtctgcacggccccgccagcatcgcacagtctgcgaggcgcagtgacagtggcactgcctcccgggctccaggtcacccgctgggtctctgctgaagtagaagtcgtgaataccctggaagtcggaaagtcattttcagggggatgtaaccattagtttgtgtgtttttttttttataaatagactttagtttttagagcagttttaggtttacagcaaaattgagcagaaagttcagagttcccatggacccctccccacctgacagccccccactattgacatgggccccccctccccacctgacagccccccactactgacattccatggatttttaatgttcatcttttagcttttctctaatctctgaattttctacaatgagcttgtataattttcataccgaaaagaaaaacatggctgggctcagtggctcatgcctgtaatcccagcactttgggaggccaaggcaggcagatcacttgggcccaggagtttgagaccagcctgggcaacatagtgaaaccccatctctacaataaaatacaaaaattagctgtgggtggtggtgtgcacctgtagtcccagctacttgggaggaaacctagtaggccaaggctgcagtgagtggagattgagccactgcacttcagcctgggcaacagagcgagaccctgtctcaaaagaaaaaacttcaaatctcggctcactgcaacctctgcctcccaggttcaacagggtttcaccctgttggccaggctggtcttgaactcctggcctcaagtgatctgcctgcctctgcctcccaaagtggtgggattacaggcgtgagccaccgcgcccagcctttgttgtttctttaacgtcagaagaaaaacgtgcctgggttcaggacctgaagtggagaggtggcgtttaagcgtctcagccttgaagcagggttgtcacccgtcggcctgagagcacactgcctgtagatggcgctgtgtcctaacatactcgggatgcatccagctcagcccctggggcacacactcagcgaggctgtcaggtccatgtgccgaaacaggtgctttgtggcccggtggggcaggcagcatttctgggaacagcgtaacatcaccaactggccgcagaggaagggcagctccgccactgggatggtcatcgggcccctgtgtcttttggtttgcatcttggattggaacattcccaagtgcagctgaagatgggacttagccaagtcggctccctggcctggggcttccttgagccctgctgagcgcctgtgggttcaggggtgggtgttcttggttgaatcttgaccgtggggttctgcactcacctgggcaactgaactgagtcccagaatgcatttcacttacacagattatggttctgagactcacaacccaaactgtgaaaagatgggccaacgtcacagacgctgttcagggagaggacatcgttttcatagggataattgcacagcgttgtgtgaaattcatgcaggtcaacacagtactttaatggagtgatgggatctctttccgtattttccacccatcactccctttcctgaaaagaccagaccatctccgccacagctctgaacctgtgtcttggccactaggagtgccacacctggcactgccccctgcccaggacttcacagcaaccctcagggggcaggagatgcacagtgagacgaggtcaccgcctggattacagccatctgagattgttcatgctgctataacaaaatactttagactgggaaattaataaacaaccaaagtgtatttctcgcagttccggaggctgtgagtccaagatcaaggtgccagtagactcggtgtcttgagggcccgtttcccatagagggcaccttctgtgtgttgtgtggtgagagggcctgacaagctccctcaagcctccctcatcagggccctgagcctattcagcgggcagagctctcgggccctaaccacctgttagaggccccacttcctaattctagcaccttggtggtcaggtttcagtgtaggaattttgggggtacaaacgttcacagcccccaggctgaccacagagcactggcatccaggctgccctgtgcccaggtgccacacagtgggtctggtgaggaggagagcagggctctgcttgggacccatcctgtgaggaggaaccagagtgaagtctgttccttacagccctcagcttcagctcacagcgaaagcgtccgctgagggctgccttctgaatttttcattgtaaaaggtggcacacctggatagtcagttgattttcaacaagggtgccaagttcattggagaaaatatcttttcgcaaaaaaactgaggcttgacaatgcacaccatgtgcagaattcagcttgactggatcatattcctaaatgtaaaagcctaaaatttaaattacctagattctaagccttaaaaaatatgaacttaaatcctgcactaatgccactgaactgtacacctaaaaatagataaaatggtaaatattatgttttatatatttttaacacaataaaaaaagtagaaatttgctttctgaaaggtactgttaaaagaatgaaaagatggccaggtgcggtggctcacgcctgtaatcccagcactttgggaggccgaggcagtacgaggtcaggagatcgagaccatcctggctaacatggtgaaaccccatctctactaaaaatacaaaaaaattagctgggcgtggtggcaggcgactgtagtcccagctacttgggaggcagaggcaggagaatgatgtgaaaccaggaggcagagcttgcagtaagccaagatggggccactgcactccagcctgggtgacagagcgagactccgtctcaaaaaaaaaagaaaaaagccacaggttgacagaaaatatttgcaaataacatacctggtaaagatttgtatccaatagatatattaaaaactttcaaaacccaataagaaaagcaacctgatttttaaaatgagtaagactcatacagtgaaactatgaaacattttttaaagaaagaagatataaataagtggaaagatgtcatatgttcatgaattggaaaacttagtcttgttaaggtggcaataatccctaaattgatgtacaaattcaacaaattcaagtgcgtatcagattcccagctgtgtttttgtagaaattgaccagctaaaatttatgtgtaaatgccagagactcagggcagacagaacagtcttgaagaaagaagacttatacttcccaatttcaaaatgtactacaaaaccacagtagtaatcctgaccatgtggggctggcccagggacaggcatggagatcagtggaatggaggtgatagtccagaagtgaacccttccatttatgggcaagtgatggtcaacaaagatgtcaagatatccatgggggaagaatagtcttcaacaaaggtgctaggaccactggatatccacatgcaaaagaaggaattacagccagctgtggtggcacatgcctgtaaccccagcactctgggaggctgaggcaggcagattgcataagtccacatagtgaaatcgcatctctactaaaaatacaaaaaattggccgggcatggtggtatgcacctgtaatcccagctactcggaaggctgaggtgggagaatcacctgagcccaggaggtggaagctgcagtgagctgagatcatgccattgcactccacctgggcaaccagagtgagaccctgtctcaaaaaaaaaaaaggaatttggacccctacctcacaccatattcaagaattaactaaatggatcagctgggtgcggtggctcacgcctgtaatcccagcactttgggattagtggccgaggcttgaggctcaagtgacccggatcacttgaggtcaggagatcgaaaccagcctggctaacatagtgaaatcccgtctctactaaaaatacaaaaacaattagccaggcatcgtggcgggtgcctgtagtccctgctacctgggaggctgaagtggaagaaacacttgaacctgggaggcagaggttgcagtgagccaacattgcatcattgcactccagcctgggcgacacagcgagactctgtctcaaaaaaaaaaaaaaaaacttgaaatggatcaaatatctccatctgtgagctaagattataaagctcttagaagaaaatgggccaatcttatgaccttgggttaggcaggggtttcttagatgtgacatcaaaagcataagcaacaaaaggtaagtttttctggaccacagcaacattttacagttttgtgcaccaaatagtgccatcaagaaaaccgaacagtagaacagaagaatgttttttgcaaatcatatatgtgataaggggcttgaatccagaacacataaagaatgcttataactgaaaaataaagacacagacagtctagttaaaagctgaactgtccattgctttgagaacgatgcagcctcaggtgccacggagctggggcccgcccactcctgccctgactcgctgctgtccacttgtactgagaagtcgaccaggaagccgcctcgtggccacggcttttaaagacaccgggaggacacctctggagcccgtggagtgattccttgaattagaattaccctgaccagctgcaatgtaaaatccctggaggtgtgtgctggcttatgaggggcacggagaaaaacaatctcaaagtgaaagaaccagttctgatgcctgccaagtctttgagaatcactaagagaaacacaccttgtggtgaaggttctcagacacaggatcacttccagacgagaatccataagcagctcgtggacctgcctggtccatcctggattgtgaggctgattgctctgttggaattgagctgcgagccgcggttgacatcaccattgcagatgcttaagccaagtgttttaataaagtgattatcacttgtcagaaccaggcacagtggctcacacctgtaatcccagcactttgggggctgacgtgggaggatcacttgagcccaggaggtcgaggctgcagtgaactatgattgtgccactgcgctctaccctgggcaacaaagcaagaccctttctcaaagacaaagaacagtgaattgtccaattaaaaaatgggcagggggctgggtgtggtcgctcacacctgtaatcccagaactttgggaggccgaggcgggtggattacaaggtcaagagatcaagaccatcctggctaacacggtgaaaccccatctctactaaaaatacaaaaagtagccgggcgtggtgatgggcgcctgtagtcccagctactcaggaggctgaggccggagaatggcgtgaacccgggaggcggagcttgcagtgagccgagatcgtgccactgcactccagcctgggcaacagacagtgcgagactccatctcaaaaaaaaaaaaaaaaaaaaaatagggatctttctaaatagatttcttcaaagacacacaagtagccaataagtacacgatcatcatgatcattatcactggtcattagggaaatgtaaaccaaaccacaatgagacactacttgatccccactaggatggctggaacaaatgaaatgcaacagggtgaggtgtaacagcaggaacccacaccctgctgggggaatgtaaggtggtgtggcagccacaggaagcagttgccagacacccagcacccctgttcttcagtgttgacttcagggaggtgaacacacacatgcatggacccactcagacgttcacagcagcttcatctgtgatggtcataatgcccgtcagctggtgatctgttagactggggtccacccactcagtggcgcactgcagaaccatcagaggaagtgaataaaggaaagaggtttagttgactcacagttcagcatggctggggaggcctcaggaagctgccaatcatggcagaaggggaagcaggcaccttctttatggggcagcaggtcggagtgggtgcctgcaggggaaatacaagatgcttataaaaccatcagatctcttaagatgtgctcattatcatgagaacagcgtggaggaaaccacccccaggatccagttacctccacttgtcctgcccttggcacgtggggcttatggggattacaattcaaggtgagacttgggtggggacacagtggaacatgaagtgtgccacgctgggtggatgacgccctcctccccccgccaccgagagctgcaggccacatgattccttttgggtagcactcgggaaagggcagaatgtacaggaacagagtgagattcgcagggcctggggctgagggaggggacgcactagaggaaggcaaaggggagcctcctgggtgtggggagcactttctgtcttggttttggtggtggctgcacagtggcccacacccgtcagagctcacctgcctgcacccaggccctccgtgcaccctggcagcccagatgactgcaccagcccaggggaggtggaggaatgccacacgcaccggtacctggggaccgggggtcctcggtgatcatcccgagctccaagacagaagctggactacagccgtgctgagtggaggggtttggtggctgggtgcccgcctcctattgctcctgcagactctggggtctcgggcgcccccagtggggcaatgtgggctgctgcagggaactcacgcgtgcctggcacccgtgcaggtcctggactcggagcaggaccctgcggagcacatccccgaggcagaggaggacctggacctcctgtatgacaccctggacatggagcaccccagcgacagcggccccgacatggaggatgacgacagcgtcctcagcacccccaagccgaagctgcggtgagccctacagggcggggcggggaggaacagccatttcagatgccccggccactctgcgaccactctggcagacccatgtccagccctggagacggggtgggcagggccagctgcctcgaagcctgggaaggctctggtggctggaaggaggggtgtgcggctgcctggcaggcccaggctacggctgcactgagccaggcagctttcctttcataggccagggggtgcaagctctgggctggggaggaccgagaggggtcccccagggtgctggctgggctgggtgtggcaccccgttgtaggggatccgtctctgggggatgccctgggaactgcaggggacctccgttcactcaggtggggagtagagctcccatgctgggtgcccctccctgaggaggaggaggcagaggcaggtggggagggggagggcaggtgtctctgtggctggatgggaggaggggctggctggggtggcctggcctgggcaggaggagaggatgcagggcaggcagctctgtgcatgggtctgggtatggaggcctcggtcagctgggggcaggaaggcaagcacaccaggcagaaggcaggtgccagcctctgggcagctgctgaggagccagaggccccagtcagagtcaggaagcttggtagaccttttgctctcacacttttttaacctaaacaacacgaagaaggtggccttgctgcatgttggaggcgcggccccagttagccctgcagccacgcagcggcctcccacctcacctgccccggcctggcagccccagcccaacttgctgctccttcagttgccagcagccaccataacaggtgaccgcggatgtggccaccagaaacagcctctgttcctcctgttctggagattgccatcccgaggctgtggcctcattcttggccagggtctcgctgggctcgggtggaggtattggtggctgccctgactggggctccgaggtcatgcagtgcaggcccagcgtggtggttggtggagttcagctccgtgtggctgcgggatgggggtctggctgccctgccgcctggtggccgttggtcattcttgccttctggcaaccgtcctcgtaccctggcccagggtccctcctccaccttcggaaccagcaaggcccagtgaagtccccctcacactttgggcctccctggccttcctgcctcatctcttctgccttcagccggagaaagttttctgtctttaacggctcacgtgattccataggagacatctttgtggcccagatcctctcccatcttaaactccgtggtgttggctgtatctgcagagccctggccagctagcattcatagtttgaggagaggcgtgtgcgtctcggggctatgatcttgaatgggcacacacagcagcaagtttccacgtgggtttgtcacccagggtggagcagcagacactgctaagtcccgtctgtttttttagggggcgggggagttgtttgtttcttgagataaggccttgctctgtcagccaggctagagtgtagttgtgcagtcgtggctcactgcagcctcaaccacctgggcccaagcggttctcccacctcagcctcctcagtagctgagaccaatggcgtgcgccaccacacccagctaatttttatatttttgtagagacagggtctccctatgtttcccaggctggtctcgaactgagctcaagcgaaccacctgccttggccacccaaagtgctgacactacaggtgtgagccagtgcacctggcctcctgtcaaatttttttcacttgaaaggtcttttaagtcttattgaatctgtaggtctcccttcctcctttttcttcgtacatattatatcaaccagggatgagacattcggcctggatggcctggatcggccagatggtctgcaagggtctggtttgtctggaaaggcatgggtggcctggatcagcctggatcagcctgggtggtctggaaaggcatggatggcctggatctgcctgagtggtccggaaaggcatgggtggcctggatcagcctggatcagcctgggtggtccggaaaggcatggatggtctggataggcctggatggtcgggaagggcctgggtggtccggaaaggcatggatggcctggatctgcctgagtggtctggaaaggcctggatggtctggatttgcctgagtggtctggaaaggcatgggtggcctgcatcagtgtggatagtgtggaaaggcctgggtggtccggaaaggcctggatagtctggataggcctggatggtttggaaggacctggatgggcctgggtggtctgatctgcctggtgggtccggaagggcctgcttcatctgatgtgcccttgttgttttgtcgagcatgttcacctgtttgctgcaggctggctgcagatcccagggctgccctccagcaggattggccagtggagctctccccagagccccttcgtgtttgtggcagccttgcctggagctaaggctgcgagtttcaggggtgtgtgtttcctgcagctgatgtcagggcaggtggaagaaccaggacggggcagccaggttggcccagcgcttagtgttgccagctccagaatcattctgtgccctgtgctgcagctggtgcgagcggggtgtgcgctgacacgggctcttctctggacccagctctgctctgccgttggattctgcagtctgtccctccaggtgtggtgggagaactgcgctttcagtgcaagaagggtcctggaaattaacgtgtcccccacccctgttccctgagccaggccatactttgaaggcctgtcgcactcgagctcgcagacggagattgggagcatccacagcgcccgcagccacaaggagcccccaagcccggtgagtggggccacactgatctcccagagcagaccgtggtctgactgggctgtggtgtggcccaaatctcccagcatgtcctgggcccagggccctgtccagctgtcctggagccactctgcacccactgtccagcacactgccacgcaggtaccccgggcctccctgagtcccagcattcccagtccagaagtcagcgccttggcacctgcagttgagcacaagctgattcccatctcctcccccacaggctgacgtgcccgagaagacgcggtccctgggaggcaggcagccgagcgacagtgtctctgacacggtggccctcgtaagcaggcttgggccgcacccacccgttccacacatcaggcacaccaatgctgcctttaagggtctgacctggaggggcggggcccacatataggtcctcatgtcacacctggtgtgcagaggtggggtcagccctcaggggtggccaggctgccagatggtcagagtatcccaaaattcactccagcttcagggtcagggcgccctggactcaccccaccctcagggtcagggcagctggactccccccacccgcagggtccggatgccctggactccccccaccctcagggtcagggcagctggactccccccaccctcagggtcagggcagctggactcaccccaccctcagggtcagggcccctggactcaccccaccctcagggtctgggttccccagactcaccctaccttcagggtcagggcgcctggactcaccccacccgcagggtcagggcccccggactccccccaccctcaggtggatggcacccaggaacgcctggttcccccctgctgcgttgcatggggtctcctcagttaggaggtcctgggcccagggcaagtcaggtcctgggaggttgggggctggtcaccctgcatggcccggatgggagccctgtgcttggaatttggctcagctaggctccctggtcagcgtatggccgggtccacatgtaggagccacggcctagagaggcctaaaccctcacccgagccagaggccacagggctggagaggccgcagcacgggtgtggtttccacgggaggctccaggcccgtctctgctcagcagggtgtgccaggcccgagggagcaccctggacagcctgaggacagccccgaggctgaggcctccaccctggatgtgttcacggagaggctgccgcccagcgggaggatcaccaagacagagtcccttgtcatcccctccaccaggtgatgggggctgcacggcggggcggggcggtgatgcacctgtcgggggaggggccgtcacgggcatcagtcggggtgggtgcgtgtcagtccatcctgatgagctccctcgggtgtagacagcagattcagggcctcgtccttcttaaaaaggagaagcaaaccccctggcccggcattgggtgtcaagcctgcagccccagattccaccctacctgtttgagggcagggtcaggcgggtctgccctccagcaggtgcccccacatccccctgagtagcccctgcctcagccaaaagacacacatacaccagcttgattcttccaggatttcaatttcatgtttctgtgatatttgggactttttccaaagcagcgagtctgggcactggtttttaccttgtggtggcacgcaggtgcctgtgtccgcgctttggagccaggtcgccctggcagcctcagtgccctgcactggcctgcacctggctctgcccagctcttggcccgggcagggagggtgagctcagtcctcacggtggctccaagcctcctggcctggctcgaagtctcacaggcagagctgtgtggggtcccatcggaggcacggcctcacttgtactcagctgctgctgtggccctcccagggctggtgacctctctgtgcagcccatgttcccactgcccatcagtcagccctgtgctcacccttccctgtccccaccacaatgtgtaggccactgcaggcctgcccctgcctctgcccctgttcctgttcctgctgccacagccacttagcctgtcctggtccccaataggtccgaggggaagcaggctggccgacggggccggagcacatccttgaaggagcggcaggcagcacggccccagaatgagcgggccaacagcctggacaacgagcgctgcccggacgcccggagccagctacaggtgcagctgcaggtgggggtggagggcgtggcacgcccaggaggcagggctcgtggtcaccctggcaccaaccagagcagggcaaaaagagaagcacagggggccaagggtgctgggccacagagcatgcctgggctttggagggctcctgctacacagcagggcgggcgggccatgggttggtttgtcaggaagaccatgtggaccccagggcaagttctagtccttctgctgccctccctggtccagggcagcctcattgcttggctgatttagcccagggcagttctccaagctggccagctctcttcctgccaccgagcctctgtggctgcagggggagcaggggcactgcaggcaccagggctggcgtggtggggatgggcgctgtgcttctcttctgggtgtggacagggctctgtgcctccagatccccaggaagactgtgtatgaccagctcaaccacatcctcatctccgatgaccagcttcccgaaaacatcatccttgtcaacacctcggactggcaggggcaggtagaggggcagtctcttggagtggagggtcagggtgtaggacagaggagagtgggttcctgaagctgccccctacccggcacacctgggtgctggagctgctggctgtggtttgcctggacgtgcctggggtctctggagcccctgagagctttggtgagggtcaggtgctgggggtggcctgggcggctgtgccgaagtcagcgtctgcctgtcttctgccagttcctctccgacgtcctgcagaggcacacgctccccgtggtgtgcacgtgctctcctgcggacgtccaggcggccttcagcaccatcgtctcacggatacagagatagtgagttgggctccaccctgtactcaccacccaagtacccctcggggtccctgcacccccacctctgcccattgctccggggctaggtgcgtcctggacctggggctgtggctggtgtccacagaggctgacccatgcgctcttcgcagcctggcctcccctcagttgtgggcgggagcagcagcctggtgggtgtcctgccacactggagtggtggcctcctggcctgtccttggaagcctgggctgaggccatgactgtgtggtccctcagcctgggcacgtttgggcatgtgggggtcctgggcttgggcagctccagggcagttgtggcatgagcggccacaggcacggagccccctgggctcacactggcatccttggatggaggacggctcccctgaggcgtctgtcccctctccgtcccacctgcctctggattgcagctgcaactgcaattcccagcccccgacccccgtgaagatcgccgtggcgggagcgcagcattacctcagtgccatcctgcggctctttgtggagcagctgtcccacaagacacccgactggctcggctacatgcgcttcctggtcatcccactgggtgagcaccacgccgtccacctgggcctgggcacagatgccacgggcagtgtggcgtggcatggagtggtgtggcgtggcgtggcgtgttgtgtggcgtggcgtggcgcggtgtgtcgtggtgtggcgcggtgtggcatggcgtggtgtccctgcttgctacacatttgttgtttttaaatgtttgtttgatacagtaacactttgttaattttaattatatgcaagataacttgattgccctaaaacagccatttgggtcaagataaagccatcgccctctgaaggggcctgagctgggtgtctcctccatcagtcgctgtgataactctatgccagtttcgatttccaaagtcagaagtgcaaagcagggctcgttattaatcctctcaaatcgtccaggtcctgtgtcgtcgaactccattacttctttaggtccatacgatgtgtcttaccacgaaacaaacccacccagccttaatctgttgaccagcagcaaggcctggaggcgacacctctcccgtgtggccctcacgatgccgacgtcagagccctgagccagccgaggcctctgcacggtcacatgtgccctgctgggccttcctcagtggcactcagggctctgggacctcagctcagggctggagctccttcagcggggccacaggcatccaccagggaggggcagtggtggctttctctttcggtggcaggaaagtgggcttgtctggaaggcagcagcacaggcctggggtcgggtggcccagcttttgtgccgcggtgggagccttgcagctccgagtcccccgtggtgacaccagccccacccctggcatgcaggctcccaccccgtggccaggtacctaggctccgtggactaccgctacaacaacttcttccaggacctggcctggagagacctgttcaacaagctggaggcccagagtgcgggtgaggcccgggcgcgtccacagcccacgccacggcgggaggaaggggccccggtttccccagatgctgtgcccaggaggccctgcacctgctcaggctcagcctcagggaagaggccatggacagggcctgctggggccttggccaggatgcctcctattcccctgagccttggaatgttggaagctgtggggcctgtctgggaaggggcgggcacagcccttcaggtcttcccacgcttgccctggtactgcctcgagagtagagcaccagggcccctcagctgcaaccagcgagccctgccgcgcttcggggtacgggaggcctgggcggggcaccggggaggcccagcttagccccgcctgcaaccccacctggcaccagcctaaccccccaccgcctcctccccctgcagtacaggacacgccagacattgtgtcacgcatcacgcagtacatcgcaggggccaactgtgcccaccagctccccatcgcagaggccatgctgacctacaagcagaagaggtaacgcggtgggcccaggcaccataccacaggctgccgccagccaccaaccctccgtgggcctccccacccgctgctgggcttggcctggtgggccgcagagccctgcaccgggcttagaccagagcctgggccagctgggcagctctgggcctccctgacagcaggtgcttccccgcaccccagatccctcatagtaagcgccatttccgcacctgtttctgtgcatgttgaaaccccgcgtgataagaagttgacagaatggatagctgtcatggggccagggtggcagtggcccagcccctccagtctgggcacctgttccttccacagcctgggtttctcgggctggggaacgaaggattccctgggcctcgggccctgtgggtgagtgatcagctcgtgtcctcacctgcccagagcaggacggtgctcaggagcccccggccgaaagtcctgcggagacctgtctgtcccgcccggcgcctcctccctgcacatctggcgccactgtcccacaccttccctagactacaggggagagagccgagtgcaaggcgcaaagccagcgctcacgggctctcccacgcaggagccccagtgagatgggagccactgagtgccctcggcggtccctggaggggtcctgagggcgtcgtaacgtgtctgttttctcttttggtggctttctgaaaaggaaaaagcattttcattttgactttaccctaaggtacggctctgtgggtctgcctcccaccctgtctgtccccaggctggtcttcagggcttgtttggcagagtcacgtaggaatcaccccgctgtcctctctccggactgggagtcaggccctgagggccaccagctgcaggctgagagcccgcacgggagaggggaagtggccccaacccgagtcactttttgctgacgtggacccttttcctccatccgatctctgacactgagtcaggagagcagcagatgggccctcctgtccctggccaggcccgtgtgctgggactccaccccagagccctgaagcctgcaggtcggccaggcaggcctttccccggctctgttttgaccctgggttttgatttaagaagtggccaggtttagcccctcctcgttttaaaccaggagcgagtggctggtgtggacaccaggatcacctgggccaggctgtttcccaggcccttcacgtttgtgaagctggcagcagcctagcaggggcacgggtgcacgccctacacacggggacgcccaagcaagtagttaaggagctggcctggtgacacggtggtcagcggctgtgccttgggccccctacacactgcagagcctggctcccagggctccctcgagcacctggggccagcagagaggggtttccagcatcttgtggcttacctggagacggggccaaactaccgagacctccaaatgggggtaaagagttttcattccgaggcagctccaccccctacaacctttcatgttcagagccaagtcccaggcacccccaaagctgccctttcagacagagccaccccttttccttggccaggtgtgtcctgctgcagggtgggggcccctgctggtcctcccatgggctcgttctctaccccgtgtcttctgccctgtgtgaggtcatttgctgtcctaggaaacccccccaaccccctgacctcagtgcagggtagttgggtccctggggcccccttgctggcctaggagctgctcgaagtgggcagcctgggaccacccacagctgtagggctgggcgctgggaagacacaggaagggggctgaacatcctatgtcttgtcctgctaaacaagccttcacaggtgaaagaccagccgtgggggcctcccctgctgacccccagcagcctccgcccttgccccctggctgtggcacgaggagcctgcagcatgttctggccgcccggccgccgcaggccgtggacgcagctgcttgtatctcccaggtcagctcttccaagcagcaagccagggccttagggggccttacacccactcccaccctgcacctcctgcccctgcctccgtgttgcaggggtgacactggctgcctccacgttataagggtgacactggctgcctggggtcctggaaggaacccagcaaaggccataagtgtcttacctgctctctgtacccagaggagggtcagtcgggaggctgagagagtgcaggcggtggcacagcccttgtgacgggggacctgtgcagagccctctccagccaggctcccctgcgagagtccctcgtgaggtgactcctgctggcccgccctcctctgccgagaatggcactcctcctatgagggcaggccaggcctggagggcggcctcgagccccagcctgcccgtgcagcgcatgggtggaaagggctgctcaggcatccggcagcttgcccagggccatgcggagtggcccccaaggcatctgtgccctccgtgcccgcggggcctccccacgccacggtggtatgctccttacactcctgaccacactgcctccacagacatgtgtgtgcctccagggtcaggatgagggtctcagtgtccagccggtgtcacccctgtcatattggcccatgtccagggctgggtgctgtctgcatggcccagaggcgcagcttggctttgagagttccagcaacatccctgtgttgtgacgtctcctgcattcggccctcatctgccacgcactgccccatgggcctcggagcagagcatggatgggaggccagcctgccatggctggctcggtgggggggtctggctcggcagagggcaggtggccctgggaattggagccacccatgccctggggaccagcagccaccacctgtcttctgtgccttcgcgtgcctgggaggacacagatgtcacagatttccaaacactggtctgctcaacaaggatagtgggatgtcaaaggccacgtccaggcactcctgcctgacagctgtggacacagccagggtgctggggggccaggaggccgccctgaggcagaggtgggcctcaacacaggatttgcatcgctttatgttatttgaaatggacaagaagaggggaaagtttcaactcttctccttagaaatggaactaggcctggggcatctttaatgggatgggaggaatctgtaggtggtttcatccagaggcatttgccaggtcttctgcagagggtgggccaggagccgtccaggttggcgtctggggagggtgggtcttgccagccgccgtctcctcacactggcgctgcgaagacagggaaggcacctgctgggaccagccgcagaggctgcctcctgggagtgtgctctggaccggctgccgggcagaggctgttttacttgtgggcacactttgtggggagcactgggatcaagcctctgccctgcagggctcttgaggagatagcgctgctggtcctgggagctggtgctccaggcagacggctgggctgggcctgtggcatcctccgctgggcctgtttcctgcaagggattctctctgaatgaccctgtgctggacgacaacccaagggagggccggggccactgtgcgagcccatgttctgcacctggtgccgggctgtccctgagggccaccctgctggcctggccattctcgtcctgcccccggcgctccaggggcaacaggtgctcctctgcactgtgtgtgcacagtctccgcctgtaagacagccacttgccggcatcagactctgcagtttggggaaatgagacagaagaaacagctgagggagctgcccagagagaaggcaccagttgctgatgcggtctggctgaggaagctgggcggggaggcacctctgtccctacgtgcaggccacggggggccttgaggccaggggagaggaggaaagaggagagccagacccagcccaccactcaggataggccctgccctctggatctttcctggggcccagaaggagatgccctcacctcaccctagctgccggcggggcctcatgctgtgctggccccttgtcttgtgggagagctccctgggcccaagcccaggctgcagtgggcacagtcagcaggagcctgtgcgagctggaccacaggacagccctgcttgagctgcacacgtcggaggggaagacagacgggtcccctcagcggccccgcggctcctgtcctccacccttggcatcttcgtgtggacgggctgtgaccagacttccaggagaggctgctgttacctgccagatgttgtatggggccaagtccaggcaaaacctccactgcccgctgagtacatcagctcacgcggggcacggcctggggtgtgctgggcctgcctgcaggctgtgcgtggggtgttctggtagaacatggaggcccactgcagccaaagcctggcctcttatgtgggcatggacgttacccagatagtctggagaaaacttctgcaccctggctttggtgctgctgattaccagagagggcccaggctcttcctgggagtcccagggcactggcagctgccctaaccccagcagagcaggggtgcccagcttggtggggaagtggaaatgcaagccggacagggctgagctggctgtgtgggcgtcgggcacctaggatggcagagtgaatccctccgtggagctgtgccctctggcctgtcctcctgaccatgggtgcacagagacccctttgtccttccagcatgtcagcatgtcagaaggggcccaggcgttggtcctgggggccaggccagggctggcagtggttggagatgggtggggccgggacacacagggcagggctgtccggcagggccatccggcagggccgcggccccagggctgcgccaggttctcaggccaagagggagctgtgcccaccaggcggggctgtgccctgaggagagcttaactgtctgtttccttgctcttagccctgacgaagagtcctcccaaaagttcattccctttgtcggggtgagtactggccagctttatgtgatgggaaaccgcacacctgccaacttgtcgtttacagtcagaacgtttggggattgactcgatatattccagaaccttcccacagatacgagctggggatttgccttcccatctggcctgtctcaaagctcgcttccttccctgctggagtggggtgtggggccagaggttgttagttccccttagctctgccttgggggctgataaatggaagcagagacaggtcggtggggcgaggcctcagaacacccaggaggcttggccccacgtctcaggagaggagagactgcctgcccgggttggggagggcgcctctgtcctttaggagcccaaggccccgggagcttcccagtgctcacttgggctgcagcctgcagtgtgtgggtttcacttcctgccctgcccagggttagggctgcttctgccagccaggccatctccctgccagccctgggtctccacagcctgtttcctgccatcttttcgctctgttgtgtggcctccctcccgccaggtgtctgctgtgagacagacccacagggcctggcagacaggttgcccaggcagcggaagggtctctgggcctcggtttccccactggtggaacagaggcctttttgtgcaccgtgcagtggttgggtctgctgagggctctggggcgatggctggccctctgggagggtggaattcgtcttgaacagcggctgcccaaagagctttctccggtgacaagagtacactgtgctcgggcacacaggccttcccatgcaaccaaggccctgcggtgtcactgggattcacggtagatctacgtagccgcctgtggctcgtggctgccaggtccggggcctatccccgtcggcccgccaaggtccctctcaccagcgtcctgtttttactgcacacatagtttgcagctgccctgagggccgactttagagagagcagtccctcctgctgaggccacgcaccctgagcactgtctgtccccacatggctgctctgagctcagctctgctccacagatggggagagaagggcaggagggagctggcaccacctggccgctccagcatcatgggagtggtggccacggtggggaggcgggagccccactgggagggcgctgggctagctgaattgcacggctttcaccagccagtgcctgttgttttctaggttgtgaaggttggaattgtggagccatcctcggccacatcaggtaaccccgtcccaccctgaggccttgtgagtggcccgtgggtgggctgcaggagcacggtcattcgagtcctgcagaccagatcaacctttcagggcctgagagccgccacgtcccagtcttgctgtggtgcttctgtcctgcggggggttcatcctccaaggactgctgtcacaaagccccacatcaaggctggcagggttgtcttccaaaaaccgaggagaatccgagaccctcccgtctctcacaggccactggggactcccaccctgcccacccccaggagctgcctggcctggccacatcctggtccggagggcctggtggcacccgggcagagcagcaggtgggctcagcctgccctgtgactcctccccaaaggcgactcggacgacgcggccccctcgggctctggcacgctctcctccaccccgccgtccgcatctcctgcggccaaggaggcctcacccaccccgccctcctccccgtcggtgagcggaggcctgtcctcccccaggtaaaggtgcctcacggctcagcacgtttcacttacccgccccaccacatgctgcctgattcagtcatcctcccctatgtcacatccacctcccagggcacctggcctgtcagccacgaaggcggaggggctctgcaggacggctgggtcctctctggccacctcctgccacagatctggtgtttgggggcaggacctctgggggacagaaactcctgcacagtgaataaacatgggcgttgtgctgggctgtctctcagctctgtacacagttggggcttttaaaaaacaagctgagggcagaaggtgcaagagacgtgagtctctagacggtcctcatgggatgagcttcgatagctgtgctgaggccccgctagcccgcccgggtctctccggagcagacctcactcaagtggaactaagccatggggggttgtgggccctgaggccaggcgtggtgctggtgctgcgtgcagggctcacaccagcagatacccccccgacccccctgcctctgtgtttccagccgccggctccttccaggctgcgcctgagggagctggttcgcacgggccctcacgactccaaggggcagcttggagagcaggtggacaggcctcccaggccgaggctctcctgtcgccagggtccctgtaatttaagcaggacccttgtgggggtgactgggcatgtgaacagctccacagagcatgctccaagcacccggccctcctctgctggcaagttggcacaggtgctggctgtcacctcctggcctgtcacagggacagtgatgtccccatcactaggcccaaagatgcaggtgtgaatgcctccctctgcctttcccagccagggtgtcggcgccgagctgatggggctgcaggtggactactggacggcagcacagcctgcggacaggaagagggacgccgagaagaaggacctgcctgtcaccaaaaacacgctcaagtgcactttccggtccctccaggtcagcaggctgcccagcagcggcgaggctgcagccacgcccaccatgtccatgaccgtggtcaccaaggagaagaacaagaagggtgaggtggggcaggctataaggccacacggcgcagaagggcggctctgtgggagagggcggctcgcagtcaacagggatgacagcccccgggctggcctcgggcagcccacatgcgcaggcaggggcgggtggggtgagggagcctgaatcctgagggcagtgagggtcaggtgcttctgaccagagcctcaggcggaggccagctgggtgggcaggagagcagctgtcctcagtcaccgtggaaggcaggtttcctaggtgagcagtgccatgaccagctgagcccccagtgcctcccccacacgtacccctggccctggccccagccccgaaggagcagcaagatgacagcagggcctcttttctcctcccagtgatgtttctgcccaagaaagcgaaggacaaggacgtggagtctaagagccagtgcattgagggcatcagccggctcatctgcactgccaggcagcagcagaacatgctgcggggtgagcaccaccggccccggggtctgtagagtgggacgtaggtgagagcacagcaaggctgctttggagcccagcctaggagctgcgggtgtctcgctgtgacacgcacattccacgattcaaggtgcaagcacattcgatgaagccctcagtgaggctgacaaccttccaaatgctgagaaagaattttttttcaaccctttttgctttttaaaaataatgacttgtttcgtttttcttgtttgttttttgttttggtttttttttttttgagacagagttttgctcttgttacccaggctggagtgcaatggtgtgatctcagctcactgcaacttccatctctcaggttcaagcgattctcctgcctgagcctcccaagtagctgggattacaggcgcgtgccaccacgcccggctaattttttgtatttttagtagagatggggttttaccgtgttggccaggctggtctcaaactcctgacctcaggtgatctgcctgcctcggcctcccaaagtgctgggattatgggcgcgagccaccgcacctggcctaaaaataatggcttgtagtttaaaagtgttggctgagcgcagaggctgaggcaggagaatggcgtgaacccgggtggcggagcttgcagtgagccgagattgcgccactgcactccagcctgggtgacagagcaagactccgcctcaaaaaaaaaaaaaaaaaaaggggttttggagaagatactctgcaagtaactgtttcagaaacggagctctgggaggctttcctctttttgagcacgggtcagatgacctccaggtcgacgtggccctgtctccccacaggggtctctgttttaagggggctcccactgtcttcttcccacacctgtgcaggtggaagtggatgtggacgagcagcgcctggcggaaggtggtggggtctgctccttccacctgcaggcagccctgggggaaatgctgccctccccaccccccagggctctgagtgtggagggcaggggcaggaatggcgtccctcaggagccagcatggccctggagcccccgagtccctgaggaaagtgttgatgccctccagcatggggctccttctcatcctgtacgcccggctgccacccagcctggtgggccaggcaggcaggtggatagggtgggcaggccgggcaggggggcaggcggtcaggcagccctctcccacagtcctcatcgacggcgtggagtgcagcgacgtcaagttcttccagctggccgcgcagtggtcctcgcacgtgaagcacttccccatctgcatcttcggacactccaaggccaccttctagccccacccaccagggggcccacctcctgccccatgctgtgaggggcccagctgcatttctgttaacatttcagtttactacagagacagacgcttaaaacacaaagagaaacagtcttaagtatgaatgtgctcacaacgtggaaactaacgggggagctcctgccaggagccgaataactgctctgcttattaacccgaacgttcggcccggggctgggaagccagaaggacgatgctgagccatggatcgcggaaggcgtcctctggcctcaggagccacccagagcctcacaggctgagttcttgcctctgtgtcctgtccttcctggaagtcaggactctgcttcctcagggagcccggggaaggcggagctcagtggccacaggccgagggccatggggccgctcagtcccgttggggttgtcctgagttgagcctgggggggccgtcctgcccgcctaagagatgcccccagcaccgcacactcgtggttcccaataaactcctgcctgcggcggaggttttatagcagcagatatttttaatgcttttcaatacatgttctaatgtagctgccaaacatgttgctcttctgaagtccccctggggctgggcagagccagcagagcctgcccccacttccccagcccctgccccaccccgcctcacaccttccccactctcaggctgttcttgaaacaccatgaggcttctgcgtgtagtccctgccccaaacttagcaagcacaggggcctccacagcccaggtggccccagaaaatgttccagagcccagcttggtacatagtgagatgctgctggggttggcctgaggtgggggccacttcctccaccccagtgggtatgtctgaggtcagccatggggatatctgggttgagattcaggttttggtgaatatggggcaggcgtccagatgtgtttgtgtcacctgctgcaacgctgtagccaatgaagattccagcgggatggcctgaccagcggggccggcactttggagccgtgggtgcagccaggtaccccgtgcagggcctgggaggctctccaggccacagtcctcagagcgtgttgggtcccatgttgtgtgtgggttccatgccctccacacagcaggagagggcttccctgaccacacctgccccctcagtcctgcttctccccagtaagcctgcactgtggggtctccataggaggagctggggaagctggggccctcccaggggtcctgatcgaccctgggggctcttggcctggtttcgtaagatggagcactgcaaaaggccatgctcagaaagcaaacgcagggcagggtgggcctcgagccggggctggaggggtctccacccttgctggcctgagagatggcccacatttcttacttgtgaccgccctgctcttcctggccgccccccccaggtggctgaacagggtgattttgttgtggtgaggggccaggatgtggcctggtgtgcagcctcagctccctgggttcaggcctcagaggtagcctgtgtgcaggaggcagagccccagcccctcccagccagagcccctccacaccagggactcctccttcacctgggaccaggagcctggggcacaccccagggtgggggagagggtaggaaggtctcccattgaatcctggcttcaggctctgccccgagaagtgtctgcggtgagggtgtgagccccgggctgatggcctctgaccccggcaacaggtgggaccctgactgactcgttcagctgcccccaagctgggctgcagagcatctgtttttctgctctccagtttcttttctttttttttttttttttttttgagatggagtcttgctctgttgcccaggctggagtgcagtggcatgatctcagctcactgcagcctccgtctcccaggttcaagcagttctcctgcctcagcctcccgagtagctgggattacaggcgtgtgccaccacacctggctattttttttgtatttttagtagagatggggttttgccatgttggccaggctggtcttgaactcctgacctcaagtgatccacccgcctcggcctcccaaagtgctgggattacaggcgtgagtcaccgcgtcctgcctgctcttcctgtttctttcccaagggtcacactcagtagggagatgaaggtggaaacatccttgctgtggctttctggcctcagagcaggttttagaggaaggggccacaggctgcctagtgcatcctggctgtgggcagcccctttcctggagccctcctgcctaccccgtacctcccatctggctgcacagctccatccttagccacgcaaggggagaacatgggcagagtctccatccagcagctgggggttctggtggcactccctgtgcccctgctgctgctgggctgtgggtctgccctgcacccaggagccccacggtccatcccccacaccatgcccagcaccagggaggttgggcagacaagacctgggccatgccagccctctgtgcctcggttttcccactggttacacaggatggtcgcattttccctgcctacctcacagagctgttctgagggtgcatggaggagcactctgtcccaccaaggacaactagaaaccaaagccatctgacagccagtgcggtaagggcgggggatgtgtgtgtgaggtgtgcacaccccccgagaacctggccctggactggcctcacaggacaggaggcagccccttgtagagctagggctcagccccatcagtctcaaaggttaagccaccagtcaccaccgaggcacccctcaggcctggtggccactgtccactattacgtagacagaccccaccctcacccaggccagctgtgggccagtcccgccctgcaatctggtctgctgccttcctcttccatgttggtccccttggccactgtctctgggcatgcaagccagtgtcctggttcagtgcctcggccagagctggggcaggagaggggcctctgggtgagagctgggggtgtctctgcagggtactggcagccttgccacactgtcctcattcccagatggaaagacctgagtgcctctcgccttcctccgggaatgaattcctcatgaaaatgaccaggccacttcttccgagggccaggccgccccctccccgagacctgtcctgccgtccgcgggtgtgtggcctgtaggggactgagagctgggcttgctgggcacctctggaatctgaccctgtgggccaaagaagcaccactgtagtttctgcagacccccatgcggttcattgtgcattgtttggtttctaggatgtatgtgttgctagttttttttaatgaaaccctggattaatgtaaatagctttttggggaacggattctaatgtcacgtatgtgaccgtgtggactatttcaaggtgctgatgcaacactaataaacctggaggggccggc

SEQ ID NO: 1261 - DNA, 83734 bp, Homo sapiens
cggtggacccccacgactctcccggcccttgcccgcggctcccggggggcggggcggggcgccccgggcggggtctgtgcgcaggcgcgtgagtgcgcgctctcgcgcaccggcgggcggggacgccccgtgaggcgccgccggaggaagcgcgcgcgcacctcacttccggcgcgcgctgcgccggcggcgattggacccgaggcggcgagctggcgccccgcccagccaatcggcggcgccggcgcgggtcggagggcgccgggcgcgcgcggggcggccgggggcgcgcggggcgcgggcggggcgccgggcggggcggggcggagcggccgcagctcgtcgccgcccgcgggcctgtccgacgccggggcccggcccgtcccctccgccgcccggcagccatgtgaccgcgccgccgccctccgcgcgcccggcccgcccgccgcgcgtccgcggcccggccgcagccccaggccgccgagggagcggcggggccggcgccatggccgagcgaggccgcctcggcctccccggcgcgcccggcgcgctcaacacgcccgtgcccatgaacctgttcgccacctgggaggtggacggctccagccccagctgcgtgcccaggtacgcgccgcccgccgcgctttgttcccgccgggcacctgctgggggtgtcctggccgcggcctctgcgcgccccatccccggcccgggtcccccagcggagcccaggtcgccccccgcgcccccgcccgccggttcgacgcgtgcagccgccgcccccccgcagctccggcaagcgcggccccagccccccaggtcccgagcaccgggggccgcgctcagcttccgaggacccggtgctgctcagacccggcgggaccttggggctcccgggcggcgctcacctggctcgccgcaaccgcacctgcacacctgcctcaatgcggtgccggccggggtgacgagggtgcttcctctctcgggtaccacacgcttcctttcgcgttcggcgacactgtcagacctcggcctgggagcgacccccggcgcacggggcgcgcaggactcggttgtatcctccgtccagcgcgcggtggagatgccctgtcctgcggggcggggtcgtcctcgcgggtacctggttggcgctgtctctcatttagaggcgtcgccaagccagtactgctatttgcgcctcccagttgatcttgccattgcggaagactggctgttctgcacttggtaggggggcgcccggtcgcccagcggtaacgattggacagggtttaccctccggccatagcccagccttccttggacttgcagcttccctgagtctcctgctcagtttgaaacttttgtaatttcttcgtgacttggtagttcctgctcaggaagctcccaggctaaggaggagagagacacgctctccggaaaagttctggttctagaatagacagcaggcgagaagaggaggcggttgggggtagtgagagttctccctggggagatgggagggtgagcggaccttccaggcactggaagtggccagtatgcctggaggggaccccacgtggcattgagttgttccacccctagtcagctgcaggtgggcctctccgtgctttcctgtggctcccacagcctgcatctctgagcgtggtgttggagttgcagagccgctggacagtggggcttgccctcctggagcgcagggttgggacctcggggctttggttttgctgagtggacaggaaggatgcccacccggcacgactcttgcacctggcggggcctcccgaaggacccagtgtccatatgagacctaagggtcagcatttgcccaaggtctggggccgagcactgcagatgtgcctgcttgcctctcttctgggaagtctctggggcctcaaagccaaagccaggagcatctccccaggcctggctgcttctccattccaggtcttggcgattgccccaatgtcaggtcccacagccccacagcccttctcctgtctgcccctctgagtcactgcctcacccacagccccagaaccttcatgcgggctgttggcgctcccctgctccagcactgcagcacatagcctgcccttgctgaacctctgcagcagcttcctggggccctccgaatgagcagcaaagtctttaacccaagggaggtgggggcgtgtggcaggaggggccgggggccttatcagcccccctgtggagctgtgctctattctccaggggtctagaaagcccactctggtgtctgtggggagggtatgggtagggcgggtttcgagaagcctggttaggacaggcgggggtagatgggggcacctgggctgggtagcactaagtgctggggggggtcccgagctctggcctggacagggttgggaggaagggtaggcaggaggacaggatttgttctgttggtgtggagttaatgggcggaggagttaatgggcggaggggcgagtggcgcagctgaccaggtgggcagatgcagtttgttcgtaggacatgctcagcctcataatgagctcctgcccttacctgtcctggaacagggcccctcataggcgggcttgcccctagctttgctttgtgcttgtgccgcctgtccgtgcatcctcggacagtctgctacttagttttgctttgttcctcctgagttcttctgtactcctcacttttgcccagccatgaagcttctgggctgcgtgtgtgctgatgcctttcggcgtgttcactgctgcgtactattcactggcgtgacagtacctcggctttgcttctgtcaagggaccttggcttgtttccagttttttggttaattacaagccccgtgctgctgtggacatcgtgtgccagtcttctgcgtgtgtctttctggatgggcagggcctgtcttaagcatgtaccgccagctaccaggatttatggtgggggtgtgcacgcactcagcgttactgctgggcagttttccagagtggttgtgcctgctccggcccccactgacagggacgagagtccccactgctccacatttgtgccaacactcatttgacttaatttttgccagtctggtgggtgtgaagtggtatcgtggttttaacttgaatttctctgattactaatttaggccatttgtacttccttgtcagtgaaattcctgttcctttgccagtttttttttctctttttttctgcttgagtttcagcagtttctttagagatagtcatcctttctcggctgtgttgaggatgtccccgtccagttatgagcgagtctttgctctctgagcagcctctgggtgcactccccgtgtcagcctggtggagtgtgcacattgactgtttgccaggctggggtgctggtctcgtttcggttctccttctgggaggcagccggagaagtctgcccccgggagcttgaactgggcatgctgggctgttgttggggaggcctgtgctccgggtttccttgcgacgcttttggctcagcactgttacacacggtgctcctaggtggtccacggggtatgcgtcagtgcctgtctgtggcctctgcctcctgggttcccagagtgtcctcctggtgcccatgtccctgagcgcccccacctgctcttcagcaagggctgggctgctttgtaccttgcccttcccacttgattgttttttcggttgatgtttattaatttgtttttatttatgtattttgttgttgttgttgcagagacagggtctccctatgttgcccagactggtcttgaactcctgggctcaagtgatcctctcacctcggcctcccgaagtgctgagattacaggtatgagcccctgggcctggccatctgtttggtttttagagacagagcctcactttgtggcccagactggggtgcagtggcttgatcatggctcattgtaacccctaaaacctgggctcaagcagtcctcccacatcagcttcctgagcagctgggactacaggtgtacaccaccatgtctgtctaatttttttgttttgttttgtttttttgagacagagtctcactctgtcaccaggctggagtgcagtggtgcaatctcggctcactgcaacctccgcctccctgtttcgattttcctgcctcagcctcccaagtagctaggactacaggcgcctgccagcatgcccggctaatttttgtatttttattttatttatttatttatttatttttattttattttattttattttgagatggagtctcgctctgtcacccaggctggagtgcagtggtgctgtctcggctcactgcaagctccgcctcctgggttcacaccattctcctgcctcagcctcccgagtagctgggactacaggcgcccgccaccacgcccggctaattttttttatatttttagtagagatggggtttcaccgtgttagccaggatggtctcaattttctgacctcgtgatccgcccgcctcagcctcccaaagtgttgggattacaggcgtgagccaccacgccctgcctattttatttttttgagaagctctgtcgcccaggctggagtgcagtggcacgatctcagctcactacaacctccacttcccgggttcaagcaattctcctgcctcagcctcctgagtagttgggactacaggcgtgcaccaccacgcccagctaatttctgtatttttagtagagacagggtttcaccatgttggccaggatggtctcgatctcttgacctcgtgatccgcccgccttggcctctgaaagtgctgggattacaggcgtgagccaccacgcccagccagaattatctttttaagtttcacacaaagccacatttggtttataattggaagttctttaactctgtagagcaggttggggagaattgacgtttgtgtggtactgagtcttctcattcatgatcaagctatttacttaggtcttgaatgtattttgagagttttacaagattctgctgtcatgcatatcctttgttacatttattcctagatgcttgtattttagaagtcatagtaaaagtcagctttttattatgtttgttgctaacatatagaaattcagttgatttttcaaagaaatcagtgattttactatttttaacctagtaacttatctatagattattttgtattttcaaaatgtatgttttgtcttttgcaaaagacaaagttgtttcttttcaatcctcatacttttctttctttctcttgcctgactgtgccagttgtcatagtacagtgttgaatatggttggttgcgtggattacccgtgttctgtcttgaccttaaggaaggtttccagtgttttacctttaaggacgatgtttgctgcaactttttgtggatagcctttatgcacttaaaaagtctcatcctattcatgacttgcaaaggctttttaaagaaatcattatgagtggatgttgaatataatcaagtactttcattaagaggattatataatttttatcttttcattactattgtggtaaattacataaattgattttatttcttttcttttctttttgagacagagtctcgctctgttaccaggctggagtgcagtggcgtgatctcagctcactgcaacctctgcctcccaggttcaagcaattcccctgcctcagcctcccaagtagctgggactacaggtgtgcaccaccacgcccagcgaatttttgtatttttagtagagacggggtttcaccgtgttggccaggagggtctcgatctcctgaccttgttatccgtccacctcagcctcccaaagtgctgggattacaggcgtgagccaccatgcctggccgtaaattgattttctaacattaacctattcctggaaaaatactagtttaagcatgttgtattaccctttttaaaaattggtggatatatatttatttatgtatttattttttgagacagggtcttgctcttttgcctaggctggagtgcagtggtgtgaccatggctcaagcaatcctcctgcctcagcctcctgagtagctgagactacaggtgcatgccactggcctggctaattttaaattttttgtagagatggggtctcactatgttgctcaggctggtctccaactcctggcctcaagtgatcctctcaccttggcctctcaaagagctgggactccaggtgtgagcctccctacctgcccacattggtgggtttagatgatagtatcttgtttaggacttctgcatgtgtgtctggggtctatgtgcttcctttcttctgtagtccttagcagattttggcgctaagatttccttgtgaaatgaaatgagtactgcctcttttgctgtatcgtggtatagcttatgtaaaattggaatcatttcttccttgaatgtttgggataattcacttataaaataacctgactggccgggcctggtggttcacacctgtaatcccagcactttgggaggctgaggtgggtggattaccggaggttaggagttcgagaccagcctgggcaacgtagtgaaatcccatctctactaaacatacaaaaattagccaggcgtggtggcacgcacctgtaattccagctactcaggaggctgaagcaggagaatcacttgaacttgggaggcggaggttgcagtgagcccagatggcgccactgcaaaaacatttttttttgaacctgctttctgggtcagtgtgtcaattttaatgcacgttctgtttatacttaaaaggaatgtgtgtttggcagttgatggtgcagtgtttgtctattagatcaagcttggtttactgtggtcttcaagtccgttccctttttttgtctactagaaatgtatgttaaaatcttataatctgagaatagattggtccgggttttctaacagttctgtcagtttctgtttgatactttttttttttccagacaggatctcactctgtcacctaggctggagtgtagtgggacgatcacagctcactgtagccttgaactcccaggcttaatcgatcctcccacctcagcttcccgagtagctgggactacaggtgtgcaccaccacacctggctaaattttgtattttttgtagagactgggtttttccatgttgctcgggctgatcttgaattcttgggctcaagcagtctacctgcctcagcctcccaaagtgctgggattataggcatgaaccactaacgccccgtcacttaatatatttttgaggctatgttattaggtacatacatgtttagaattgtaattctaggtattttgaacttttctcattgtatgactgcttttatatctagtaatgctttttgtctttagtattgactttgatgcaagcattcttttggataatttttgcctgttagctatttttctatcctttttaaaaacctttgtatatccttacatattagatgtgtctttggttattcagcatgtatctagatttcattttcattcactctgaccttttctgacttttttttttttgagacagagtctcgctgtgtcgccaggctggagtacagtcgtgcaatcttggctcactgcaacctctcctcccgggttcaagcgattctcctgcctcagcctcccgagtagctgggactacaggcgcctgccaccacgcccagttaatttttgtatttttagtagagacggggtttcaccatgttggccaggctggtctcgaactctcgacctcgtgatccgcccgccttggcctcccaaagtgctgggattacaggctgagcctctgtgcccggcctttttttatttttattttttattttttgagacggagtctctctcttttgagatggagtcttgctctgttgcccagggtggaatgcagtggcgcaatcttggctcactgcaacctccacctcccaggtcaagtgattcttgtgcctcagcctcccgagtagctggaactacaggtgcgcgccaccgcacccggctcatttttttgtatttttagtagagacggggtttcaccatgttggccagactggtctcgaactcctgacctcaaatgatctgcccgcctcggcctcccaaagtgctgggattacaggcataagccaccacgcccagcctaccctgtacattttaatgtgcatagttaattgtatctttactctcctgctgaactatgcagggaccttagcccactttattctaatccaaccctttcatgtttatatttatatgattttgttactgtgtatcttaattgttttcttgtgaagcccacaagatgttgttactgctttatactgtgatatttgatgagcttcaaaactcaccacttcctttgttgctcattcttcttgcatgtcaggaatcattttccttcttctgttgaatatttgttcttaggatttcctttagtgaggatctgctgataactaccttctctttctgtttgtctgaagatgttttagtttaccctcaccctgagcagggcgtgtgctggttgtacgatgctggggtggtgtgtgctcctcccacaggtccaggcagggcgtccctggctttgacttccagctttgctgtaagaggtcagcggccgtgacaggctggagggagacgtctgggtggctttgtggtcatgtcatcgttgccaacggtcgtctcatggtgggtcctggtgtgggttctcttgtgattgcctgagtcggggttactagacttgctgactttgtggatcgatgattttcatgagtcccgggaagctctcagccactttttcttctgctgttggttctgcgctattctctctctcacctctggagcaacaattggacgtgttgctcttcctgccggatcctccacatccatagatgcactgggtggtgtcagtgggcggcggctggctggggcagtagcctgtctccagcccttccccctgcctctgtccacgtgcaggggcgtctcctcaggacgcatgttgcctactgaccgctgccagcctgcacgagactctcacggcgggaccctgtctgccttgctcggtgctgcccagagcctgcacagtgtagctccttggcggacgttcctgtaatggaaccaggatgtcatgccaaggagtgtggtttcattttgagtggtggggaagtcgctggactatttcaagtgtgtgtatttgggagagcagtgctgctggagtggtggaccacactggaggtggagattgcctcagggtgtgcaggtggagatgggtgggaggtgtcgtgcagggcttgggacagggctttcggaggtggtctgcagtgatccagggaagatgggctgctctgagggaggggctgaggaagctgacctgggcagccagtggcctgtaggctgggcagcactcgagctggggccaaggggcagcaggacggtgcccgtagccctggaggccttggggattcggaggacctggcccatcgccgtggcctgcacggtgcgtgcacaccgctctgtccgcgcaggctgtgccctgctttcaagatgcctggaaacctctggcagctctgtcctgctgtcaacactggagtcacatgtcagtgggtctcctgctggggactggcttttgtgcaggagatggagggcagggggctacagtgcccttggactaaaggatgctttccttggatctgggcactagaaccagccctttccctctctctgcccagcattctcagcatgcgtctcaggaaggtttgatggagtgggcagctgcggtgctgtggcggggtcggggggctgctgcagagagcgggtctgcggtcagtcacagtgacgggggtctctttggaccctgtgacttgtgtgtggtggtggcaggcagtggcgttgccgagacagggtgctcaggtgcaggtgggaaggggtggcaggatggaggttgtacagtgctttccccaggaccagggggcagggtgtggcgtgcttattcctgcctggccgtggagggtctctgtaggacaggctcccgctgagggcagccctgaggcctgtgagctgctggccccgcagggtggctgggcctggctggctcagcagctgctctgagaggcagccctaaaaatagccgagcgctgagaggccgtccctttctgctccgcaggcgcgcgccgatgtgtgctcagctcaggccgacttagcagggttgtgagagtgatgagagcgtggctgctggtcatggtgctggggtcgtcagcagctcctcgagggctccggcctgtggaggccggtggcgccccgtctcaccccacggatggggggcaggctctccaggagccccagggagcactggctactgctgggctgctctcaggcccgggacattcatggccgtagccccaggtcctctgcatggtcaggggccatgctgggtcccctggggtgcagatgccgctcaacagaggagtcaggacccaaaaggggcagaaatgggcaagggaagacactggggaaggggtgggtctgcccttcctgctgggggtgcacacgggcctggggctgagcaacccgctctgggcctggctgttccgctccactgccccaaccagcctttcctcagcaccccctggccaagctgtgggcaccccctgcccccggacacaggcagcacctggccaagtgcagagacactccagctggctcttcgcctgtgtcccagccctgagggcaccgtcgtagggtggtgggacgggggggggctcggacacagtggttgtggaggggtcagtgctgtggctcggggtggggtggggctgggggagggtttgcttcagggtagcggctctcttcaggggttcagcaaggagacagatgggttctaatgacccctgagtcctgagacaaggtggggtgagctggagcaggggaggggacttggaagggccttcagtccccatgcagcccttgcacaacctttcgggccaacatcctgggccttgcttggcagaggagtttgggatccacgggcttgaggcccaggtggtcagctcgctcggtgcaatgctgtgtctcgcatttctgtctctcgactgccccatccagcccgtgtcctaagagcagctggcagcagccgccacgcacaggcagctcagctcagcagccccaggagccaggtgtgtcttgagctgggcagcaaagtggccatgcagtccagcctcccttcagccttccccaggatgcctttcatcttggggagatggccattgtgggggtgaccagcactgtcccttccctggcaggccaggatgtggatccacagcgaggcagacctgcagatgcacatccctcttctcaaatgctgttcttgttctggtgagcacggggaacggcaccaagccaatgctgatgggaagggccctgaccttgggctgctgtcctgcgagcttggcccctctgctgggcccctcctccatgcctttgtttactctccaaccttctgggagtcccacatctgcatcaggacagaggtgaccagggaccagttgacagctaggatgccaccagcatcttttgtttaatttgagtctcatttcccagtgtaattctgtagctgaccttgcaggaggcattgacaatatttctttattgtatggccccagccaggacttccctctttttagatgcaaaataattgggcaagacttttcatgggcattgcatgctgggctcgtgcaggtgtctccagggccgcctcgagaccagcgcccgcctccctggtcctggatacaggtggggcgggggctcccccgcagcagtggagttgagacccgcacctgcttcctggtcctggacacgggtggggcgggggctccgcagcagcagtggagttgaggcttccgtatgagctcgctcctggtcagtttgagggtggacataccagacatcctgcatcttcccagtcgccccaggagcgcctcaggagggtgagtggcaggaggccgatgccctgctagcaggcagtccctcggggccaggccttcctggtgcggtgctgaattgggctgttcgttcctctgagcaccaaggagagggatggcggctcaggcttcaggcagtgcccgccggtgcctctagaaggtgctccgtggtggggcccgggagggtggcccttccacattctcgggctgcctgtgtgccacccaagtgtcaggtcatgaggcccctcggtctggcctagggctctccttcctcccccacctcaagcctggggtgtggcctagccagggaggggagcgggagctctggccgtgaagacccaccctgaggtctgggctctcctggcctgagcgtgctttctgctatgagctccacgttcaccctgcggccaggactctactgttcctcctggtgggagctgctgtggtgccctgggtggcctccagtcaccgccagcctgccccttgcagtcagtcctgctgttccttcggctcctgcagtttccagcttggccctggacttcctgtttttcccacctagctggacgtaaaggttgtcgcgccttggaaagttaagtcactacacccgaatcgacgcactcttggctcgcctggctatggcttcagctggaaacggagctgagcgtggcttatgtttataaatacagcacctatcaggtccagcgtcgctgtctcctgcgggaggtgtcagctttgggcgtgaagaacagctgcaaggccacagggccaaggggtatctcaccagctgggaggccggcgtgcctgacctggccacacagagcgagcctcagaagcgagggggaaggagggcaggccttggggaggggtccaggaaggtcgagaggctgcagtggtggtagcctgaggggatgtgcgcggccaggtcagtgcctgccgctactgcctgctgcgctgactgcctgagcactggggatcgtgggcctgaggggcggggaccttggctcccgtggatagctcctgcaccatcctcttgcttctcagaccctcggcaagtggtgacagggggctggggtggagttgttctcctgccgtggtcctgtcaaatggtgctgggggcggggccaggaatcacagcaggtgtctgccgctagcgctcggagcctgtgctgggggcagggtggtgcatctcatgcctctgccgcttgctcactgtacttgcctggggaggatgtggcaggggcagaggacagctggccaggctcttggactgcacctgactctggtgggctatcgaaggttttggaggtttctttaattagcaacatgatatccagagattgcgactgtggctcgagcggttccctgccagggagcaggaccattgacagccgagccttgactcaccggcccaggccacccgaggggccattgacaactgagccttggctcaccggcccaggccacccgatggaccattgacagccgagccttggctcaccggcccaggccacccgaggggccattgacaactgagccttggctcaccggcccaggccacccgaggggccattgacagccgagccttggctcaccggcccaggccacccgaggtttcactgcggattctatcagaacagtgcctccccccaggattcgtcaaccttcagtggaccaggccctgcagtggttccagttattccctgggaaaatttccagcactgattagggggtgactcttggtcagaggttgagtgtttccctaggtgtggaggtgcacggagaagagaggggtgcagttcttaaaggacacatggcttatgccacaccccctgccccaacccccggagtggccagctttcctttgactggggaggaggcagctgtccagggttgtcctcacctctcctcctggagaatgtggtcccttcagaaaggggacccagtagtgggtgacctggtgcaaaccacccactgcctcctctgggccttcctggggctcttcggctctcaggagaggagggagctcaggctgtggctgctctgtgagttggacacggacgctccagccgctgggcccagcagtgtgaatggccatagagaacaggggcccagaggctgctctcgaggacactggcagcagttgtgctctgggctcgccatccttgaagctggaatattccacaagtgccacgcacttgctggaggtactgcctgggggtagactgtggccaggccctcccagcagcccgagtcttggcgcgtgggctggactcccacactcagcacctttctgctgacctgaacacccagggcacagtggcagcggcgtcattaggatttccaactagctgtttctgttaagagtgaagaggaaaccttgtttgattagactcattgtaaaaaagattccagtgaatctcttgcctgctgtctttgcagttgcctctaagggtcacgaggcagggcggcgtcctctctcagtgccactgtgacctggcagcacctcttttgcatattattgacctagagagagaggtcaattgtaattcggagctgcacagtcggaaaatttgtagcaacagagaattataggcgctctaggcattcgatgaatcttctccaccttgctgtggggttaattcaggggagcagtggggagtgtgctgggagtgagattagagggaggactccctggaggctggccctgcgccctggaggccagcatggccctggtgctggctacatcctctggggctcttcctcatctgtctgcagaggaggcagctgtggagcgagggtgtgtacgggagcaggatgggctgcacagaagcctttccgggggtgcctgtggtttgcaggggcctggctgcagctgccctgtgtgatctctgtccccgtcttctcccggcttccttgggtcctgtgtgcccaacttggcacttcaagatttgctccctggcaactgttgcctttcccagaagagaagtccctggaaccaggaccagcctgctgtcacctgcctgctgctcctgccccaccagaaccatcctgagtccaaactggctgagagtcaagggggtgttcagggcctccaggagctctgggagagtctaggatgctctagatccttgggctcatggggcagtagagtggggggctgtggtcctgggcaccctctggagagaccgctctggtgtcagccaagtggcgggcaccttctgggcttgggggcggggcttctcacgatggctcagggaggtccagacagcccccttgtctaggtgcgcacctggagtcctttcctgcgtgacttgcaaacaggccttgcagggctctagtgtatcagctcccggactgcaggcagcagcaaactctgccgtgtggtactgcttctcatggacaggagaccaccaggctccttccaggagggtgaggtctctgcagcgggagcatccaggcctggaactcgagctgtggtgtggtggtgccagcccaggagccaagcacagccaggagatgaaacccatccctgtggtctgcacgtccatgccagggccgagcccccagctgggatgccctgggagggtgcagggtgggctctggatgcctgctgggggatttcagtgagaaccaggaagggttgagccagagcctccgagaagcctggggtccatgtgtgggaaggaacggggacagggagcctccgagaagcctggggtccgtgtgtgggaaggaacggggacagggagcctccgagaagcctggggtccgtgtgtgggacggaacggggacagggagcctccgagaagcctggggtccgtgtgtgggacggaacggggacagggagcctccgagaagcctggggtccgtgtgtgggacggaatggggacaggagcctccgagaagcctggggtccgtgtgtgggaaggaacggggacaggagcctccaagaagcctggggtccgtgtgtccgtaggaacgggggacaggaggttgtgaagggcgtgtgggttccgggaggctcactatagtgatgtcctgccttagacgaggtcacacaggggaaggttactgtgccgcagagttttctttccgagcactcaatgctcacctcctgggagggagtggggccgcagccagccctgacccagctgggtgtgtggccgctctctggacccccggtcccagggtggcagctagtgcagcctaggccacaccagcatgacccctcgcccctgtctccacggagcaccgtgggactctggcatcagaatcctggggccccacccaacacccacgcatttcctgtcttttctcaggcaatcgccatggtacccagggctggccttgtttcagcttcctgacgagtgccctgtggtcagtcatttctgtcctcgcctttacctcaaatcctgctttttgccttaagtgcgttcccaattccatctctgtgccagctgtgccccatgcagcctctaccggcatctcacgtgatgtcaaccttctgggtccttggggcctagccttgctctggtgaacggctttgttggatgctggggttggcattttttttttttttgagacagagtcatcctgttgcccaggctggagtgcagtggcacaatctcggctcactgcaaccttgcctccagggttcaggtgattctcctgcctcagcctcccgagtagctgggattacaggcatgcaccgtcacacccagctaatttttgtatttttagtagagacggggtttcaccgtgttggccaggctggtctcaaactcctgacctcaggtgatctgcctgcctcggcctcccaaagtgctgggattacaggcatgagccaccgtgcccagcctgggttggcttttaactggcaagtttagtctgtgtttctgtgcgatgatatagttgcatgtattcctgtcattttgatcattttgattgtgtttattacgtatttcctctcctaagttttgttatttcctcctcggaaattaaggaaggatcaagactgattgaatttatttgtatttttgagacaggttctcactctgttgctcaggctagagtgcagtggcatgatcatagctccctgcagcctcaaactctggggctcgagtcatcctcccatttcagcctcctaaagtgctgggattaacaggcacgaaccattgtgcctggcctgagttttatgtattacccactccaggaaatcactgtagtccttttaactgttactgatttgcttaaaatgtgaaaggcctgttgacatttaaggatagtcaacaaccctcccaccctccaaaggaaggagagctgaaatgcaggagaaacagcaatgcctttgatgagtatggctttgctgctactttgctcacctgtggccctgcctttcccaaggatagtttttgttttcctggagcacatccttcagaagctctttcagtctttcagtgcctgaagatggcgtttttgtccccctcatacttggtgatcacagagttcttctaggttgacagttttgtctcctcggtactttgacgattgttttattgtcttctggcctctgttgtggttttgaggagtctgcgatcagcctgctccttgttccttgtgggacacatgtgtgatctgtggttgcttttagcgtttttattttgatttggtgcggatttgttatcaacattgcttttgatcctccttgggacttactgaatatgagcatctctcttcttgttttggaagaatcctcagtcagacattgcatctccttccttgggtggaagctgctcagtcactgtcctgtgccttgccgtggggctgcctgtgcctctgtgcctgcttctccttccatggggagcccctcccagcccctcactggcgctgggaagcacagtggtcctcccctctgtgggctgtgttgagaaatgttgctggctagtcccagacccacaacacggagcacgggggttttgcctggtgcccgtgatatcagtggggagtgagaggagcaggtggccccctcggctgtgttcagggtgtgcctgtgtggccgaccacctccaggactgaggccacacaggaagcagttgggattgtgaaaacccccatgggaagctgtgctgatcctcccctgagcctgtgacagctgagggcacaggcaatggtggggctcggtgcctggggctgagttgggaaggtttggtgtctgacccacttcttcccaagtgggagctccctcctcgggcactgcatggcttctctgcggggcctctgcctggtcctctcgtgggcggtccaagacctggagcccaggaggtggattctgaggtctgagtcccccgcaggacagcagttccatcctctggtccctctcctgcccccaggggccagtaggttacagacaccttcctgaaactccctggaggggagcagccttgattcctaaacaagaagttggtcctaagtgcatcctcttgatgtggggcagagaagaaatctgagacagtctcatgcccccaccgccatcgtccccccacttttttgtgggggtgcccaatctgtgctctgccccctccccaggctccgctcctgtgggctgcgtcgtggtttctcctctctgtgggacgtgtgctgggcccctgggggtggatgcagaccgagcctgggcccatgtagaccaactggcgtgggtgtgagagagagagacgcatacccactcaggcacatacacgtgcacacacacacccatgcacgcgtgtgcacacacaccctggccctgttccctaccagtccccaccccctcctgctgcatgtgctcctggttccctctcttcacctgacagctggagtcatcctcctgcccacagccgtgccctgtgcagagcaggtgctggttctgccctcccctggcctgccccaggcggggacactacactgggaagctgccccgttgcaggcgttcccatggcgccactgctgtgttagctgcctgcagcacaggccggccagtcctggggtgctggacagaccctcctggaagccagtccctggccgtcctgtcctgctgggggcacagtgtctcggcagaaggttctggctgctccctggggtgctggcttgtgtcacctggctttgctgggtcccagtgacatgcagtctggggatgttcctgggacccgttgggcttgcggtggccacttgggaaagctgagcactgaaagtgccaaaacctgggacaccttcttgcaggcccactcttcagcctttgccccgtgggccattggggagggaggaggtgggaggttttggcaaagcagcccaaaggtccacacagacccagggctggcaaccggcccggcctgtcacccttctcactgagggtcacagcctgtggcccatggcagggctgcccaggacaggggcttggccccggaggcctgcagtgtgaggcgtggcccacaggccttcccagagggggttctgggagcctcccccagctgtcacacgcacctgcctgtgcctcacccgggctaaaatagcccctgcacagaaacgcccttgctgggcagggcccattcctgctgggagacacctgtcagggcccttcctgcctggggccatatggagtgtccagcctgggggtggtcgtggggtgtcgggggcctgggcctggatccacgatgccctgtctggtctagagcctggcctggcttccccttggcgtgactgcccacaggcagtggccgccgtctgctcagctgcatcctcctgcgttgggctcatctgtctgccttcccctgacacctcctcctgccagactccagggccaagggagtgggccccggctgcagaggcagtgccagctagctgagtgggtcaggccacagaccccacctgactccagggcagcgtggccaggagagcattggaaggagagagctgttcccaccttgaggctgacgcagaccagacctggctctgtcctgagcagcagaaagtatgtgcagggcttcaccctcttccctctgtctgtgtagagctccacctgaggcccagtgtgtgcgtagagtcccacctgaggcccagtgtctacgtagagctccacctgaggcccaatatgtgcgtagagctccacctgagggccagtgcctacgtagagctccacctgagggccagtatgtgcgtagagctccacctgaggcccagtgtctacatagagctccacctgagggtccagtgtgtgggtagagctccacctgagggccagtgtctgtgtagagctccacctgagggccagtgtgtgcttggtgcccacagctgagttagcccaggctcgtggtcatgctcacaggtgcacgtggccacacaagtcactgagcacagacccagatgggatgcagctcataacgtgcactgcgggggggagctgtggcatcttttcccagagcccctctggtctggcagcctcgggagtgtgtgcatggtatgggaggtgggaacagagctgggaggggctcccctccatggggtggggttcccctccagctgttggtgaggcacactgtacacctgcacacctgtgcctgggactgttgggctggacgtgtaggaacatggaatggcccctgggccttcgggtgactgagacagaagtacaggcccagcaggtctgaggacagggcctcctgatgactggacccagcctggacaatggccggcagctcccagccttgccacaggctgactggaatgcgtggtgtggtggagcccagcactgagggccggacgtgtgtttgcagcattgttctcacagccacctcggaggcttccctgctctggggcagatgccgttgctggagccgtggtgctcccagaggcaccctgggctcagctcagcccccataggccagtgcctggagtggctgtgacgctgtggccggcgcctggcgtggctgtgacgctgtggccggcgcctggcgtggctctgacgctgtggccggcgcctggcgtggctctgacgctgtggccggcgcctggcgtggctctgacgctgtggccggcgcctggcatggctgtgatgtgctgactccggcaccatcagttccttcccctattctggggcaggtggggaccacctcttcaccctccctcatgggcagggctggcctctgctgaggtggcccctcactgggcccaggcatggagacccagtggtcctagccctcggtgtagtctatccatgaggcacctggctgagcctgttcctctcactccacagcagcctccttggccctgaccactggccaacgaggacactgagaaggcaccctgaccttctgtcctcattagcagggagcagccatgtccagataaggctgtacatcagagaaagctgagtgaggctggcaagagctggcagccgccctcggccgcccgggcgagccttgggacgggctgggtggtaagtgctggtgatgcaggagcagagagccccgtggaactctctccatgaggacggcggtgccctggggcccagctacgaggatggctgtgcaggcacctggagcctggggatggcagggcgtgggctgagcatgtggagcaccagcctgtgacattcctctgcccaggggcagcagggcacggagcgtgtgtggccagctgccgccacaggcccccagctcccacgcgggcaggctcgcgaccgcaccaagggggcagctcctggagacaaaagctcctcagttttcccttccaacaaaacacagtcagcaggtttgggaccagctgcctggggtcttaaccatctgtgctctgtgcgcgcccccacccccttgcctgcctggaggaaagtggtggggttgacatgcgcctcgagggccagccgggcgctggtgcatttctcagaaatccgtgaagtgctcccttgtcctgctcgtgttctgtgctgtccttgggagtggcgcggccgcttgccagggctgcagagttggccacgcagcctctccaggaggccttgagccaagcacaggatgcagcccagcagtggtggcaccgtggagtggctgggcggaagagatcctggtccacgctgctgtctggagggcagggtcctcaggtgaccagagtccgtgcaggagcgagtgaggacagggctggggcaggcggcaggatgaggccgcccagagcaactcagtgagtgaatgagtgaaagcacgcacgccccatgctccagcggggccagagtgtgctgttgggtgagtctggccttccttcctggggttgtgggccctacttgtgggaggccactgtggggagggcgtccttgtagaagtgttaatcagagtgaaagccagtccctgtgcactgctgctgggaatgtagcatggtgcagctgttgcggggaacaggacggcagcccctcgggaaatgagacagagttaccgtcagagttactgtgtgagctagcagttgcacttctcagtagaacccgggagcactgacgcagggcctccaggggagatctccaccctgtgttcacagcagccttactcacggtgactgcgtgatggacgcagcctgtatccatcctcggacaaacaagtcagcaccatgtggccctccgcaccacccagcatcactgggccctcggtcagcaccgcgtggccctccacactgtggaatattacttagccctgaaaaggaaggaaatggacacaggctgcaacgtggatggaacttgagtatattgtgctgagtggaataagccagtcacaggaggacatgcactgtatgatcccatttgtgtcaggtccctagagtcattgcattcatagggacggaggtaggatggtgcagcctggtgatgccaggggccggggaaggtgggaatggggagttggggttgaatgggtagtttcagttgcgcaaggtgaagagagttctcgggatggatggcggtgagggctgcacaacagcatccacgcacgtagtgccactgacctgcacactgaaaaatggttcaaacggcaagttttacgttatatttaccacaataaaaaagagaaatagacatcgtcaagctgttctccaaaataaggctgtcaccgtttaccttcctaccagaaaaaaacagttaagtcccaaagccagggggagcaccagtgttaacctcctgggttggggctggctgagcccgtggctatgcctccctgggcttaggtggcaaccctgcgaggagcttgggcctctcgtcttttgggttcctgttcaaaatgggaagtggtctccaaaccccagggcccacctgagccccctgagatgggaacctctccagacctgcccctgagatcctgtcccacccctggacaagggcctctgtgcctctgaacaaaactggggggcctggtgcagagtcctagctcaggcttccagaagtcagtggtttgaaggggtgcccacccttgctccgttgggacatagggacgcaggtgcctgtctcagcccccacatgtgcacccccaggggcagcagcgtcccctccagtctctggtttgcatcatgcacaggagtgggtgggtgggagtttcagtctcccagagagcatactgttgggccatgctgtctctggcctcctcacccatggaggtcctgccccgcccccatctgaggctgggtggccgaggggtctgttctcagactggggcctggcgctggcccggtttcctggaggaggaagcgggggagtgacctgcggaggacttccagcctccccttccgcctgctgtgggctgcatggcgctggggctctgcccagccctggagagtgttggctgctctccttccagctgacatggaaatgccatgcagggcacgcacgtggggcactttctgctgagtcaggtttctctgaccttcctgaaatgtcacttgttctgtaactcacaaaaactggggtgctgggatatggtgccttccttctcccggaagtccctgccgaggggggcggtggtggggcattcccagggggtgtttgtcctttgctgtctttactttcccaccttgttccttgggcctcccctgacctattgaccctgccacagctcgctcaccccaggtccctgggggctgtgcaggattccgggtcctccagggccagtgtgatccttgctgggttctcagagtgaccctggagggaggtcccctgccgaccctcacctcccgttcccaggtcatctgccccagggccaggtgtccatccaccctgactgtgaccatgtgcctgtgacctgcgtgactgacccctgcccttgggtgcccaggcctagcagtgccccatgccactgggtccccaggcatctgccaggaaaggacagctctaaagtggccagggcagcaggggtcctgatgtctgttgaaggcccttggaattccctggcttcattgtgccatctccccgctcttctccctccctcctgcctcctgtcttcctactctctcccctccttccacccacccagctgctctcctctctgagcctggccccacaaccagaggtgctcactcctgccttcaactgactgcaggtatccaggcatctgggctgagggtgcctctgtggctttgttgaccaacccaggctgacttcagaggtgctcttcagcccctgctttgcaagttcctggggacccgtggctgtcactttggccccttgatgtttatggtggttcccgtagctaagtggatgctgccaaagatggaaagtgggggacgctattccactgccactcagagcgagaccaggtgcttcaaaaagactagcagggttgggtgtggtggctcatgcctgtaaccctagcactttgggaggtcaaggtggggggaccacctgaggtcaggagtttgagatcagcctggccaacatgagaaaagcccatctctactgaaaatacaaaaattagccgggtgtggtggtatgcacctgtagtcttagctacttgggaggctgaggcgaaagaatggcttgaacccgggggcagaggttgcagtgagctgagatcatgccattgcactccagcctgggcaacaagagcaaaactctgtctctataaaaaaaaaaaaaaaggaagaaaaagaaaagaccagcagggccaggtgtggtggctcatgcctgcaatcctagcactttgggaggctgaagggagaggatctcctgagcacaggggttcaaggctgcagtgagccgtgattgcaccactacactctagcctaggtgacagagcaagattctgtctctattaaaaaaaaaaaaaaaggaatggagatgacaaagaacaagtcttaattgaatattaacaaaagccagaagctgattggaaaagcttaataaagtagcaaacatgcctggctaatttttgtatttttagtagagaggagtttcaccatgttggccaggctggtttcaaactcctgacctcaggtgatcagccctcctcggcctcccgaagtcctgggattacaggcatgagccaccacatccggccaatttttgtattttttgtagagatggggtttcaccatgttgcccaggctggtcttgagctcctgggctcaggtgatccacctgccttggcctcccaaagggctgcgattccaagtgtgagccaccgcgtctggctaaggagtattttccttagcagatacaaatttatttaaattagctatgctagttaaaacaatatggaattggcagaagtataaacattgactaatggaatgtaccagcagaaacacatgcgatcgtaatgtgcttcagaaatggcctcattcatctgtggggaaaggatatacttctgggtaaatggtttggtgataactgaacattcatgtaggaaataaaatgcaatcacaacacacacaactccaaatggatggataatctcattgtgaaaaagaggaaggaacaaatgggggagtgggatggattaaagcagtggtccccaacctttttgccgccagggaccggttttgtggaagacagtttttccacagacggtgatgggaatggtttccagtgaaactgtcccacctccgatcatcagccatcagattctcataagcagcgtgcagcctggatccctcgcgtgcacagttacaatagggttcttccggagctcaggtgggaatgctcactccctggtgctcatctcctgctgtgcggccagttgctaacaggccaggaacctgtcctgggggttggggacctctggtctacagcacaggtgacttttctgtaccagagctaggaatgaagggctggctgagctggtgcttcctgccacctgtgtagtggtgcaggtgtccatggtccagggctggccaggggcatctcctgtcctggcttggcttctgcccctgggtccgtggtggctgcctgggacctgcccttgcagccagggtgaaaggagtgggcagggcctgctgcctctgctcagggcccctagtggggctgcttgctcagcacccttgccccgtctctggccacgtagccgtcacccagctagcatggggaggctcgctaccaaggggtggggggctggagaacggagcttggagacagctggcagtctcggccacacatagagacacccgctcctgagacctgcagtgcctgcagaggggaagaaacggggctggcggggagagcacacagtgcgtttctgtggtcaggcccctttatttcttcaaatagatcccaagtgtagagaacatgtgctcattcttgttggcaggcctgtgggtttttgtgtctcactctgaacttttcctgtatgcctctcgcttctctctgtcagaaaacaaaacagaagcctctattctctgggattcggattcaagtcggctcttttattcacctatttcgagcagacacaatgaaagaggaaacagataacactgtgggtattcagcaagttgtcttggatgtgaacattgagtttccacttgtcactgtgattttattttatattgagttgtttttaaaatatgctttgcttcactttcgttgctgttgaatctattacagctgcacggtgtcctgaacacagtggcaggctggtgatgaatcgtcttctgtaggttttctggtgtctttgttatgattctctcagggccaagtgtggtgcacctggcctgggcaaacctttaggcctcgctctcagaaccaactgtggataataagcaaataacatgttttgtttatctgcgcagtttctgaatgcaaatgattctttttattccttattttatttatttatgttttagagacagagtcttgccgtgttgcccaggctggagctttttattcttcgtgtttgcacagtggctgtagctatgtgtagtgacagcagagacaggcctgagaggggcagccacgttccccctgggcaggatctgtctgctacgggaccgcaagctgcgactttttccttctaagtgtgcggagaggagcccctgcctagggacggggagccgtagcctgctgtttttgtgacaagcatcttgggcgagggggcactgggctgtgctgcatagatggtgagcactggactcacccccagccccaagtcaaacgaatgtaaggaacgtgagcttctggaaacgagcgtggaagcctgagtggtgaggaagggaaatcttgcagtacctgcacactccccaaatgcctcttgtgggtttgcagtacctgcgcactccccaaatgcctcttgtggatttgtttgtttgtttgtttacaattagttcatccacagcaggatccaagctgctgcctgtgtgtgtgtgtgtgtgtgtgtgtgtgtgtgtgtgtgtgtctatgtgtgagagagagagagacagggtcctctgtcacccaggctgagtgtagtggtgcaatcacagctgactgcagcctccaactcctgggctcaggtgatcctcccacctcagcctcccaagtagctgggactgcaggtgcgccccaccaagcccagctaatttttgtatttttttgtagagacagggtttcgccatgttggccaggctggtctcgaactcctggcctcaagtgatccacccgcctcggcctcccacagtgctgggattacaggcatgattgtgcccagccacagtagagcttcttgtttgcagttggttggtgtgtgtcttgtggctgtctttaataaaacaaaaactttgcaagtatcgtctggtaggccaggcgcagtggctcacgcctgtaatcctagcacttcaggaggccgaggtgggcgggtcacttgaggtcaggagttcaaaaccagcctggccgatatggtgaaaccccatctctagtaaaaatataaaaaattagctgggtgtggtggtgcacgcctgtagtcccagctactcaggaggctgaggcaggtgaattgcttgaacccgggaggcggaggttgcagtgagccaagatcgcaccactgcactccagcctgggtgacagcaggactctgtcttaaaaaaaaaaaaaaaaaaagacagtattgttatggtaaaggttcacccctcacaccttttttcgtatgcagctctgagcttaacatccaccatacaaccaggcacagaacactgggcagtccacccaaaacagtccccagcagccaccctccctactgacctggccttgtgcccccagctctgccttttccagagtgccatagagatggacaaaaatggtgtgtgccctcttgacacgggcgtctctcactcaacacgatgccttccagatccatcctatcacgtatcgatctgttcctagctgttgctgaatagtaccaaaatgtccttgtctttgtgtgaaggacatcggggtttccagtgggtggcagttatgaatagagctgctgtgaatgtgcattagggatctgtgtagggacatatgctttcatttcccttggaccaattccaaggggtaggattgctgggtcctgtatgtttaactttgtaagaaactgccaaactgctttccagtgactctgccatgtggcgttctgcacgttcagagtatatggaagtcccagtggttttgcttcctcgccagcatttggtattagctttttttatttttcatgttttttaagccattctaataggtgtagttggtatctcgtttggttttaatttgcatttccctaataactaataattttgagcatcttttcatgtgcttatttgctatcaatgtatcttttctggtgaaacgtctgttcaaatattttgctcacttttttttttttttgagatggagtcttgctctgtcacccaggctagagtgcagtggcgcgacctcagctcactgcaacctttacctccctggttcaagcaattcccctgcctcagccttccgagtagctgggactacaggcttttctcactttttattaggttgtttgttttcatattgttgagttctgagagttcatatatttatatattctggataaaatttttgtcgaatgtgtgatctgtggccaggtgtggtggctcatgcctataatcccagcactttgggaggctgaggtgggcagatcactcgaggccaggagtttgagaccaggcctggcctacatgtagctgggactacagatgtgtgctgccgtacttggctaatttttatactttttgtagagacagggtctccctgtgtacccaggctggtctcaaactcctgggctcaagtgatccacccacctcagcttcccgaagtgttgggattacaggcatgagccacccttccctgcctcaacttttaatatatggttgaatttgcctggaagtttttttttgttttgttttgtttttggaagatttaattaattaattgatttatttttgagacagagtctcactctgtcccccaggctggcgtgcagtgatacgatctcggctcactacaacctctgcctccccagttcaagtgattctcccacacccggcccagaaaatttaacaattaattcaatttatttaatagttgtaggactataccagctatctatttcatcgtggggagttttagtagtttgtggctttctagggaaatgaaaattggtacattttatcaaagtagtcaaatttttgttcatgaagttgtttatagtatttcccagtagtctgtaaggtctgtagtgctttccttcttttacttctgataatggcaacttttgtctactttcttctttgtttgggtagaggttttatgaattttattgatcttcccaaagaactagcatttggttttattttattgtttatctattttcagtttagttgttcctctttatcattataatttccttccttttgcttacttggggtttaatatgttcttctagtttcttaagatggaaccttagggctgggcgcagtggcccagtaatcccagcactttgggaggccgaggtgggtggatcacctgaggtcaggagttcgagaccagcctggccaacatggtgaaatcgtgtctccaccaaaaatataaaaaattagctgggcgtggtagtgcacacctgtaatcccagctgcttgggaggctgaggcatgagaatcgtttgaacccaggaggtggaggttgcagtgagccgagatcacaccactgcactccagcctgggcaacacagtgtgactccatctcaaaaaagatggaatctggctgggcgcagtggctcaacgcctgtaatcccagcactttgggaggccaaggcaggcggatcacgaggtcgggagattgagaccatcctgcctaacacggtgaaaccccgtctccactaaaaatacaaaaaattagctgggtgtgatgtcgggcgcctgtagtcccagctactcgggaggctgaggcaggacaatagcgtgaacccaggaggcggagcttgcagtgagctgagatcacgccaccgcactccagcctgggcaacagagcgagactccgtcttgagaaaaaaaaaaatggaatctttagattgtgtatttgaatcttttttcttttctgacataagcacttaatgctataaattctcatttcagaacggctttagctgcacctggcagattgacgtgctgcgttttcatttacattccattcagagtgttctctgatttcctttgagacttcctttgatccataggtttttgttttttagtttcccaagcatcccaagaggatttccccgccatctttctgtgatagattgctagtctaacgccattttggtcagagaacgtattctttgtatgatatcagctcttttgtatttgtgaaggatttgtggtgtgacccagcctatggtctatcttggttcatatcacctctcttagtctctctcctctgtctttcttcctcttgcattgtgttgagtaagagagagtctgtgggaatccgggcagccccagtggagtggggtggaaccaggacgagggtccctgctggaggagcgccccctcaggccaggcccttccgcgtttctgccaagtcctaggagactctgacttaatgcctgacttattttgtgatatactgagttatgagaatgactttaaagctcacaggtggcctcagagtgcaccttgtgctcacaaacactgacgggcgacagtggacagtctgactgcagctcggggaatgagttgaaggactctgacagagatgtctgtagtaggcaggcttgtcacactcattgtttaagctccatgcctgtttacctaaaaagctggacttaaatacatcgaacttggaactcagaaaaataaaacatcttctgacctgggtaggtccgtcttccagtgttggaaagcagactcatttccgggttagtcctgtgctgctttttgacctacactgacccgatcttgtttggaacaggccgccctgtgcatgatttggtcccatgcagaatcacacagcccggttggtgactttgatggctgtcaggcactgctcgcgtctgcagccctgtctgcagagagcaccccgtggccctgcatgcacggctcccccacccccgcccacacaacatcccccccaccgcctgcacggctcccccacccacacccgcacaacttcccccccaccccctgcacagttcccccactcccacgcgcacgacttccccccctaccccctgcacggctcccccacccccacccgcacggcatcacccccaccgcctgcacggctcccccacccccacccgcacggcatcacccccaccgcctgcacggctcccccacccccacccgcacaacttcccccccaccccctgcacggctcccccacccccacccccacgcgcatgactttccccccaccccctgcacggctcccccactcccacgcgcatgacttcccccccaccccctgcacggctcccccactcccacgcgcatgacttcccccccaccccctgcacggctcccccacccccacccccacccgcacggcatcaccccctaccccctgcacggctcccccacccccacctgcacagcatccccccaccactgcatggctcccccacctctgcccacacagcttccctacccccgcctgcacggctcccccactgcctgttgtccgctgtccccgttgcacctcccacctgctgccctgctgtcaagtcaggcgcgtcccacccagagtgctctggtgtctgccccttggcttctctcagcagctcagtggagtgtagacagtgtagtagatcatcacctgagcagccaggatgggagtggggtctctgtggtctccattttacaaatgggttgacaggtgctcaggaagccctgtgatgtcctgaggccgcccaggcagtcatacacaggctgtacccatccagtgctcccgttgcctgggggcagggatgtgtgctggaagggcctgggactgccttcccaccgccatgtccacacccaatgcccaggggtggagacggaagcacgtggcggccactgtggcactggtgggtggctgcgttccatggcctgactgtgtctggcgcctgttctggtgttttacattcatactttgagggccaagcaccagcccaggaggtgggtgccacaagtccagacttccccaagggaaagtgtccccagcacagactcagccactcagaacttgttggtcttagagcctgaagccgggcagggcagacagtgccatccctatctggatggtggtgccttcacccttctgctgtcctgagcaagaagaaaaatgagccaagcttcaaagagagctgtgccaaagtttccggaaagcttgccagtgtgggtgttgcaccccacacaccttcaggcatgggtgggtggtgtgggcatcttcactggatggatttggagccctggcgcgtgtacggcagatgccccggggagatggcatgttcacacggggcagcactaggcagagtggagggtagggtctacacccctccactcctcagcaacagagccctggacactgggtgtgtccttcagactgtccctggcgtctccagcactcctgtggcctcaggacggaatgatggaggtgaaatgaacagaaggaaggttgggggaaagcgtatcccagctatgggcagggggtcctggggtgggcaggatttggggcggctgggcctggggctggatagggccgcgggagaggggaggcctgtgctctcacagctgggagctggctcaggactctcagatcttctctttgtggcctgtcatccctcctacctgcctgtccacaggcccacactgagtgagttccatgggagggaggctcaccctcaggggccttcaggagatgggacctctggcccggcagccaacggatgctgaggggtgcccaccatgtgcagggacagctggggtgatgtcttggagccctgtgaggtcctggggccgcccaggcagtcacaccccgccctgcaccccagggtgcaggctcccggggtgacacagtgctgggacggcacagggccgcgtcctgaggagagggcggagccccgaggctgagctgtgccttgcctcacaggttgtgcagcctgactctgaagaagctggtggtcttcaaggagctggagaaggagctgatctccgtggtgatcgctgtcaagatgcaggtgaggccgcttgtgaccccggctgtggctgggtgctgtgtaggctttccatgtgcctgggagacgagtcaggcggtgcgctactgtggggccttgtgccaaaacagcgggcagcccatgccatctccgggagcccggggggctgggaatgacaggatgctcctgggtccagtcctgtcccgcacaagggaggcaggcccggccttctgggatgtggaggtcacatgcatggggccttcccagggcagagctgccctcgagtcacctcacagtgatggacgggccccaagcacctggagccagggcttccctgctgcactcagcacccacttcctgcccactttttgtggggtggagggcgtcggtgggagaggggagcagggcactctgggaggcgagggcctagccagaactcccagcccctggtgccagggcctctctcctgaccctagtgggtcctgtgacctctcgaaggctttgaacaagtagcggttccagaggggtcatgctggtgtcttccccatgcctggcccaggccccgccccctccttggggtagagctgccatgacccttgcagcatggcctttgcccagtggcccagacagggaggtgtccccgccaactgtcagggccacccctgccctttcagggtcatacggttccaggtgtgtggcctgtatagggccaccgccagcgggctctccctagccggcaccactcatgggcaagtctcacccatgtcctcagcatacaggagtgtccttctgtgtggccgtccagcgtgacagggtggggtctcagtggctgttgtgctcctgaccccagcccatcagctcctcgaggatggggccctgcccttggagcccatgtccaaggccccacacaggtccctgcagctggccggattcttgacacctgctgtggctctgacacggggtctccgggtctccccgacctgcagagtagcacctgagcctcggccagtgtggctgaggtcaccagccaagcactgggtcttgagtgcgaggaggcctgaggcttgttgtctgtcccagtcaattgccactatgtgaaacctactgcatcttaaataaacgtctggagaaacccttttcctcgctgaacatgctcgtggattagcagcagcctacatctgcggcgtgtgctggtggccaggttccccgggtggtggggccttgccccaggaacttccaggagcgtgtggctaatagcaggaccccaagaacttccaggagtgcgtggctaatgcaggacccggagaacttccaggagagcgtggctaatagcaggaccccgagaacttccaggagagcgtggctaatgcaggaccccgagaacttccaggagagcgtggctaatagcaggaccccgagaacttccgggagcgcgtggctaatagcaggaccccgagaacttccgggagcgcgtggctaatagcaggaccccaagaacttccaggagtgcgtggctgatagcaggatggaagcgtctctccgcctgtcctgcccatgggtgtggccatgcccagggtgcccagtacctgctgcagtctggctgcgggtcgtccctggggaacagggagctctctgtgggccattgccaccaggccgtgaggctgtgtctggacctcttggcttggggggcaggggtcagggtctcattgggtcttcagagcaatgcagaaaggcatgaaggcaagagtcgacccctcactgacttctgagtctggtgctgttgacctctaacctctggcatggggccccaccccacactgaccctgttccttggccccattccttcctctgcctgtctctggtcctgccccagcctgtgtcttgaccgagagcttggccccagggcccctcagagccccacctctccagcccctctgtgtagcgcatggactggctgcccatgccctccctgcccaccccagctcagcagccacgtggcccttggcctcccttgatcaccccagctcctcatctgcttctcttggggtgtcctctccgcccaggccccctgtgggggaagcagccagcctggccccgcagccccacctgcccctcagccttctctggcgtgcaccttcgcctcactggctggtggcacacactgtccttttcccgacacagctgggtccctgcaggtcctctgaggggggaatgctaagagggacccgacgcagagcacatttgcagggaaacatctctgaagggtcaaggggaggagcagggagagtccagaccacaacgcaggggcagctggggagaggagaggggacaggagggctggccgaggagagccgcgctgcctcttgccacgctgcacgtgaggccccagcacaaggggaggaccagagtccgccatggacgtctcatggagcccgagtacggccatgcgggccgcccgcacctgtcctgaggccccgctgctcccacccgaacctgggctggccccgggctcccgttgtctgtcctggacccccgcccgccctccagccacctggcacctctcatccactgtgtcccgcgcgccggcctccgggaaccttgtgcctgggaccccgcagcggctgcttgtttctcggggcacgaggtccccaagctcatccttgttgggatggtcccatttaaaacagcactgcgataagcacgttcaatccattaggaatctattttgatataaagtttgcggttggggtcctgttgtctttcacgcaaatgactcgttatccatttagcaggtgcgtgtgatgtctcctgctggcctgaagctcactgggtatgaactgtgttttcaggtgctcatgcatttcctgcacctacatctaggcttctactaccctcatttttgtgacagcatctccgtattttaagtattgtatctctgtatgttttactttctgagaggaccagtcaggcctgatcattcttctttttagaaaatgctttaggccaggtgcagtggctcatgcctaatcccagcactgtgggaggccgaggagggtggattgcttgaactcaggagttggagaccagtctgggcaacatgactaatccttgtctcttaacaaaatacaaaaattattgtatatttttttgtggtggtacatgcctgtagtcccaggtgctagggaggctgaggctggaggattgcctgagcctaggaggtcaaggctgtagtgagttgagatcgagccactgccccacagcctgggtgacagagaccctgtctcaaaaaataaaaacaaaaaataaaaaaatgctttaagccaagcatggaggcacatgcctgtaaggctgagctacttaggaggctgaggcaggaggattgcttgagcccgggagctcaagtccagcctgagcaacacagcgagacctgtctctcaaaaccaaaaccagaagaggcttggtgcctccagatttgttctgccagacagacttgggcagcgcagtcaggtgctgctgcacctggccgtggaatctgttttgtgatcgcgttaacttcagcaggagccgctcctggtttctctctcatgtcttagggcagattcctggaggtggaacctgtgggccgaagggtctccatgtttttaaggttcttgggaaagatgccagggcacctctgagaattaccccagcctgtgcctaccacccccagactgcagggctgcaatcctgccagttttagagtgcaggagtcacggtgtctttgcctggtttcctgctgatatgcagtcctttgagctagaacaggtcttgcttaatcacagggctccaaacgaatcctgcggtcccatgagattgtgctgccccccagtggacaagtggagacagacctggccctgaccttctccttgcaggtgagtctttcaccagtggtgacgacaccctcatcactgtcccctggggagacgggcccccctcatcactgtcccctggggagacgggcccccctcatcactgtcccctggggtgatgggcccccctcatcagtgtcccctggggagacgggcacgcctcatcaccgtcccctggggagacgggcacccctcatcaccgtcccctggggcgacgggccccgtcatccctgtcccctggggtgacgggcccccccatcactatcccctggggtgacgggcacccccatcactgtaccctggggagacaggccctccccatcactgttccctggggagacgggcccccccatcactgtcccctggggagacgggcccccccatcagtgtcccctggggagacgggcacgcctcatcactgtcccctggggtgacgggccccctcatcactgtcccctggggagatgggcccccctcatcagtgtcccctggggagacgggcacccctcatcactgtcccctggggtgacgggccccctcatcactgtcccctggggagacgggcacccccatcactgtcccctggggagacgggcacccccatcactgtcccctggggtgacaggccccccccatcactgtcccctggggtgacgggcaccccctcatcactgtcccctggggagacgggcacccccatcactgtcccctggggtgacgggcccccccaatcactgtcccctggggtgatgggcaccccctcatcactgtcccctggggagacgggcacccccatcgctgtcccctggggtgacgggcccccccatcactgtcccctggggtgatgggccccctcgtcactgtcccctggggagacgggcgccctcatcactgtcccctggggtgatggccccccctcatcactgtcccctggggtgacggccccccctcatcactgtcccctggggtgatgggccccctcatcactgtcccctggggtgagagcatttgtctcatcattgccatcagtgtcctgcgttactgcagatcttctgttgattatggtttattcttaaatgattagaagatttgtatttgtttattaggttgagtttttctttgttttttctttgttttttgtttgtttgtttgtttttgagatggagtctctccttgtcacccaggctggtgcagtcttggctcactgcaacctccacctcccgagttcaagcgattctcctgcttcagcctcccgagcagctgggattacaggcatgtgccaccacgcccggctatttttcgtatctttagttgagacggggtttcaccatgtcggccaggctggtctcgaactcctgactgcatgatctgcctgcctcggcctctcaaagtgctgggattacaggcgtgggacaccatgcccagcctagtttttcattccttatctatgataaagagaatataaggccgggtgtggtggctcatgcctgtaatcccagcacttcgggaggccgaggtaggtggcaggagaatcgcttgaacccgggaggtggaggttggttgcagtgagctgagatcatgccatagcactccagcctgggggacagagtgagactccatctcaaaaaaaagagagaatataataacgagggcaaaaaaacacttactgagtcaaggctattttgctcttctatttaaaaagataggggaaactcagagttcacaagcaatcccagctcttcgggaggctgaggcaggaggattgcttgaacccaggaggtggaggtgacagtgagcccggctaatttttgtatttttgtagagatggggttttgccatgttggctagggtggtctcgaactccctacctcaggtgatccgcccagcttggcctcccaaagtgccgggattacaggtgtgagccaccgcgcctggcccaatgctccatggttcagtgggttttgataggcatgctcaggcatgtcagcaccaccgcagttagggtggtgaacagccccattttcccctaagtatttaaactgatttttatttgtgaactctgagtgtctaagagatacctgtgaacatcagcttgctggagccctgctggacagggagcctgtggtgagacgtgcaggcgagttgggtgaacagggggcctcggagggagagccctccccgccctgtgtgcccctcgcggaaaagcgtcctgggtcccaccttgctgattgcctcaggcacatgagccgccacactgtttccgagtgtccacaggcgcgctcggccatcccggacactgcagcacatagtccttgtccacctgccatggctgttagcgtggcgcggagccctcagggcctgagctctggcgactggctcactcttgattgtgttgggtaaaggatgggctctggggaccggcatgccactgggatgaacttgggggcccgtctgtgggtgcccttccgatctcatgggcagcaggttggcctggtcgcaggctgcagggtggctgggccgtcagaggccgtgatgctgcctggggccccggtgcaccctcagctgccactcgcacttgtgcccacagtatcctcacttcttgaagagggaaggcaacaagcttcagatcatgctgcagcgcagaaagcgctacaagaacagaaccatcctgggctacaagacgctggccgcgggctccatcagcatggctgaggtgagtgctccgtctggcgtggcctgcgtcgggctggccacctgggtgccagagcattcgcccgtgggagatggagatgtctctcccgggtccagatgtccagggatcaggtgaaaatgatgagaggagcctgggcggccgggctccgccataagggccaggtgcggccccaggtggtgcttcctctctgaccttcccttgccgcctagcatggctccccgcatgcctgcagccgcgcgcactcccctctaacgagcctgtcctgcccttcagtggaggctgggttttgggtcaggctgctctggagtccttcccatggaggaatcgctgctgtccccacaccacgggtgcgtcctgtgatgggttcgtgtctgcatcctgctcagcacgtgctctggcccaggattggctgagcaggagcaggacaggtgtcagttctgtgaaggggctagcgacaatacccgagcagggcgggggcagcacccagaggtcagaggggtggctggagttccctggaggggaaagaaggggaagtacctcaaaaggaaaagaaacagccaagcagcagcccaccttgctccagagaacccagcgttccaaggaggctgcagtagggcgtgggggcctgggagaagacaccccaggctgaggcctcggactttctcatggaccctttcggggctgcaagattggctctgggagaaggggcagcccagggccccagaccagtttgtctcttttgcttcagaactttccccatcgtggggttgtgttcaggggtccaggggctgcgggcgtgagtggtgcttggggcatgtgaagctgggttgctgcctgcctggggcctgggaaggtcagccagcgcagcccctcattgggagccggagatgccagagccccccagcccctcttcttcccactttgtccccctgctcctggggcttggggctgggacagtgggggtgcccacttgtagctggttcccccacacccccaggcccagcctgcaggcctcctgtctcccaggtcaagcgctaggtcccccagatcctcacacacccccacttacgcatccaggacaagtgccaagtactactctgggctcagccctccctgctaccccaggagatgggagcgtggagggtacaggaagcagcagtggcgtcccgaggcctcgcttctccgtgccgccgcagggcctcagacaagctttgcagtcttcccgattccttcggcaaaccacggacagcacgggtggaccgggcctccaggctgcacttcccagggccctgggacccctctggtggcctggagctgcccatcatcccagcctccctcctgcaggctgagcgatgggtgaacaggtagctcagggatgctctctgggctgtgagagcctcctgggagccaccgcttgcttcctgtggagcaggagggtccaggcactgtggggaggtcatgcaggctctgtttcccattagccatgcaggcgaggtcctgctgatccctgccggtccctgtgtttcccattagccatgcaggcgaggtcctgctgatccctgccggtccctgtgtttcccattagccatgcaggcgaggtcctgctgatccctgccggtccctgtgtttcccattagccatgcaggcgatgtcctgctgatccctgccggtccctgtgtttcccattagccattcaggcgatgtcctgctgatccctgctggtccctgtgtttcccattagccatgcaggcgatgtcctgctgatccctgccggtccctgtgtttcccattagccatgcaggcgatgtcctgctgatccctgctggtccctgtgtagccatgcaggtgatgtcctgctgatccctgccggtccctgtgagctcctgccccaggctgctccgcccacatctctcagtctgcaccccagtgccccaggcggctcctcccagcccctctcagcactggtgcttctgtgtttgacgtccttgccctgaatgctggcctctgctcccaggcccctccctcacctgtcctcccagccttgggctgtcccctcctgatccccggggagaggctggagcaaccttcccccaccccaggtcacaccagccacatcgtctgctgcttgaaatcccatcatctgttcttcactcttggcagaaaagccccacccctggatgtagttccagtgccctgcccctgagcctgtggcccccaccccaaggctccctcgccctgcacctgtggcttccaaagccgaggtcatctgactgctcctcgctctcccctccagcatctcctccaggccctcggggcatccttccaccttccactggcagcctggtcccagaacctagttgggtcctcccatgtgtccccgagcaccagggcggttcatgggctccctgtgtcctgccaccttttggggctggttcccacctgtgagcgttgctggcttgttgagagtatgagcacgggagattgcggaggcgggacagccccgagggcacagacggacacaggtggcagaggtggggggctctcaccagctgggctcaggcagctgtgccatgggggcttgctggctccgagactgcacgcctgagacgggggtgagggcatgggtgctgccatagggactgtcgtgagagtggggtgtcggtgaggctggcgccatgcatttgagagtagtgctcggcggtggggaagggtccttgagggcacagggtggggtgaggcgggctgttgggcggactcgaggccagggctgagagtgtggtgggagaggatgtggggggcacctgcccaggacctccaggctgtggggagaccaggaggcgatggctgtggggacacaggtgtcatctcccttcaaatgggtgcacacgcagggggcaggaggggctgggagcagcctgggcccctgccacaccatagctctgccctcacctggcactcattctgtgtgagctgaggcccagagccctggacttactctgaggctgaggaagtggagtccaaggtggcccagggtaggggccgggcctcatgggtgccaggagctggacgccggcgtggggtggcttaggtctgcaggctgaccagcagttctggctgggaccatcaggagtgaccgcagccccagggcctgctgggcacgcgcctctgcctgccacttctcaggaagcttgagctgactgcaggtggtccctctcagaggcagctccgcagaggcaggtgtgcggtgggggcagacgtggggccttctcctgtggtgtggctctcagaactcaccccagcacccgtagagggagtgtgtaggggtgggcgttcgtgtggccagaccaccctggggctgcagcctgggagacgcaggcatgccagctggtggccattgtctgaggctggggcctgtgggctccccgacaagacaggaaggttgacagacccatgaccaggcgaaggggtgacctgggagtgcggtggtggctgagggagcagccatgcttctttgcacagccggactcctcttgtggcctcgccacaagctgcacatgccactggggccaggtccagcccaaggggacctgtgaggggcgggcggctcatggtgggacacaggaagacctcagggtaaggacagcgcgggagcgtcaccctgaccgtttgcatgctggattccctttagtttctctctatgagtgtctgcacagccacaggctgctgatgacagcccagtcaggtgtgggctgcatatcaatgggtggccccgtgagaatatgatggcactggacacttcctatctcctgatgacatggtagccatcgtaacaccatagcacagttactttattcctgtgtgaactcagtgtggcccaggtgtccagggcctggtcacacacacgtccatccctacacggcggtgcatggcgacctcccaggccttcgcatccacacacacgtccacccctacgcggcggtgcgtggtgacctcccaggccttcgcattactcactcacccaccagcttgtccagagccacctccagccccgcaggctctgccatcgtcagtgccctattcacaggcaccacttaatgtcttttatactttatttttactgtgcttttttttttttgctttttatttttaaatttttttcgtgatgtggtttcacttttatagtgcagtggcgcgatctcagttcactgcaacctccacctcccgggttcaagtgattctccttcctccgcctcccgagtggttgggattacaggtgctcatcaccacacccaactaatttttttatttttagtggagacagggtttcaccctgttgtccaggctggtcttgaactcctgacctcaagtgatctgtctatctgggcctcccaaagtgttggtatttctttcttttttttttttttttttttttgagacagaatctcgctctgtcgcccaggctggagtgcagtgccgcaatctcagctcactgcaacctccacctcccaggttcacgccattctcctgcctcagcctcccgagtagctgggactacaggcgcccgccactacgcctggctaattttctgtatttttagtagagacggggtttcaccgtgttagccaagatggtctcgatctcctgacctcgcgatccgcccaccttggtctcccaaagtgctgggattacaggcgtgagccactgtacccggccaagtgttggtatttcaagcatgagccaccgtgcccagcctactttttctgtgtttaaatgtgtttagacacataaatacttaccatctgtaacaattgcctacagtattcagtacagtaacatgctttacaggtctgtggcctaggagcaggaggctgtctctcatataggctgaccttgaagatattgtgtgttcagttctaggccaccccaataaaaacggatattgaaataaagtgagtcacacaaatttcgtggtttttcagtgcatataaaagttatgtttacactgtactgtagtctgttaagtgtgcaatagcattacgtcaaaaaatatatacatacattaattttaaaatattgctaaagctgggtgcggtggctcatgcctgtaatcccagcactttgggaggccaaggcgggcgtatcacctgaggtcaggtgttcgaaaccagcctggccaatatggtgaaatgtcgtctctactaaaaatacaaaaaaaaattagccgggcgtcgtggctcacacctgtaatcccagctactagggaggggaggcaggagaatcactttaacccgggaggcggaggttgcagtgagccgagatcacgccactgcattctagcctgggtgacagagtaagacttcctctcaaaaaaaaaaaaaaaagaaaagaaaaagctaacaatcatctgagccttcggggagttgtaaccctttggctggtgggggtccttagtgtgggtgggtgctgaccggtcagagtgttggttgctgaaggctagggtgcctgtggcaatttcttaaataaaacaagaaagaagtttcctgcatacttgactcttcttttcgcagaatagttccctgtcgcatgcggtgctgtttggtaccatgttacccaccattatttcagaattggggtcagtcctctcaaaccccgttgctgcgttactaaccgagacggtggactctcccaagtcctgtgttgtcactccgcagtgttcacagcatcctcaccaggagcagattccatcttaagaaaccactttcgttgctcatccatgagaagccacttcttatcagctgaagtttcttcatgagactgcagcaattcagtcagtcctcaggctctgcttctaatcccagtcctcttgctatttccaccacatgtgcacttccttcctgcactgaagccttgagccctcaaagtcatccacgagagagttggaatccacttctcccaaattcctgtcaatgctgatatctcaactttttcccatgaatcacagatgttcttcatggcatcaagaatggtgaatccaggccacgcgcagtggctcacacctgtcatcccagcactttgggaggccaaggtgggcggatcatttgaggtcaggagttctaaaccagcctggccaatatggtgaaacgctgtctctgctaaaaatacaaaaaaagaaaaaaaggctgggcacggtggctcacacctgtaatcccagcactttggcaggccagggcgggtggattacctgaggtcaggagtttgagaccagcctggccaacatggtgaaaccttgtctctactaaaagtacaacaattagccaggtgtggtagaggacacctgtaattccagctactcagtaggctgagacagaagaatcggttgaacctgggaggcggaggttgcagtgagctgagattgcaccagtgcattccagcctgggtgacaagagtgagactccgtctcaaaacaaacaaacaaacaaaaaaattagtgggccgggtgcaatggctcacgccggtaatcccagcactttgggaggccaaggcgggcaggtcacctgaggtcgggagctcgagaccagcctgaccaacatggagaaaccccgtctctactaaaaatacaaaattagctgggtgtggtggcacatgcctgtaattccagctactcaggaggctgaggcaggagaatcgcttgaacccaggaggcggaaattgcaatgagccaagatcacgacattgcactccagcctgggcgccaagagtgagacttcatctcaaacaaacaaacaaaaaaaacgaattagtggagtgtggtggcaggcacctaaagtcccagctactcgggaggctgaggcaggagaattgcttgaacctgggaagtggaggttgtagtgagcgagatcgcaccattgcactccagcctgggcaacaagagttagaatctgtctcaaaaaaaaagaatgggccaggtgtggtggctcacgcctgtcatcccagcactttgggaggccacggtgggcggatcacgaggtcaggagatcaagaccatcctggctaacacagtgaaacaccgtctctactgaaaatataaaaaattagctgggcgtggtggcgggcgcctgtagtcccagctactcgggaggctgaggcaggagaatggtgtgaacctggaggtggagcttgcagtgagccgagatcgcgccactgcactccagcctgggcgacagagcgagactccgtctcaaaaaaaaaaaaaagaaaagaaaaaaaaagaatggtgagtcatttccagggggtttccaatttaccttgcccagatccatcagaggaatcactgtctatggcagctatagccttatgaatgaaatacattttttttaaataataagacttgaggccaggcgcagtggctcacacctgtaatcccagcactttgggaggtcaaggcaggtggatcatctgaggtcaggagttcaagaccagcctgaccaacatgttgaaatgccatctctgctaaaaatataaaaattagccaggcgtggtggcgggcccctgtaatcccagctactcaggaggctgaggcaggagaatcgcttgaacctgggaggcagaggttgtagtgagccaagatcgcgtcattgcactccagcctgggcaacagagcgaaactccaactcaaataataataagacttgaaagttgaaatgactccttgatgcatgggctgcctgatggatgtcgtgtgagcagccatgaaaacaacattcgtctcctgcgagtctccagcagagctcttgggtgaccaggtcatgtcaatgagcagtcatattttgaaaggaaccttttttttcccaagcaataggtctcatagtgggcttaaaacattcagccaattgtgctgtaaacagatgtgctgtcatccaggctttgttgttccattttcagaacacagacagtcgactttgcataattcttaagggccctaggatttcaggaatggtaaatgagcactggcttcaacttaaagtcaccagctgccttcactcctaacaagagaggcagcctgtcctttgaagctttgaggccaggcatcgacttctcctctctagctatgaaagtcctagatggcatcttcttccaatggaaggctgtgtcttctacgttgaaaatctgttgtttagtgttagccaccttcgtcaagatctgaactagaccttctagagaactcgctgcagcttctccgtcagcacttgccgcttcaccttgcatttctgttatggagacggctgctttactaaaacctcatgaaccaacttctgccagctccaaacttcttctgcagcctcctcgcctctctcagccttcacagaggtgaagggagtcagggccttgctccggatgaggctttggcttaaaggagtgttgtctggttcaatcttcatcccggccactcactctctccacaccgtcactgaggctgctctgctgattctccttcctgtgttcgctggagcagcgattttcctttccctcaggagctttctctttgcattcactgcttggtgatttagtataaggggcctcgccctcaccctgtctcggctctgacgtgccttcttcactaaactcagtcatttctaggttctcattgaaagagatgtgcaacccctcctttcacttgaacacttaggggcccgtagagttagtaattggcctaatttccatattattgtgtctcggaagagagaggccacaggagagacagacatgggaatggccggtgggctgagcagtcagacgcacacacctactgattaagttcactgtcttacatgggtgatgttcgtggtgccccagagcagttgtgatagtcacaccgtagctcactgatcacagatcaccatacagatataataatagtgaagaagtttgaaatattgggagaattaccaaaatgtgacacagacaccaagtgaacacgtgctgttggaaaagtggcgctgatagacttgcttgatgcagggttgccaaaagccttcactgtaaaaaacagaagatcagcaaagtgcagcagagcagagtgagggctgcagcccgggtgcgcggtgggcggcggcctgcgggtgtggtgggcgtcccgggtgcgcggtgggcggcggcccgggggtgtggtgggcggtgtcccgggtgcacggtgggcgtcccgggtgcgcggtgggcggtgtcccgggtgcgcggtgggcggtgtcccgggtgcgcggtgggcggcgtcccgggtgcgcggtgggcggcgtcccgggtgcgcggtgggtggcggcccgggtgcgcggtgggcggtggcctgggtgcgcggtgggcggcaccatccaggcttgctgcgatgttggcaagaggacgaggtctcctcaccatgcatgtctcagaacatacctctgtcgttacgtggtgcatgactgtttttgtaaaatttttattgtagtatttgtacaattaagtgtgacatcctgagcaattttcttttctttttttttttttttttttgagacggggtcttactttgccacccaggctggagtgcagtggtgtgatcttggctcactgcagcctcaagcccctgggcccaagcagtcctcccacctcagtcctcaagtagctgggactacaggtgcgcaccaccatgcccagctaattttttatactttttgtagagataagagtttcgccatgttgcccaggctggtctcaaactcctgagctcaagccatccacctgcctcaacctcccaaagtgttaggattacaggcgtgaaccattatgcccggcctcaattttcctagtcactaaaatctatttgaaaatggaagagggaggagcctgtcagggtcaggggtggagggagctgggccctggggccaccctccctggtgaggcagctccagccctttgctgaggattgcagagcatccacagagcatctgctggactaacccgggagggtggtctcagggtcagcaggggcaggagtgggaatggccacagtccaggacagtgacctgccggccagcatcaccccaggggagtgcccagctcaggggtggctggccccttggcaggaggacgcacgccccaaggagcactgtcaggaggagaggaacatgcagcctggagtgtcggggcctgggacttccagggcctgcagatatcaaaatagtgttcacatataggtcgaccacaggctgagtggagcgggggctaatcaacaacccgcccctggcccgctgcgggcccagcagagcattcccactacagccagctccagggatcccggcaaaagcatctttgataagaggccccattccttcctgccctcccacctgaaggaggaagcgagcagggttttcttaggagaaaaagggcccagacccctctgagccccgtggaggttggtatgagcaggtgcagcaccacctgagccccaccttgattcctccgggaccccagcccggcagccccctcccctctgagctcattttactgggatccccagcaagggctcagcatttctgaccgagggcttctgagcttccaggttctcacccctgtgtgacactgagaccctgccacatcagatgccactctgagaaggcgactcagggtgctgggggcctggacaacagcagcctccaagtacgtgaagctgcgtgtgccccggcgagttgtgggcacgagggcgtcagcagtgggtgcgagtgttggcagaagctgccagctgcccttcgtcattttctgaaatgaagatgagggcaaatgtaaacttttaaacatttttttaccttgattaattgaagaattagcagcccaaatcaggaccccacaatcaaaataaatctggtcggctgggcgtggtggctcacgcctgtaatcccagcactttgggaggccgaggcaggcagatcatttgaggtcaggagtttgagaccatcctggccaacatggtgaaactgtttctactaaaaatacaaaacttagctgggcgtgctggcagatgcctgtaatcccaggtacttgggaagctgaggcaggagaatcacttgaacccaggaggcggaggttgcagtgagccaagatcgcaccattgcacaccagcctgggccacagaatgagactccgtctcaaaaaagtaataaataaataaatctggtctataaaatcctaacatctggatgtgaaccgatagccccaaaaggcggcttctagagcacagctggccccaaggctgtgagtgtctgagagttgtcgtcatggcgtgtggttctgaggctggcgtggggcacggcggggctgtgcctgggtacaggtcgtggctgcaggaggggccggggcttgttctgcagctccgtggtttgagtgcctcacaacagaggagctggacctggcctgtgagccaggcctggtgggtgtctcctgctgctggagattccggcctggctgagagtgctgggctcctccttggtcccccacagacactggtccctgggcattggctcctgtgggttgggcagccggcttcacacactgctttgctgctgctgagctcttgggtgggtggagggtggaggcagggttggagcagggggccaggatcttcctgggtggcactgcatggacagcagtcgtgcctgagatcaggagggccgcggacacccctgtctgtccatctcagtccctcgtgactgtgcctggcactggcctctccagcacagcccagtgccctctgcttatggcccgttcgtgaaagctcccacgtgttcctctcgtctgtccgcctggctcctgtgtcctcctctcgtatctgtcccctctccccagtggccacgtttcctgtccactggatgctccctgccctgtggctgccctgctgagggtcccccttgctgtcactgagagagaaagcccttcagaaaccccagcccacacatcagggcaccggggctccttcccgtcgtgctgctttctagaaccgtgcccctggcctgcaggtgatgcaacacccgtctgaaggtggccaggtgctgagcctctgcagcagcatcaaggaggcccccgtcaaggcggccgagatctggatcgcctccctgtccagccagcccattgaccacgaagacagcaccatgcaggccggccccaaggccaagtccacgggtgagtgtggtgccagcccgctcctgcccctgctgtggggaggccctgccttccagccatggcacatcgggtggcagaaactgtccagcctggcttaaggagttgggggtccggagcacgtgtcagttgctctcctgtctggaagccacagcagaggtgcgcgctgttgtagggtccgggctgccacaggtccctgttctgcccccgtggctgcagctccttggtcaagaggcctgagtcctgagtgtcctcaaaaaggaggtgtggggtcgcactgtgatgcccttgctggtctgggtgcagggcccgccatgggcaggtgccacagctgccgccaccccagtggggtcaccagggcctcccctactcctcaggcgggggagacccagtcggtgcaaatccaggctgaaatgccagctggcaggaggggccgtggaggccggagcagttcatgtggccccctttgccctccctgcccctccccacttcctgccaaccccgacctggaccgttgccagtggacttgggggactcgggggctcggggccacggcacctgtgtctggagcccctctgtcctgcatggatccacctcctcgctgcccccactctgtgtccagggaagcctgggggtggtcactgcctggtttcccgggtggaatctcacggcaccctcccttctgtctgttcattccgcagataactactccgaggaggagtatgagagcttctcctccgagcaggaggccagtgacgacgccgtgcaggggcaggtgacctggggccggggctccgcgccctctcctggctcacaccgggtgtcctggggtctgtggggtcctcaccagctgtcaccagggcctcgtgagggtgggtgagccacgggcctggcccctggttggccgcccatctctcgtctcccgaccccaggggcccgagtttatgctcaggtggctctgagagtcttgggacacaggtgggctctcagtgccgggcctctcccatcgcccacgctgaggctggcagggtcctgccagcactatgcaggctgccgtggcctcagccactgcatatgtctctgcaggacttggacgaggacgactttgacgtggggaagccgaagaagcagcggagatcgattgtaagaacgacgtccatgaccagggttggtggagactgcttctatgaatgctggggaaggcgagggtcggggaggacgctgggagcctgggcgtgggggggacacgggcgtgggaagtgagatctcaccccaggtcacagcagcatgtcccgtggcagaccccctgattgccagtctcctgccgggtgccactgtctcccctgcctcgccacatctcctggctttagccttgtgtggccgctaggctcagtgggccctgagcaaggctgggaggctgcctcgctgccaggctcactccatgtgcagaaactccgggaggccatcctcccttttgtcccgtcaggtgcccacatacacctgagtgggctggttcccccatttttgtttgggatctggcctacctacctccacggtccccaggagcttggcagggctgttcagcattttttccctgaggaaagctcaggcagctctttcctcagaggccgtgtccggcactggcacagagggtccaccgcctggcgcctggacaccccaaggacaggcacggttccagggaggccagcgcaggtgggcggggagctctgtgcctggtgctgacaagggacatgggcacagcccagcccggacaccgccgcctcctctggcagcattcaagggggcgctgtgggcagacggtgccagggacgggcaagctgctcccaaagtggtgaagctgtgtcttgctggcctggagagcagcccccgctgtgcagaacaccagcttgagcctccattccagggcccccttgggcccaactgttgtgaagggagggcgtgggctgcctttgtagggttggtccccgagagggtggctgagggtcccgctcacccagtggctggagccgaggttctgcagtccagggtggcacgaggcacccacggggctcaggctcttggagcacgccccaccccacactcgcccacctgcccaccccacgtgggtgcccagcaccttccttctggggtcggccagggcctttcctgggagggggtgctgagggaagggccccgtgagcctgggaagggctgcagaggcttctggaagaaccatggagtccgcacacgcctccccgggtcccccttggccaggaatggaactgtcagacctcaggcctgttgggaagcctctgggagccacgagcgaatccatcagcgtggctggtgctgaggccttgctgctctcccacggcgggcctgggtgcggcctgggcctgaggaaggggctccagcggcgggtctgcagctctggcggcggctctgactctgcaccgcctgtcttgcagcaacagaacttcaagcagaaagtggtagcgctgctgcggaggttcaaagtgtccgacgaggtgagtgcgccgcgccttctgctcgcggcccccacgcctgcaacagcacctggtcgggaggaggcctctggggtctgtctccgggccacctctggttctgccgctcaccgtctgcacggccccgccagcatcgcacagtctgcgaggcgcagtgacagtggcactgcctcccgggctccaggtcacccgctgggtctctgctgaagtagaagtcgtgaataccctggaagtcggaaagtcattttcagggggatgtaaccattagtttgtgtgtttttttttttataaatagactttagtttttagagcagttttaggtttacagcaaaattgagcagaaagttcagagttcccatggacccctccccacctgacagccccccactattgacatgggccccccctccccacctgacagccccccactactgacattccatggatttttaatgttcatcttttagcttttctctaatctctgaattttctacaatgagcttgtataattttcataccgaaaagaaaaacatggctgggctcagtggctcatgcctgtaatcccagcactttgggaggccaaggcaggcagatcacttgggcccaggagtttgagaccagcctgggcaacatagtgaaaccccatctctacaataaaatacaaaaattagctgtgggtggtggtgtgcacctgtagtcccagctacttgggaggaaacctagtaggccaaggctgcagtgagtggagattgagccactgcacttcagcctgggcaacagagcgagaccctgtctcaaaagaaaaaacttcaaatctcggctcactgcaacctctgcctcccaggttcaacagggtttcaccctgttggccaggctggtcttgaactcctggcctcaagtgatctgcctgcctctgcctcccaaagtggtgggattacaggcgtgagccaccgcgcccagcctttgttgtttctttaacgtcagaagaaaaacgtgcctgggttcaggacctgaagtggagaggtggcgtttaagcgtctcagccttgaagcagggttgtcacccgtcggcctgagagcacactgcctgtagatggcgctgtgtcctaacatactcgggatgcatccagctcagcccctggggcacacactcagcgaggctgtcaggtccatgtgccgaaacaggtgctttgtggcccggtggggcaggcagcatttctgggaacagcgtaacatcaccaactggccgcagaggaagggcagctccgccactgggatggtcatcgggcccctgtgtcttttggtttgcatcttggattggaacattcccaagtgcagctgaagatgggacttagccaagtcggctccctggcctggggcttccttgagccctgctgagcgcctgtgggttcaggggtgggtgttcttggttgaatcttgaccgtggggttctgcactcacctgggcaactgaactgagtcccagaatgcatttcacttacacagattatggttctgagactcacaacccaaactgtgaaaagatgggccaacgtcacagacgctgttcagggagaggacatcgttttcatagggataattgcacagcgttgtgtgaaattcatgcaggtcaacacagtactttaatggagtgatgggatctctttccgtattttccacccatcactccctttcctgaaaagaccagaccatctccgccacagctctgaacctgtgtcttggccactaggagtgccacacctggcactgccccctgcccaggacttcacagcaaccctcagggggcaggagatgcacagtgagacgaggtcaccgcctggattacagccatctgagattgttcatgctgctataacaaaatactttagactgggaaattaataaacaaccaaagtgtatttctcgcagttccggaggctgtgagtccaagatcaaggtgccagtagactcggtgtcttgagggcccgtttcccatagagggcaccttctgtgtgttgtgtggtgagagggcctgacaagctccctcaagcctccctcatcagggccctgagcctattcagcgggcagagctctcgggccctaaccacctgttagaggccccacttcctaattctagcaccttggtggtcaggtttcagtgtaggaattttgggggtacaaacgttcacagcccccaggctgaccacagagcactggcatccaggctgccctgtgcccaggtgccacacagtgggtctggtgaggaggagagcagggctctgcttgggacccatcctgtgaggaggaaccagagtgaagtctgttccttacagccctcagcttcagctcacagcgaaagcgtccgctgagggctgccttctgaatttttcattgtaaaaggtggcacacctggatagtcagttgattttcaacaagggtgccaagttcattggagaaaatatcttttcgcaaaaaaactgaggcttgacaatgcacaccatgtgcagaattcagcttgactggatcatattcctaaatgtaaaagcctaaaatttaaattacctagattctaagccttaaaaaatatgaacttaaatcctgcactaatgccactgaactgtacacctaaaaatagataaaatggtaaatattatgttttatatatttttaacacaataaaaaaagtagaaatttgctttctgaaaggtactgttaaaagaatgaaaagatggccaggtgcggtggctcacgcctgtaatcccagcactttgggaggccgaggcagtacgaggtcaggagatcgagaccatcctggctaacatggtgaaaccccatctctactaaaaatacaaaaaaattagctgggcgtggtggcaggcgactgtagtcccagctacttgggaggcagaggcaggagaatgatgtgaaaccaggaggcagagcttgcagtaagccaagatggggccactgcactccagcctgggtgacagagcgagactccgtctcaaaaaaaaaagaaaaaagccacaggttgacagaaaatatttgcaaataacatacctggtaaagatttgtatccaatagatatattaaaaactttcaaaacccaataagaaaagcaacctgatttttaaaatgagtaagactcatacagtgaaactatgaaacattttttaaagaaagaagatataaataagtggaaagatgtcatatgttcatgaattggaaaacttagtcttgttaaggtggcaataatccctaaattgatgtacaaattcaacaaattcaagtgcgtatcagattcccagctgtgtttttgtagaaattgaccagctaaaatttatgtgtaaatgccagagactcagggcagacagaacagtcttgaagaaagaagacttatacttcccaatttcaaaatgtactacaaaaccacagtagtaatcctgaccatgtggggctggcccagggacaggcatggagatcagtggaatggaggtgatagtccagaagtgaacccttccatttatgggcaagtgatggtcaacaaagatgtcaagatatccatgggggaagaatagtcttcaacaaaggtgctaggaccactggatatccacatgcaaaagaaggaattacagccagctgtggtggcacatgcctgtaaccccagcactctgggaggctgaggcaggcagattgcataagtccacatagtgaaatcgcatctctactaaaaatacaaaaaattggccgggcatggtggtatgcacctgtaatcccagctactcggaaggctgaggtgggagaatcacctgagcccaggaggtggaagctgcagtgagctgagatcatgccattgcactccacctgggcaaccagagtgagaccctgtctcaaaaaaaaaaaaggaatttggacccctacctcacaccatattcaagaattaactaaatggatcagctgggtgcggtggctcacgcctgtaatcccagcactttgggattagtggccgaggcttgaggctcaagtgacccggatcacttgaggtcaggagatcgaaaccagcctggctaacatagtgaaatcccgtctctactaaaaatacaaaaacaattagccaggcatcgtggcgggtgcctgtagtccctgctacctgggaggctgaagtggaagaaacacttgaacctgggaggcagaggttgcagtgagccaacattgcatcattgcactccagcctgggcgacacagcgagactctgtctcaaaaaaaaaaaaaaaaacttgaaatggatcaaatatctccatctgtgagctaagattataaagctcttagaagaaaatgggccaatcttatgaccttgggttaggcaggggtttcttagatgtgacatcaaaagcataagcaacaaaaggtaagtttttctggaccacagcaacattttacagttttgtgcaccaaatagtgccatcaagaaaaccgaacagtagaacagaagaatgttttttgcaaatcatatatgtgataaggggcttgaatccagaacacataaagaatgcttataactgaaaaataaagacacagacagtctagttaaaagctgaactgtccattgctttgagaacgatgcagcctcaggtgccacggagctggggcccgcccactcctgccctgactcgctgctgtccacttgtactgagaagtcgaccaggaagccgcctcgtggccacggcttttaaagacaccgggaggacacctctggagcccgtggagtgattccttgaattagaattaccctgaccagctgcaatgtaaaatccctggaggtgtgtgctggcttatgaggggcacggagaaaaacaatctcaaagtgaaagaaccagttctgatgcctgccaagtctttgagaatcactaagagaaacacaccttgtggtgaaggttctcagacacaggatcacttccagacgagaatccataagcagctcgtggacctgcctggtccatcctggattgtgaggctgattgctctgttggaattgagctgcgagccgcggttgacatcaccattgcagatgcttaagccaagtgttttaataaagtgattatcacttgtcagaaccaggcacagtggctcacacctgtaatcccagcactttgggggctgacgtgggaggatcacttgagcccaggaggtcgaggctgcagtgaactatgattgtgccactgcgctctaccctgggcaacaaagcaagaccctttctcaaagacaaagaacagtgaattgtccaattaaaaaatgggcagggggctgggtgtggtcgctcacacctgtaatcccagaactttgggaggccgaggcgggtggattacaaggtcaagagatcaagaccatcctggctaacacggtgaaaccccatctctactaaaaatacaaaaagtagccgggcgtggtgatgggcgcctgtagtcccagctactcaggaggctgaggccggagaatggcgtgaacccgggaggcggagcttgcagtgagccgagatcgtgccactgcactccagcctgggcaacagacagtgcgagactccatctcaaaaaaaaaaaaaaaaaaaaaatagggatctttctaaatagatttcttcaaagacacacaagtagccaataagtacacgatcatcatgatcattatcactggtcattagggaaatgtaaaccaaaccacaatgagacactacttgatccccactaggatggctggaacaaatgaaatgcaacagggtgaggtgtaacagcaggaacccacaccctgctgggggaatgtaaggtggtgtggcagccacaggaagcagttgccagacacccagcacccctgttcttcagtgttgacttcagggaggtgaacacacacatgcatggacccactcagacgttcacagcagcttcatctgtgatggtcataatgcccgtcagctggtgatctgttagactggggtccacccactcagtggcgcactgcagaaccatcagaggaagtgaataaaggaaagaggtttagttgactcacagttcagcatggctggggaggcctcaggaagctgccaatcatggcagaaggggaagcaggcaccttctttatggggcagcaggtcggagtgggtgcctgcaggggaaatacaagatgcttataaaaccatcagatctcttaagatgtgctcattatcatgagaacagcgtggaggaaaccacccccaggatccagttacctccacttgtcctgcccttggcacgtggggcttatggggattacaattcaaggtgagacttgggtggggacacagtggaacatgaagtgtgccacgctgggtggatgacgccctcctccccccgccaccgagagctgcaggccacatgattccttttgggtagcactcgggaaagggcagaatgtacaggaacagagtgagattcgcagggcctggggctgagggaggggacgcactagaggaaggcaaaggggagcctcctgggtgtggggagcactttctgtcttggttttggtggtggctgcacagtggcccacacccgtcagagctcacctgcctgcacccaggccctccgtgcaccctggcagcccagatgactgcaccagcccaggggaggtggaggaatgccacacgcaccggtacctggggaccgggggtcctcggtgatcatcccgagctccaagacagaagctggactacagccgtgctgagtggaggggtttggtggctgggtgcccgcctcctattgctcctgcagactctggggtctcgggcgcccccagtggggcaatgtgggctgctgcagggaactcacgcgtgcctggcacccgtgcaggtcctggactcggagcaggaccctgcggagcacatccccgaggcagaggaggacctggacctcctgtatgacaccctggacatggagcaccccagcgacagcggccccgacatggaggatgacgacagcgtcctcagcacccccaagccgaagctgcggtgagccctacagggcggggcggggaggaacagccatttcagatgccccggccactctgcgaccactctggcagacccatgtccagccctggagacggggtgggcagggccagctgcctcgaagcctgggaaggctctggtggctggaaggaggggtgtgcggctgcctggcaggcccaggctacggctgcactgagccaggcagctttcctttcataggccagggggtgcaagctctgggctggggaggaccgagaggggtcccccagggtgctggctgggctgggtgtggcaccccgttgtaggggatccgtctctgggggatgccctgggaactgcaggggacctccgttcactcaggtggggagtagagctcccatgctgggtgcccctccctgaggaggaggaggcagaggcaggtggggagggggagggcaggtgtctctgtggctggatgggaggaggggctggctggggtggcctggcctgggcaggaggagaggatgcagggcaggcagctctgtgcatgggtctgggtatggaggcctcggtcagctgggggcaggaaggcaagcacaccaggcagaaggcaggtgccagcctctgggcagctgctgaggagccagaggccccagtcagagtcaggaagcttggtagaccttttgctctcacacttttttaacctaaacaacacgaagaaggtggccttgctgcatgttggaggcgcggccccagttagccctgcagccacgcagcggcctcccacctcacctgccccggcctggcagccccagcccaacttgctgctccttcagttgccagcagccaccataacaggtgaccgcggatgtggccaccagaaacagcctctgttcctcctgttctggagattgccatcccgaggctgtggcctcattcttggccagggtctcgctgggctcgggtggaggtattggtggctgccctgactggggctccgaggtcatgcagtgcaggcccagcgtggtggttggtggagttcagctccgtgtggctgcgggatgggggtctggctgccctgccgcctggtggccgttggtcattcttgccttctggcaaccgtcctcgtaccctggcccagggtccctcctccaccttcggaaccagcaaggcccagtgaagtccccctcacactttgggcctccctggccttcctgcctcatctcttctgccttcagccggagaaagttttctgtctttaacggctcacgtgattccataggagacatctttgtggcccagatcctctcccatcttaaactccgtggtgttggctgtatctgcagagccctggccagctagcattcatagtttgaggagaggcgtgtgcgtctcggggctatgatcttgaatgggcacacacagcagcaagtttccacgtgggtttgtcacccagggtggagcagcagacactgctaagtcccgtctgtttttttagggggcgggggagttgtttgtttcttgagataaggccttgctctgtcagccaggctagagtgtagttgtgcagtcgtggctcactgcagcctcaaccacctgggcccaagcggttctcccacctcagcctcctcagtagctgagaccaatggcgtgcgccaccacacccagctaatttttatatttttgtagagacagggtctccctatgtttcccaggctggtctcgaactgagctcaagcgaaccacctgccttggccacccaaagtgctgacactacaggtgtgagccagtgcacctggcctcctgtcaaatttttttcacttgaaaggtcttttaagtcttattgaatctgtaggtctcccttcctcctttttcttcgtacatattatatcaaccagggatgagacattcggcctggatggcctggatcggccagatggtctgcaagggtctggtttgtctggaaaggcatgggtggcctggatcagcctggatcagcctgggtggtctggaaaggcatggatggcctggatctgcctgagtggtccggaaaggcatgggtggcctggatcagcctggatcagcctgggtggtccggaaaggcatggatggtctggataggcctggatggtcgggaagggcctgggtggtccggaaaggcatggatggcctggatctgcctgagtggtctggaaaggcctggatggtctggatttgcctgagtggtctggaaaggcatgggtggcctgcatcagtgtggatagtgtggaaaggcctgggtggtccggaaaggcctggatagtctggataggcctggatggtttggaaggacctggatgggcctgggtggtctgatctgcctggtgggtccggaagggcctgcttcatctgatgtgcccttgttgttttgtcgagcatgttcacctgtttgctgcaggctggctgcagatcccagggctgccctccagcaggattggccagtggagctctccccagagccccttcgtgtttgtggcagccttgcctggagctaaggctgcgagtttcaggggtgtgtgtttcctgcagctgatgtcagggcaggtggaagaaccaggacggggcagccaggttggcccagcgcttagtgttgccagctccagaatcattctgtgccctgtgctgcagctggtgcgagcggggtgtgcgctgacacgggctcttctctggacccagctctgctctgccgttggattctgcagtctgtccctccaggtgtggtgggagaactgcgctttcagtgcaagaagggtcctggaaattaacgtgtcccccacccctgttccctgagccaggccatactttgaaggcctgtcgcactcgagctcgcagacggagattgggagcatccacagcgcccgcagccacaaggagcccccaagcccggtgagtggggccacactgatctcccagagcagaccgtggtctgactgggctgtggtgtggcccaaatctcccagcatgtcctgggcccagggccctgtccagctgtcctggagccactctgcacccactgtccagcacactgccacgcaggtaccccgggcctccctgagtcccagcattcccagtccagaagtcagcgccttggcacctgcagttgagcacaagctgattcccatctcctcccccacaggctgacgtgcccgagaagacgcggtccctgggaggcaggcagccgagcgacagtgtctctgacacggtggccctcgtaagcaggcttgggccgcacccacccgttccacacatcaggcacaccaatgctgcctttaagggtctgacctggaggggcggggcccacatataggtcctcatgtcacacctggtgtgcagaggtggggtcagccctcaggggtggccaggctgccagatggtcagagtatcccaaaattcactccagcttcagggtcagggcgccctggactcaccccaccctcagggtcagggcagctggactccccccacccgcagggtccggatgccctggactccccccaccctcagggtcagggcagctggactccccccaccctcagggtcagggcagctggactcaccccaccctcagggtcagggcccctggactcaccccaccctcagggtctgggttccccagactcaccctaccttcagggtcagggcgcctggactcaccccacccgcagggtcagggcccccggactccccccaccctcaggtggatggcacccaggaacgcctggttcccccctgctgcgttgcatggggtctcctcagttaggaggtcctgggcccagggcaagtcaggtcctgggaggttgggggctggtcaccctgcatggcccggatgggagccctgtgcttggaatttggctcagctaggctccctggtcagcgtatggccgggtccacatgtaggagccacggcctagagaggcctaaaccctcacccgagccagaggccacagggctggagaggccgcagcacgggtgtggtttccacgggaggctccaggcccgtctctgctcagcagggtgtgccaggcccgagggagcaccctggacagcctgaggacagccccgaggctgaggcctccaccctggatgtgttcacggagaggctgccgcccagcgggaggatcaccaagacagagtcccttgtcatcccctccaccaggtgatgggggctgcacggcggggcggggcggtgatgcacctgtcgggggaggggccgtcacgggcatcagtcggggtgggtgcgtgtcagtccatcctgatgagctccctcgggtgtagacagcagattcagggcctcgtccttcttaaaaaggagaagcaaaccccctggcccggcattgggtgtcaagcctgcagccccagattccaccctacctgtttgagggcagggtcaggcgggtctgccctccagcaggtgcccccacatccccctgagtagcccctgcctcagccaaaagacacacatacaccagcttgattcttccaggatttcaatttcatgtttctgtgatatttgggactttttccaaagcagcgagtctgggcactggtttttaccttgtggtggcacgcaggtgcctgtgtccgcgctttggagccaggtcgccctggcagcctcagtgccctgcactggcctgcacctggctctgcccagctcttggcccgggcagggagggtgagctcagtcctcacggtggctccaagcctcctggcctggctcgaagtctcacaggcagagctgtgtggggtcccatcggaggcacggcctcacttgtactcagctgctgctgtggccctcccagggctggtgacctctctgtgcagcccatgttcccactgcccatcagtcagccctgtgctcacccttccctgtccccaccacaatgtgtaggccactgcaggcctgcccctgcctctgcccctgttcctgttcctgctgccacagccacttagcctgtcctggtccccaataggtccgaggggaagcaggctggccgacggggccggagcacatccttgaaggagcggcaggcagcacggccccagaatgagcgggccaacagcctggacaacgagcgctgcccggacgcccggagccagctacaggtgcagctgcaggtgggggtggagggcgtggcacgcccaggaggcagggctcgtggtcaccctggcaccaaccagagcagggcaaaaagagaagcacagggggccaagggtgctgggccacagagcatgcctgggctttggagggctcctgctacacagcagggcgggcgggccatgggttggtttgtcaggaagaccatgtggaccccagggcaagttctagtccttctgctgccctccctggtccagggcagcctcattgcttggctgatttagcccagggcagttctccaagctggccagctctcttcctgccaccgagcctctgtggctgcagggggagcaggggcactgcaggcaccagggctggcgtggtggggatgggcgctgtgcttctcttctgggtgtggacagggctctgtgcctccagatccccaggaagactgtgtatgaccagctcaaccacatcctcatctccgatgaccagcttcccgaaaacatcatccttgtcaacacctcggactggcaggggcaggtagaggggcagtctcttggagtggagggtcagggtgtaggacagaggagagtgggttcctgaagctgccccctacccggcacacctgggtgctggagctgctggctgtggtttgcctggacgtgcctggggtctctggagcccctgagagctttggtgagggtcaggtgctgggggtggcctgggcggctgtgccgaagtcagcgtctgcctgtcttctgccagttcctctccgacgtcctgcagaggcacacgctccccgtggtgtgcacgtgctctcctgcggacgtccaggcggccttcagcaccatcgtctcacggatacagagatagtgagttgggctccaccctgtactcaccacccaagtacccctcggggtccctgcacccccacctctgcccattgctccggggctaggtgcgtcctggacctggggctgtggctggtgtccacagaggctgacccatgcgctcttcgcagcctggcctcccctcagttgtgggcgggagcagcagcctggtgggtgtcctgccacactggagtggtggcctcctggcctgtccttggaagcctgggctgaggccatgactgtgtggtccctcagcctgggcacgtttgggcatgtgggggtcctgggcttgggcagctccagggcagttgtggcatgagcggccacaggcacggagccccctgggctcacactggcatccttggatggaggacggctcccctgaggcgtctgtcccctctccgtcccacctgcctctggattgcagctgcaactgcaattcccagcccccgacccccgtgaagatcgccgtggcgggagcgcagcattacctcagtgccatcctgcggctctttgtggagcagctgtcccacaagacacccgactggctcggctacatgcgcttcctggtcatcccactgggtgagcaccacgccgtccacctgggcctgggcacagatgccacgggcagtgtggcgtggcatggagtggtgtggcgtggcgtggcgtgttgtgtggcgtggcgtggcgcggtgtgtcgtggtgtggcgcggtgtggcatggcgtggtgtccctgcttgctacacatttgttgtttttaaatgtttgtttgatacagtaacactttgttaattttaattatatgcaagataacttgattgccctaaaacagccatttgggtcaagataaagccatcgccctctgaaggggcctgagctgggtgtctcctccatcagtcgctgtgataactctatgccagtttcgatttccaaagtcagaagtgcaaagcagggctcgttattaatcctctcaaatcgtccaggtcctgtgtcgtcgaactccattacttctttaggtccatacgatgtgtcttaccacgaaacaaacccacccagccttaatctgttgaccagcagcaaggcctggaggcgacacctctcccgtgtggccctcacgatgccgacgtcagagccctgagccagccgaggcctctgcacggtcacatgtgccctgctgggccttcctcagtggcactcagggctctgggacctcagctcagggctggagctccttcagcggggccacaggcatccaccagggaggggcagtggtggctttctctttcggtggcaggaaagtgggcttgtctggaaggcagcagcacaggcctggggtcgggtggcccagcttttgtgccgcggtgggagccttgcagctccgagtcccccgtggtgacaccagccccacccctggcatgcaggctcccaccccgtggccaggtacctaggctccgtggactaccgctacaacaacttcttccaggacctggcctggagagacctgttcaacaagctggaggcccagagtgcgggtgaggcccgggcgcgtccacagcccacgccacggcgggaggaaggggccccggtttccccagatgctgtgcccaggaggccctgcacctgctcaggctcagcctcagggaagaggccatggacagggcctgctggggccttggccaggatgcctcctattcccctgagccttggaatgttggaagctgtggggcctgtctgggaaggggcgggcacagcccttcaggtcttcccacgcttgccctggtactgcctcgagagtagagcaccagggcccctcagctgcaaccagcgagccctgccgcgcttcggggtacgggaggcctgggcggggcaccggggaggcccagcttagccccgcctgcaaccccacctggcaccagcctaaccccccaccgcctcctccccctgcagtacaggacacgccagacattgtgtcacgcatcacgcagtacatcgcaggggccaactgtgcccaccagctccccatcgcagaggccatgctgacctacaagcagaagaggtaacgcggtgggcccaggcaccataccacaggctgccgccagccaccaaccctccgtgggcctccccacccgctgctgggcttggcctggtgggccgcagagccctgcaccgggcttagaccagagcctgggccagctgggcagctctgggcctccctgacagcaggtgcttccccgcaccccagatccctcatagtaagcgccatttccgcacctgtttctgtgcatgttgaaaccccgcgtgataagaagttgacagaatggatagctgtcatggggccagggtggcagtggcccagcccctccagtctgggcacctgttccttccacagcctgggtttctcgggctggggaacgaaggattccctgggcctcgggccctgtgggtgagtgatcagctcgtgtcctcacctgcccagagcaggacggtgctcaggagcccccggccgaaagtcctgcggagacctgtctgtcccgcccggcgcctcctccctgcacatctggcgccactgtcccacaccttccctagactacaggggagagagccgagtgcaaggcgcaaagccagcgctcacgggctctcccacgcaggagccccagtgagatgggagccactgagtgccctcggcggtccctggaggggtcctgagggcgtcgtaacgtgtctgttttctcttttggtggctttctgaaaaggaaaaagcattttcattttgactttaccctaaggtacggctctgtgggtctgcctcccaccctgtctgtccccaggctggtcttcagggcttgtttggcagagtcacgtaggaatcaccccgctgtcctctctccggactgggagtcaggccctgagggccaccagctgcaggctgagagcccgcacgggagaggggaagtggccccaacccgagtcactttttgctgacgtggacccttttcctccatccgatctctgacactgagtcaggagagcagcagatgggccctcctgtccctggccaggcccgtgtgctgggactccaccccagagccctgaagcctgcaggtcggccaggcaggcctttccccggctctgttttgaccctgggttttgatttaagaagtggccaggtttagcccctcctcgttttaaaccaggagcgagtggctggtgtggacaccaggatcacctgggccaggctgtttcccaggcccttcacgtttgtgaagctggcagcagcctagcaggggcacgggtgcacgccctacacacggggacgcccaagcaagtagttaaggagctggcctggtgacacggtggtcagcggctgtgccttgggccccctacacactgcagagcctggctcccagggctccctcgagcacctggggccagcagagaggggtttccagcatcttgtggcttacctggagacggggccaaactaccgagacctccaaatgggggtaaagagttttcattccgaggcagctccaccccctacaacctttcatgttcagagccaagtcccaggcacccccaaagctgccctttcagacagagccaccccttttccttggccaggtgtgtcctgctgcagggtgggggcccctgctggtcctcccatgggctcgttctctaccccgtgtcttctgccctgtgtgaggtcatttgctgtcctaggaaacccccccaaccccctgacctcagtgcagggtagttgggtccctggggcccccttgctggcctaggagctgctcgaagtgggcagcctgggaccacccacagctgtagggctgggcgctgggaagacacaggaagggggctgaacatcctatgtcttgtcctgctaaacaagccttcacaggtgaaagaccagccgtgggggcctcccctgctgacccccagcagcctccgcccttgccccctggctgtggcacgaggagcctgcagcatgttctggccgcccggccgccgcaggccgtggacgcagctgcttgtatctcccaggtcagctcttccaagcagcaagccagggccttagggggccttacacccactcccaccctgcacctcctgcccctgcctccgtgttgcaggggtgacactggctgcctccacgttataagggtgacactggctgcctggggtcctggaaggaacccagcaaaggccataagtgtcttacctgctctctgtacccagaggagggtcagtcgggaggctgagagagtgcaggcggtggcacagcccttgtgacgggggacctgtgcagagccctctccagccaggctcccctgcgagagtccctcgtgaggtgactcctgctggcccgccctcctctgccgagaatggcactcctcctatgagggcaggccaggcctggagggcggcctcgagccccagcctgcccgtgcagcgcatgggtggaaagggctgctcaggcatccggcagcttgcccagggccatgcggagtggcccccaaggcatctgtgccctccgtgcccgcggggcctccccacgccacggtggtatgctccttacactcctgaccacactgcctccacagacatgtgtgtgcctccagggtcaggatgagggtctcagtgtccagccggtgtcacccctgtcatattggcccatgtccagggctgggtgctgtctgcatggcccagaggcgcagcttggctttgagagttccagcaacatccctgtgttgtgacgtctcctgcattcggccctcatctgccacgcactgccccatgggcctcggagcagagcatggatgggaggccagcctgccatggctggctcggtgggggggtctggctcggcagagggcaggtggccctgggaattggagccacccatgccctggggaccagcagccaccacctgtcttctgtgccttcgcgtgcctgggaggacacagatgtcacagatttccaaacactggtctgctcaacaaggatagtgggatgtcaaaggccacgtccaggcactcctgcctgacagctgtggacacagccagggtgctggggggccaggaggccgccctgaggcagaggtgggcctcaacacaggatttgcatcgctttatgttatttgaaatggacaagaagaggggaaagtttcaactcttctccttagaaatggaactaggcctggggcatctttaatgggatgggaggaatctgtaggtggtttcatccagaggcatttgccaggtcttctgcagagggtgggccaggagccgtccaggttggcgtctggggagggtgggtcttgccagccgccgtctcctcacactggcgctgcgaagacagggaaggcacctgctgggaccagccgcagaggctgcctcctgggagtgtgctctggaccggctgccgggcagaggctgttttacttgtgggcacactttgtggggagcactgggatcaagcctctgccctgcagggctcttgaggagatagcgctgctggtcctgggagctggtgctccaggcagacggctgggctgggcctgtggcatcctccgctgggcctgtttcctgcaagggattctctctgaatgaccctgtgctggacgacaacccaagggagggccggggccactgtgcgagcccatgttctgcacctggtgccgggctgtccctgagggccaccctgctggcctggccattctcgtcctgcccccggcgctccaggggcaacaggtgctcctctgcactgtgtgtgcacagtctccgcctgtaagacagccacttgccggcatcagactctgcagtttggggaaatgagacagaagaaacagctgagggagctgcccagagagaaggcaccagttgctgatgcggtctggctgaggaagctgggcggggaggcacctctgtccctacgtgcaggccacggggggccttgaggccaggggagaggaggaaagaggagagccagacccagcccaccactcaggataggccctgccctctggatctttcctggggcccagaaggagatgccctcacctcaccctagctgccggcggggcctcatgctgtgctggccccttgtcttgtgggagagctccctgggcccaagcccaggctgcagtgggcacagtcagcaggagcctgtgcgagctggaccacaggacagccctgcttgagctgcacacgtcggaggggaagacagacgggtcccctcagcggccccgcggctcctgtcctccacccttggcatcttcgtgtggacgggctgtgaccagacttccaggagaggctgctgttacctgccagatgttgtatggggccaagtccaggcaaaacctccactgcccgctgagtacatcagctcacgcggggcacggcctggggtgtgctgggcctgcctgcaggctgtgcgtggggtgttctggtagaacatggaggcccactgcagccaaagcctggcctcttatgtgggcatggacgttacccagatagtctggagaaaacttctgcaccctggctttggtgctgctgattaccagagagggcccaggctcttcctgggagtcccagggcactggcagctgccctaaccccagcagagcaggggtgcccagcttggtggggaagtggaaatgcaagccggacagggctgagctggctgtgtgggcgtcgggcacctaggatggcagagtgaatccctccgtggagctgtgccctctggcctgtcctcctgaccatgggtgcacagagacccctttgtccttccagcatgtcagcatgtcagaaggggcccaggcgttggtcctgggggccaggccagggctggcagtggttggagatgggtggggccgggacacacagggcagggctgtccggcagggccatccggcagggccgcggccccagggctgcgccaggttctcaggccaagagggagctgtgcccaccaggcggggctgtgccctgaggagagcttaactgtctgtttccttgctcttagccctgacgaagagtcctcccaaaagttcattccctttgtcggggtgagtactggccagctttatgtgatgggaaaccgcacacctgccaacttgtcgtttacagtcagaacgtttggggattgactcgatatattccagaaccttcccacagatacgagctggggatttgccttcccatctggcctgtctcaaagctcgcttccttccctgctggagtggggtgtggggccagaggttgttagttccccttagctctgccttgggggctgataaatggaagcagagacaggtcggtggggcgaggcctcagaacacccaggaggcttggccccacgtctcaggagaggagagactgcctgcccgggttggggagggcgcctctgtcctttaggagcccaaggccccgggagcttcccagtgctcacttgggctgcagcctgcagtgtgtgggtttcacttcctgccctgcccagggttagggctgcttctgccagccaggccatctccctgccagccctgggtctccacagcctgtttcctgccatcttttcgctctgttgtgtggcctccctcccgccaggtgtctgctgtgagacagacccacagggcctggcagacaggttgcccaggcagcggaagggtctctgggcctcggtttccccactggtggaacagaggcctttttgtgcaccgtgcagtggttgggtctgctgagggctctggggcgatggctggccctctgggagggtggaattcgtcttgaacagcggctgcccaaagagctttctccggtgacaagagtacactgtgctcgggcacacaggccttcccatgcaaccaaggccctgcggtgtcactgggattcacggtagatctacgtagccgcctgtggctcgtggctgccaggtccggggcctatccccgtcggcccgccaaggtccctctcaccagcgtcctgtttttactgcacacatagtttgcagctgccctgagggccgactttagagagagcagtccctcctgctgaggccacgcaccctgagcactgtctgtccccacatggctgctctgagctcagctctgctccacagatggggagagaagggcaggagggagctggcaccacctggccgctccagcatcatgggagtggtggccacggtggggaggcgggagccccactgggagggcgctgggctagctgaattgcacggctttcaccagccagtgcctgttgttttctaggttgtgaaggttggaattgtggagccatcctcggccacatcaggtaaccccgtcccaccctgaggccttgtgagtggcccgtgggtgggctgcaggagcacggtcattcgagtcctgcagaccagatcaacctttcagggcctgagagccgccacgtcccagtcttgctgtggtgcttctgtcctgcggggggttcatcctccaaggactgctgtcacaaagccccacatcaaggctggcagggttgtcttccaaaaaccgaggagaatccgagaccctcccgtctctcacaggccactggggactcccaccctgcccacccccaggagctgcctggcctggccacatcctggtccggagggcctggtggcacccgggcagagcagcaggtgggctcagcctgccctgtgactcctccccaaaggcgactcggacgacgcggccccctcgggctctggcacgctctcctccaccccgccgtccgcatctcctgcggccaaggaggcctcacccaccccgccctcctccccgtcggtgagcggaggcctgtcctcccccaggtaaaggtgcctcacggctcagcacgtttcacttacccgccccaccacatgctgcctgattcagtcatcctcccctatgtcacatccacctcccagggcacctggcctgtcagccacgaaggcggaggggctctgcaggacggctgggtcctctctggccacctcctgccacagatctggtgtttgggggcaggacctctgggggacagaaactcctgcacagtgaataaacatgggcgttgtgctgggctgtctctcagctctgtacacagttggggcttttaaaaaacaagctgagggcagaaggtgcaagagacgtgagtctctagacggtcctcatgggatgagcttcgatagctgtgctgaggccccgctagcccgcccgggtctctccggagcagacctcactcaagtggaactaagccatggggggttgtgggccctgaggccaggcgtggtgctggtgctgcgtgcagggctcacaccagcagatacccccccgacccccctgcctctgtgtttccagccgccggctccttccaggctgcgcctgagggagctggttcgcacgggccctcacgactccaaggggcagcttggagagcaggtggacaggcctcccaggccgaggctctcctgtcgccagggtccctgtaatttaagcaggacccttgtgggggtgactgggcatgtgaacagctccacagagcatgctccaagcacccggccctcctctgctggcaagttggcacaggtgctggctgtcacctcctggcctgtcacagggacagtgatgtccccatcactaggcccaaagatgcaggtgtgaatgcctccctctgcctttcccagccagggtgtcggcgccgagctgatggggctgcaggtggactactggacggcagcacagcctgcggacaggaagagggacgccgagaagaaggacctgcctgtcaccaaaaacacgctcaagtgcactttccggtccctccaggtcagcaggctgcccagcagcggcgaggctgcagccacgcccaccatgtccatgaccgtggtcaccaaggagaagaacaagaagggtgaggtggggcaggctataaggccacacggcgcagaagggcggctctgtgggagagggcggctcgcagtcaacagggatgacagcccccgggctggcctcgggcagcccacatgcgcaggcaggggcgggtggggtgagggagcctgaatcctgagggcagtgagggtcaggtgcttctgaccagagcctcaggcggaggccagctgggtgggcaggagagcagctgtcctcagtcaccgtggaaggcaggtttcctaggtgagcagtgccatgaccagctgagcccccagtgcctcccccacacgtacccctggccctggccccagccccgaaggagcagcaagatgacagcagggcctcttttctcctcccagtgatgtttctgcccaagaaagcgaaggacaaggacgtggagtctaagagccagtgcattgagggcatcagccggctcatctgcactgccaggcagcagcagaacatgctgcggggtgagcaccaccggccccggggtctgtagagtgggacgtaggtgagagcacagcaaggctgctttggagcccagcctaggagctgcgggtgtctcgctgtgacacgcacattccacgattcaaggtgcaagcacattcgatgaagccctcagtgaggctgacaaccttccaaatgctgagaaagaattttttttcaaccctttttgctttttaaaaataatgacttgtttcgtttttcttgtttgttttttgttttggtttttttttttttgagacagagttttgctcttgttacccaggctggagtgcaatggtgtgatctcagctcactgcaacttccatctctcaggttcaagcgattctcctgcctgagcctcccaagtagctgggattacaggcgcgtgccaccacgcccggctaattttttgtatttttagtagagatggggttttaccgtgttggccaggctggtctcaaactcctgacctcaggtgatctgcctgcctcggcctcccaaagtgctgggattatgggcgcgagccaccgcacctggcctaaaaataatggcttgtagtttaaaagtgttggctgagcgcagaggctgaggcaggagaatggcgtgaacccgggtggcggagcttgcagtgagccgagattgcgccactgcactccagcctgggtgacagagcaagactccgcctcaaaaaaaaaaaaaaaaaaaggggttttggagaagatactctgcaagtaactgtttcagaaacggagctctgggaggctttcctctttttgagcacgggtcagatgacctccaggtcgacgtggccctgtctccccacaggggtctctgttttaagggggctcccactgtcttcttcccacacctgtgcaggtggaagtggatgtggacgagcagcgcctggcggaaggtggtggggtctgctccttccacctgcaggcagccctgggggaaatgctgccctccccaccccccagggctctgagtgtggagggcaggggcaggaatggcgtccctcaggagccagcatggccctggagcccccgagtccctgaggaaagtgttgatgccctccagcatggggctccttctcatcctgtacgcccggctgccacccagcctggtgggccaggcaggcaggtggatagggtgggcaggccgggcaggggggcaggcggtcaggcagccctctcccacagtcctcatcgacggcgtggagtgcagcgacgtcaagttcttccagctggccgcgcagtggtcctcgcacgtgaagcacttccccatctgcatcttcggacactccaaggccaccttctagccccacccaccagggggcccacctcctgccccatgctgtgaggggcccagctgcatttctgttaacatttcagtttactacagagacagacgcttaaaacacaaagagaaacagtcttaagtatgaatgtgctcacaacgtggaaactaacgggggagctcctgccaggagccgaataactgctctgcttattaacccgaacgttcggcccggggctgggaagccagaaggacgatgctgagccatggatcgcggaaggcgtcctctggcctcaggagccacccagagcctcacaggctgagttcttgcctctgtgtcctgtccttcctggaagtcaggactctgcttcctcagggagcccggggaaggcggagctcagtggccacaggccgagggccatggggccgctcagtcccgttggggttgtcctgagttgagcctgggggggccgtcctgcccgcctaagagatgcccccagcaccgcacactcgtggttcccaataaactcctgcctgcggcggaggttttatagcagcagatatttttaatgcttttcaatacatgttctaatgtagctgccaaacatgttgctcttctgaagtccccctggggctgggcagagccagcagagcctgcccccacttccccagcccctgccccaccccgcctcacaccttccccactctcaggctgttcttgaaacaccatgaggcttctgcgtgtagtccctgccccaaacttagcaagcacaggggcctccacagcccaggtggccccagaaaatgttccagagcccagcttggtacatagtgagatgctgctggggttggcctgaggtgggggccacttcctccaccccagtgggtatgtctgaggtcagccatggggatatctgggttgagattcaggttttggtgaatatggggcaggcgtccagatgtgtttgtgtcacctgctgcaacgctgtagccaatgaagattccagcgggatggcctgaccagcggggccggcactttggagccgtgggtgcagccaggtaccccgtgcagggcctgggaggctctccaggccacagtcctcagagcgtgttgggtcccatgttgtgtgtgggttccatgccctccacacagcaggagagggcttccctgaccacacctgccccctcagtcctgcttctccccagtaagcctgcactgtggggtctccataggaggagctggggaagctggggccctcccaggggtcctgatcgaccctgggggctcttggcctggtttcgtaagatggagcactgcaaaaggccatgctcagaaagcaaacgcagggcagggtgggcctcgagccggggctggaggggtctccacccttgctggcctgagagatggcccacatttcttacttgtgaccgccctgctcttcctggccgccccccccaggtggctgaacagggtgattttgttgtggtgaggggccaggatgtggcctggtgtgcagcctcagctccctgggttcaggcctcagaggtagcctgtgtgcaggaggcagagccccagcccctcccagccagagcccctccacaccagggactcctccttcacctgggaccaggagcctggggcacaccccagggtgggggagagggtaggaaggtctcccattgaatcctggcttcaggctctgccccgagaagtgtctgcggtgagggtgtgagccccgggctgatggcctctgaccccggcaacaggtgggaccctgactgactcgttcagctgcccccaagctgggctgcagagcatctgtttttctgctctccagtttcttttctttttttttttttttttttttgagatggagtcttgctctgttgcccaggctggagtgcagtggcatgatctcagctcactgcagcctccgtctcccaggttcaagcagttctcctgcctcagcctcccgagtagctgggattacaggcgtgtgccaccacacctggctattttttttgtatttttagtagagatggggttttgccatgttggccaggctggtcttgaactcctgacctcaagtgatccacccgcctcggcctcccaaagtgctgggattacaggcgtgagtcaccgcgtcctgcctgctcttcctgtttctttcccaagggtcacactcagtagggagatgaaggtggaaacatccttgctgtggctttctggcctcagagcaggttttagaggaaggggccacaggctgcctagtgcatcctggctgtgggcagcccctttcctggagccctcctgcctaccccgtacctcccatctggctgcacagctccatccttagccacgcaaggggagaacatgggcagagtctccatccagcagctgggggttctggtggcactccctgtgcccctgctgctgctgggctgtgggtctgccctgcacccaggagccccacggtccatcccccacaccatgcccagcaccagggaggttgggcagacaagacctgggccatgccagccctctgtgcctcggttttcccactggttacacaggatggtcgcattttccctgcctacctcacagagctgttctgagggtgcatggaggagcactctgtcccaccaaggacaactagaaaccaaagccatctgacagccagtgcggtaagggcgggggatgtgtgtgtgaggtgtgcacaccccccgagaacctggccctggactggcctcacaggacaggaggcagccccttgtagagctagggctcagccccatcagtctcaaaggttaagccaccagtcaccaccgaggcacccctcaggcctggtggccactgtccactattacgtagacagaccccaccctcacccaggccagctgtgggccagtcccgccctgcaatctggtctgctgccttcctcttccatgttggtccccttggccactgtctctgggcatgcaagccagtgtcctggttcagtgcctcggccagagctggggcaggagaggggcctctgggtgagagctgggggtgtctctgcagggtactggcagccttgccacactgtcctcattcccagatggaaagacctgagtgcctctcgccttcctccgggaatgaattcctcatgaaaatgaccaggccacttcttccgagggccaggccgccccctccccgagacctgtcctgccgtccgcgggtgtgtggcctgtaggggactgagagctgggcttgctgggcacctctggaatctgaccctgtgggccaaagaagcaccactgtagtttctgcagacccccatgcggttcattgtgcattgtttggtttctaggatgtatgtgttgctagttttttttaatgaaaccctggattaatgtaaatagctttttggggaacggattctaatgtcacgtatgtgaccgtgtggactatttcaaggtgctgatgcaacactaataaacctggaggggccggc

SEQ ID NO: 1262 - DNA, 83734 bp, Homo sapiens; identical to SEQ ID NO: 1261
